US006566127B1

(12) United States Patent
Pavco et al.

(10) Patent No.: US 6,566,127 B1
(45) **Date of Patent: *May 20, 2003**

(54) METHOD AND REAGENT FOR THE TREATMENT OF DISEASES OR CONDITIONS RELATED TO LEVELS OF VASCULAR ENDOTHELIAL GROWTH FACTOR RECEPTOR

(75) Inventors: Pamela Pavco, Lafayette, CO (US); James A. McSwiggen, Boulder, CO (US); Dan T. Stinchcomb, Fort Collins, CO (US); Jaime Escobedo, Alamo, CA (US)

(73) Assignees: Ribozyme Pharmaceuticals, Inc., Boulder, CO (US); Chiron Corporation, Emeryville, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 09/371,772

(22) Filed: Aug. 10, 1999

Related U.S. Application Data

(63) Continuation-in-part of application No. 08/584,040, filed on Jan. 11, 1996, now Pat. No. 6,346,398.
(60) Provisional application No. 60/005,974, filed on Oct. 26, 1995.

(51) Int. Cl.[7] .......... C12N 5/00; C12P 19/34; C07H 21/04
(52) U.S. Cl. .......... 435/325; 435/91.31; 536/24.5
(58) Field of Search .......... 435/91.31, 91.1, 435/325; 536/23.1, 23.2, 24.3, 24.33, 24.31, 24.5

(56) References Cited

U.S. PATENT DOCUMENTS

| | | | | |
|---|---|---|---|---|
| 4,987,071 A | | 1/1991 | Cech et al. | |
| 5,334,711 A | | 8/1994 | Sproat et al. | |
| 5,359,051 A | | 10/1994 | Cook et al. | |
| 5,525,468 A | | 6/1996 | McSwiggen et al. | |
| 5,631,359 A | | 5/1997 | Chowrira et al. | |
| 5,672,695 A | | 9/1997 | Eckstein et al. | |
| 6,346,398 B1 | * | 2/2002 | Pavco et al. | 435/91.31 |

FOREIGN PATENT DOCUMENTS

| | | |
|---|---|---|
| EP | 360257 | 3/1990 |
| WO | WO9103162 | 3/1991 |
| WO | WO9207065 | 9/1991 |
| WO | WO9312569 | 4/1993 |
| WO | WO9315187 | 8/1993 |
| WO | WO9323057 | 11/1993 |
| WO | WO9402595 | 2/1994 |
| WO | WO9411499 | 5/1994 |
| WO | WO9421679 | 9/1994 |
| WO | WO9421791 | 9/1994 |
| WO | WO9511304 | 10/1994 |
| WO | WO9504142 | 2/1995 |
| WO | WO9504818 | 2/1995 |
| WO | WO9513380 | 5/1995 |
| WO | WO9521868 | 8/1995 |
| WO | WO9523225 | 8/1995 |
| WO | WO9610390 | 4/1996 |
| WO | WO9610391 | 4/1996 |
| WO | WO9610392 | 4/1996 |
| WO | WO9622689 | 8/1996 |
| WO | WO9700957 | 1/1997 |
| WO | WO9726270 | 7/1997 |
| WO | WO9813526 | 4/1998 |
| WO | WO9828317 | 7/1998 |
| WO | WO9858058 | 12/1998 |
| WO | WO9916871 | 4/1999 |

OTHER PUBLICATIONS

Usman et al., "Chemical modification of hammerhead ribozymes: activity and nuclease resistance," *Nucleic Acids Syposium Series* 31:163–164 (1994).
International Search Report, PCT/US96/17480.
U.S. patent application Ser. No. 60/005,974, Pavco et al., filed Oct 26, 1995.
U.S. patent application Ser. No. 60/082,404, Thompson et al., filed Apr. 20, 1998.
U.S. patent application Ser. No. 60/101,174, Hartmann et al., filed Sep. 21, 1998.
Aiello, et al., "Vascular Endothelial Growth Factor in Ocular Fluid of Patients with Diabetic Retinopathy and Other Retinal Disorders," 1994 *New Engl. J. Med.* 331, 1480.
Akhtar and Juliano, "Cellular Uptake and Intracellular Fate of AntiSense Oligonucleotides," *Trends Cell Biol.* 2:139–144 (1992).
Bartel and Szostak, "Isolatin of New Ribozymes From a Large Pool of Random Sequences," *Science* 261:1411–1418 (1993).
Beaucage and Iyer, "The Functionalization of Oligonucleotides Via Phosphoramidite Derivatives," *Tetrahedron* 49:1925–1963 (1993).
Beigelman et al., "Chemical Modification of Hammerhead Ribozymes," *J. Biol. Chem.* 270:25702–25708 (1995).
Berkman et al., "Expression of the Vascular Permeability Factor/Vascular Endothelial Growth Factor Gene in Central Nervous System Neoplasms," 1993 *J. Clin. Invest.*91, 153.
Breaker and Joyce, "Inventing and improving ribozyme function: rational design versus iterative selection methods," *TIBTECH* 12:268–275 (1994).
Breaker et al., "A DNA enzyme with $Mg^2$–dependent RNA phosphoesterase activity," *Chemistry & Biology* 2(10):655–660 (1995).
Breaker, "Are engineered proteins getting competition from RNA?" *Current Opinion in Biotechnology* 7:442–448 (1996).

(List continued on next page.)

*Primary Examiner*—Sean McGarry
*Assistant Examiner*—Janet Epps
(74) *Attorney, Agent, or Firm*—McDonnell Boehnen Hulbert & Berghoff

(57) ABSTRACT

The present invention relates to nucleic acid molecules which modulate the synthesis, expression and/or stability of an mRNA encoding one or more receptors of vascular endothelial growth factor.

5 Claims, 35 Drawing Sheets

OTHER PUBLICATIONS

Burger et al., "Experimental Corneal Neovascularization: Biomicroscopic, Angiographic, and Morphologic Correlation," *Cornea* 4:35–41 (1985/1986).
Burgin et al., "Chemically Modified Hammerhead Ribozymes with Improved Catalytic Rates," *Biochemistry* 35:14090–14097 (1996) (volume no mistakenly listed as 6).
Carter, "Adeno–Associated Virus Vectors," *Curr Opi. Biotech.* 3:533–539 (1992).
Caruthers et al., "Chemical Synthesis of Deoxyoligonucleotides and Deoxyoligonucleotide Analogs," *Methods in Enzymology* 211:3–19 (1992).
Cech, "Ribozymes and Their Medical Implications," *JAMA* 260:3030–3034 (1988).
Chartrand et al., "An oligodeoxyribonucleotide that supports catalytic activity in the hammerhead ribozyme domain," *Nucleic Acids Research* 23(20):4092–4096 (1995).
Chen et al., "Multitarget–Ribozyme Directed to Cleave at up to Nine Highly Conserved HIV–1 env RNA Regions Inhibits HIV–1 Replication–Potential Effectiveness Against Most Presently Sequenced HIV–1 Isolates," *Nucleic Acids Research* 20:4581–4589 (1992).
Chowira et al., "In Vitro and in Vivo Comparison of Hammerhead, Hairpin, and Hepatitis Delta Virus Self–Processing Ribozyme Cassettes," *J. Biol. Chem.* 269:25856–25864 (1994).
Christoffersen and Marr, "Riobozymes as Human Therapeutic Agents," *J. Med. Chem.* 38:2023–2037 (1995) (also referred to as Christofferson and Marr).
Collins and Olive, "Reaction Conditions and Kinetics of Self–Cleavage of a Ribozyme Derived From Neurospora VS RNA," *Biochemistry* 32:2795–2799 (1993).
Detmar et al., "Overexpression of Vascular Permeability Factor/Vascular Endothelial Growth Factor and its Receptors in Psoriasisi," *J. Exp. Med.* 180, 1141.
Dreyfus, "Restriction Ribozymes?" *Einstein Quarterly Journal of Biology and Medicine* 6:92–93 (1988).
Dropulic et al., "Functional Characterization of a U5 Ribozyme: Intracellular Suppression of Human Immunodeficiency Virus Type I Expression," *Journal of Virology* 66:1432–1441 (1992).
Duval–Valentin, "Specific inhibition of transcription by triple helix–forming oligonucleotides," *Proc. Nalt. Acad. Sci. USA* 89:504–508 (1992).
Egholm et al., "PNA hybridizes to complementary oligonucleotides obeying the Watson–Crick hydrogen–bonding rules," *Nature* 365:566–568 (1993).
Elkins and Rossi, "Ch. 2—Cellular Delivery of Ribozymes," in *Delivery Strategies for Antisense Oligonucleotide Therapeutics*, edited by Akhtar, CRC Press, pp. 17–220 (1995).
Elroy–Stein and Moss, "Cytoplasmic Expression System Based on Constitutive Synthesis of Bacteriophage T7 RNA Polymerase in Mammalian Cells," *Proc. Natl. Acad. Sci. USA* 87:6743–6747 (1990).
Fava et al., "Vascular Permeability Factor/Endothelial Growth Factor (VPF/VEGF): Accumulation and Expression in Human Synovial Fluids and Rheumatoid Synovial Tissue," 1994 *J. Exp. Med.* 180, 341.
Feldstein et al., "Two sequences participating in the autolytic processing of satellite tobacco ringspot virus complementary RNA," *Gene* 82:53–61 (1989).
Ferrara, "Vascular Endothelial Growth Factor," 1993 *Trends Cardiovas. Med.* 3, 2244.
Folkman and Shing, "Angiogenesis," *J. Biol. Chem.* 267:10931–10934 (1992).
Folkman, "What is the Evidence that Tumors are Angiogenesis Dependent?" *Journal of the National Cancer Institute* 82:4–6 (1990).
Folkman, "Tumor Angiogenesis" 1985 *Adv. Cancer. Res.* 43, 175.
Forster and Altman, "External Guide Sequences for an RNA Enzyme," *Science* 249:783–786 (1990).
Frier et al., 1986, *Proc. Nat. Acad. Sci. USA* 83:9373–9377.
Fong et al., "Role of the Fit–1 Receptor Tyrosine Kinase in Regulating the Assembly of Vascular Endothelium," 1995 *Nature* 376, 66 Corrected from specification.
Gao and Huang, "Cytoplasmic Expression of a Reporter Gene by Co–Delivery of T7 RNA Polymerase and T7 Promoter Sequence with Cationic Liposomes," *Nucleic Acids Research* 21:2867–2872 (1993).
Gitay–Goren et al., "The Binding of Vascular Endothelial Growth Factor to Its Receptos is Dependent on Cell Surface–associated Heparin–like Molecules," 1992 *J. Biol. Chem.* 267, 6093.
Grant et al., "Insulin–like growth factor I acts as an angiogenic agent in rabbit comes and retina: comparative studies with basic fibroblast growth factor," *Diabetologia* 36:282–291 (1993).
Griffin et al., "Group II intron ribozymes that cleave DNA and RNA linkages wit similar efficiency, and lack contacts with substrate 2'–hydroxyl groups," *Chemistry & Biology* 2:761–770 (1995).
Guerrier–Takada et al., "The RNA Moiety of Ribonuclease P Is the Catalytic Subunit of the Enzyme," *Cell* 35:849–857 (1983).
Hampel and Tritz, "RNA Catalytic Properties of the Minimum ( . )s TRSV Sequence," *Biochemistry* 28:4929–4933 (1989).
Hampel et al., "Hairpin' Catalytic RNA Model: Evidence for Helices and Sequence Requirement for Substrate RNA," *Nucleic Acids Research* 18:299–304 (1990).
Haseloff and Gerlach, "Sequences required for self–catalysed cleavage of the satellite RNA of tobacco ringspot virus," *Gene* 82:43–52 (1989).
Haseloff and Gerlach, "Simple RNA Enzymes with New and Highly Specific Endoribonuclease Activities," *Nature* 334:585–591 (1988).
Hertel et al., "Numbering System for the Hammerhead," *Nucleic Acids Research* 20:3252 (1992).
Ishiwata et al., "Physical–Chemistry Characteristics and Biodistribution of Poly(ethylene glycol)–Coated Liposomes Using Poly(oxyethylene) Cholesteryl Ether," *Chem. Pharm. Bull.* 43:1005–1011 (1995) (mistakenly referred to as Ishiwataet).
Ishizaka et al., "Isolation of Active Ribozymes from an RNA Pool of Random Sequences Using an Anchored Substrate RNA," *Biochemical and Biophysical Research Communication* 214(2):403–409 (1995).
Izant and Weintraub, "Constitutive and Conditional Suppression of Exogenous and Endogeneous Genes by Anti–Sense RNA," *Science* 229:345–352 (1985).
Jaeger et al., "Improved Predictions of Secondary Structures for RNA," *Proc. Natl. Acad. Sci. USA* 86:7706–7710 (1989).
Jeffries and Symons, "A Catalytic 13–mer Ribozyme," *Nucleic Acids Research* 17:1371–1377 (1989) (also referred to as Jefferies).

Jellinek et al., "Inhibitions of Receptor Binding by High–Affinity RNA Ligands to Vascular Endothelial Growth Factor," *Biochemistry* 33:10450–10456 (1994).

Joyce et al., "Amplification, mutation and selection of catalytic RNA," *Gene* 82:83–87 (1989).

Joyce, "Directed Molecular Evolution," *Scientific American* 267:90–97 (1992).

Kashani–Sabet et al., "Reversal of the Malignant Phenotype by an Anti–ras Ribozyme," *Antisense Research & Development* 2:3–15 (1992).

Kim and Cech, "Three–dimensional model of the active site of the self–splicing rRNA precursor of Tetrahymena," *Proc. Natl. Acad. Sci. USA* 84:8788–8792 (1987).

Kim et al., "Inhibition of vascular endothelial growth factor–induced angiogenesis suppresses tumour growth in vivo," *Nature* 362:841–844 (1993).

Koch et al., "Vascular Endothelial Growth Factor: A Cytokine Modulating Endothelial Function in Rheumatoid Arthritis," 1994 *J. Immunol.* 152, 4149.

Kore, et al., "Sequence specificity of the hammerhead ribozyme revisistsed; the NIH rule", *Nucleic Acids Research*, 26(18):4116–4120 (1998).

Kumar and Ellington, "Artificial evolution and natural ribozymes," *FASEB J.* 9:1183–1195 (1995).

Lasic and Needham "The 'Stealth' Liposome: A Prototypical Biomaterial," *Chemical Reviews* 95:2601–2627 (1995).

Lepri et al., "Effect of Low Molecular Weight Heparan Sulphate on Angiogenesis in the Rat Cornea after Chemical Cauterization," *Journal of Ocular Pharmacology* 10:273–281 (1994).

L'Hullier et al., "Cytoplasmic Delivery of Ribozymes Leads to Efficient Reduction in α–Lactalbumin mRNA Levels in C1271 Mouse," *EMBO J*, 11:4411–4418 (1992).

Li and Altman, "Cleavage by RNase P of gene N mRNA reduces bacteriophage λ burst size," *Nucleic Acids Research* 24:835–842 (1996).

Lieber et al., "Stable High–Level Gene Expression in Mammalian Cells by T7 Phage RNA Polymerase," *Methods Enzymol.* 217:47–66 (1993).

Limbach et al., "Summary: the modified nucleosides of RNA," *Nucleic Acids Research* 22(12):2183–2196 (1994).

Lisziewicz et al., "Inhibition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. U.S.A.* 90:8000–8004 (1993).

Liu et al., "Cationic Liposome–mediated intravenous Gene Delivery," *J. Biol. Chem.* 270(42):24864–24870 (1995).

Long and Uhlenbeck, "Kinetic characterization of intramolecular and intermolecular hammerhead RNAs with stem II deletions," *Proc. Natl. Acad. Sci. USA* 91:6977–6981 (1994).

Mathews et al., "A Receptor Tyrosine Kinase cDNA Isolated from a Population of Enriched Primitive Hematopoiectic cells and Exhibiting Close Genetic Linkage to c–kit," 1991, *Proc. Natl. Acad. Sci.*, USA, 88, 9026.

McGarry and Lindquist, "Inhibition of heat shock protein synthesis by heat–inducible antisense RNA," *Proc. Natl. Acad. Sci. USA* 83:399–403 (1986).

Michels and Pyle, "Conversion of a Group II Intron into a New Multiple–Turnover Ribozyme that Selectively Cleaves Oligonucleotides: Elucidation of Reaction Mechanism and Structure/Function Relationships," *Biochemistry* 34:2965–2977 (1995).

Millauer et al., "Glioblastoma Growth Inhibited in vivo by a Dominant–negative Flk–1 Mutant," 1994, *Nature* 367, 576.

Millauer, "High Affinity VEGF Binding and Developmental Expression Suggest Flk–1 as a Major Regulator of Vasculogenesis and Angiogenesis," *Cell* 72:835–846 (1993).

Miller et al., "Vascular Endothelial Growth Factor/Vascular Permeability Factor is Temporally and Spatially Correlated with Ocular Angiogenesis in a Priamate Model," 1994 *Am. J. Pathol.* 145, 574.

Mitra et al., "A mammalian 2–5A system functions as an antiviral pathway in transgenic plants," *Proc. Natl. Acad. Sci. USA* 93:6780–6785 (1996).

Mukhopadhyay et al., "Antisense Regulation of Oncogenes in Human Cancer," *Critical Reviews in Oncogenesis* 7:151–190 (1996).

Nakamaye and Eckstein, "AUA–Cleaving Hammerhead Ribozymes: Attempted Selection for Improved Cleavage," *Biochemistry* 33:1271–1277 (1994.

Nathans and Smith, "Restriction Endonucleases in the Analysis and Restructuring of DNA Molecules," *Ann. Rev. Biochem.* 44:273–293 (1975).

Neufeld et al., "Vascular Endothelial Growth Factor and Its Receptors," *Progress in Growth Factor Research* 5:89–97 (1994).

Norrby, 1997, *APMIS* 105, 417–437.

Ohkawa et al., "Activities of HIV–RNA Targeted Ribozymes Transcribed From a 'Shot–Gun' Type Ribozyme–trimming Plasmid," *Nucleic Acids Symp. Ser.* 27:15–16 (1992).

Ojwang et al., "Inhibition of Human Immunodeficiency Virus Type 1 Expression by a Hairpin Ribozyme," *Proc. Natl. Acad. Sci. USA* 89:10802–10806 (1992).

Oku et al., "Real–time analysis of liposomal trafficking in tumor–bearing mice by use of positron emission tomography," *Biochimica et Biophysica Acta* 1238:86–90 (1995).

O'Reilly et al., "Angiostatin: A Novel Angiogenesis Inhibitor That Mediates the Suppression of Metastases by a Lewis Lung Carcinoma," *Cell* 79:315–328 (1994).

Orgel, "Selection in vitro," *Proc. R. Soc. London B*, 205:435–442 (1979).

Ormerod et al., "Effects of Altering the Eiconsanoid Precursor Pool on Neovascularization and Inflammation in the Alkali–burned Rabbit Cornea," *American Journal of Pathology* 137:1243–1252 (1990).

Pandey et al., "Role ov B61, the Ligand for the Eck Receptor Tyrosine Kinase, in TNF–α–induced Angiogenesis," *Science* 268:567–569 (1995).

Passaniti et al., "A Simple, Quantitative Method for Assessing Angiogenesis and Antiangiogenic Agents Using Reconstituted Basement Membrane, Heparin, and Fibroblast Growth Factor," *Laboratory Investigation* 67:519–528 (1992).

Perreault et al., "Mixed Deoxyribo–and Ribo–Oligonucleotides with Catalytic Activity," *Nature* 344:565–567 (1990) (often mistakenly listed as Perrault).

Perrotta and Bean, "Cleavage of Oligoribonucleotides by a Ribozyme Derived from the Hepatitis δ Virus RNA Sequence," *Biochemistry* 31:16–21 (1992).

Pieken et al., "Kinetic Characterization of Ribonuclease–Resistant 2'–Modified Hammerhead Ribozymes," *Science* 253:314–317 (1991).

Pierce et al., "Vascular endothelial growth factor/vascular permeability factor expression in a mouse model of retinal neovascularization," *Proc. Natl. Acad. Sci. USA* 92:905–909 (1995).

Plouet et al., "Isolation and Characterization of a Newly Identified Endothelial Cell Mitogen Produced by AtT–20 Cells," *EMBO J.* 8, 3801.

Rossi et al., "Ribozymes as Anti–HIV–1 Therapeutic Agents: Principles, Applications, and Problems," *Aids Research and Human Retroviruses* 8:183–189 (1992).

Santoro and Joyce, "A general purpose RNA–cleaving DNA enzyme," *Proc. Natl. Acad. Sci. USA* 94:4262–4266 (1997).

Sarver et al., "Ribozymes as Potential Anti–HIV–1 Therapeutic Agents" *Science* 247:1222–1225 (1990).

Saville and Collins, "A Site–Specific Self–Cleavage Reaction Performed by a Novel RNA In Neurospora Mitochondria," *Cell* 61:685–696 (1990).

Saville and Collins, "RNA–Mediated Ligation of Self–Cleavage Products of a Neurospora Mitochondrial Plasmid Transcript," *Proc. Natl. Acad. Sci. USA* 88:8826–8830 (1991).

Scanlon et al., "Ribozyme–Mediated Cleavage of c–fos mRNA Reduces Gene Expression of DNA Synthesis Enzymes and Metallothionein," *Proc. Natl. Acad. Sci. USA* 88:10591–10595 (1991).

Scaringe et al., "Chemical synthesis of biologically active oligoribonucleotides using β–cyanoethyl protected ribonucleoside phosphoramidites," *Nucl Acids Res.* 18:5433–5441 (1990).

Senger et al., "Vascular permeability factor (VPF, VEGF) in tumor biology," *Cancer and Matastasis Reviews* 12:303–324 (1993).

Shalaby et al., "Failure of Blood–island Formation and Vasculogenesis in Flk–1–deficient Mice," 1995 *Nature* 376, 62.

Shweiki et al., "Patterns of Expression of Vascular Endothelial Growth Factor (VEGF) and VEGF Receptors in Mice Suggest a Role in Hormonally Regulated Angiogenesis," 1993 *Clin. Invest.* 91:2235–2243.

Stein and Cheng, "Antisense Oligonucleotides as Therapeutic Agents—Is the Bullet Really Magical?" *Science* 261:1004–1288 (1993).

Szostak, "In Vitro Genes," *TIBS* 17:89–93 (1993).

Taira et al., "Construction of a novel RNA–transcript–trimming plasmid which can be used both in vitro in place of run–off and (G)–free transcriptions and in vivo as multi–sequences transcription vectors," *Nucleic Acids Research* 19:5125–5130 (1991).

Takahashi et al., "Markedly Increased Amounts of Messenger RNAs for Vascular Endothelial Growth Factor Augments Revascularization in a Rabbit Ischemic Hind Limb Model," 1995 *J. Clin. Invest.* 93, 662 Corrected from Specification.

Tang et al., "Examination of the catalytic fitness of the hammerhead ribozyme by in vitor selection," *RNA* 3:914–925 (1997).

Terman et al., "Identification of a New Endothelial Cell Growth Factor Receptor Tyrosine Kinase," 1991 *Oncogene* 6, 1677.

Thompson et al., "Improved accumulation and activity of ribozymes expressed from a tRNA–based RNA polymerase III promoter," *Nucleic Acids Research* 23:2259–2268 (1995).

Torrence et al., "Targeting RNA for degradation with a (2'–5') oligoadenylate–antisense chimera," *Proc. Natl. Acad. Sci. USA* 90:1300–1304 (1993).

Turner et al., "Free Energy Increments for Hydrogen Bonds in Nucleic Acid Base Pairs," *J. Am. Chem. Soc.* 109:3783–3785 (1987).

Turner et al., "Improved Parameters for Prediction of RNA Structure," *Cold Spring Harbor Symposia on Quantitative Biology* vol. LII, pp. 123–133 (1987).

Uhlenbeck, "A Small Catalytic Oligoribonucleotide," *Nature* 328:596–600 (1987).

Usman and Cedergren, "Exploiting the chemical synthesis of RNA," *TIBS* 17:334–339 (1992) (Corrected from Specification).

Usman and McSwiggen, "Ch. 30—Catalytic RNA (Ribozymes) as Drugs," *Annual Reports in Medicinal Chemistry* 30:285–294 (1995).

Usman et al., "Automated Chemical Synthesis of Long Oligoribonucleotides Using 2'–O–Silylated Ribonucleoside 3'–O–Phosphoramidites on a Controlled–Pore Glass Support: Synthesis of a 43–Nucleotide Sequence Similar to the 3'–Half Molecule of an *Escherichia coli* Formylmethoionine tRNA," *J. Am. Chem. Soc.* 109:7845–7854 (1987).

Usman et al., "Chemical modification of hammerhead ribozymes: activity and nuclease resistance," *Nucleic Acids Syposium Series* 31:163–164 (1994).

Vaish et al., "Isolation of Hammerhead Ribozymes with Altered Core Sequences by in Vitro Selection," *Biochemistry* 36:6495–6501 (1997).

Vaisman et al., "Characterization of the Receptors for Vascular Endothelial Growth," 1990 *J. Biol. Chem.* 265, 19461.

Ventura et al., "Activation of HIV–Specific Ribozyme Activity by Self–Cleavage," *Nucleic Acids Research* 21:3249–3255 (1993).

Weerasinghe et al., "Resistance to Human Immunodeficiency Virus Type 1 (HIV–1) Infection in Human $CD4^+$ Lymphocyte–Derived Cell Lines Conferred by Using Retroviral Vectors Expressing an HIV–1 RNA–Specific Ribozyme," *Journal of Virology* 65:5531–5534 (1994) (Correction from Specification).

Weckbecker et al., 1992, *Angiogenesis: Key principles–Science–Technology–Medicine*, ed. R. Steiner).

Wincott et al., "Synthesis, deprotection, analysis and purification of RNA and ribozymes," *Nucleic Acids Research* 23(14):2677–2684 (1995).

Yu et al., "A Hairpin Ribozyme Inhibits Expression of Diverse Strains of Human Immunodeficiency Virus Type 1," *Proc. Natl. Acad. Sci. USA* 90:6340–6344 (1993).

Zabner et al., "Adenovirus–Mediated Gene Transfer Transiently Corrects the Chloride Transport Defect in Nasal Epithelia of Patients with Cystic Fibrosis," *Cell* 75:207–216 (1993).

Zaug et al., "The Tetrahymena Ribozyme Acts Like an RNA Restriction Endonuclease," *Nature* 324:429–433 (1986).

Zhou et al., "Synthesis of Functional mRNA in Mammalian Cells by Bacteriophage T3 RNA Polymerase," *Mol. Cell. Biol.* 10:4529–4537 (1990).

Ziche et al., "Angiogenesis Can Be Stimulated or Repressed in vivo by a Change in GM3:GD3 Ganglioside Ratio" *Lab. Invest.* 67:711–715.

* cited by examiner

*Figure 1: Hammerhead Ribozyme*
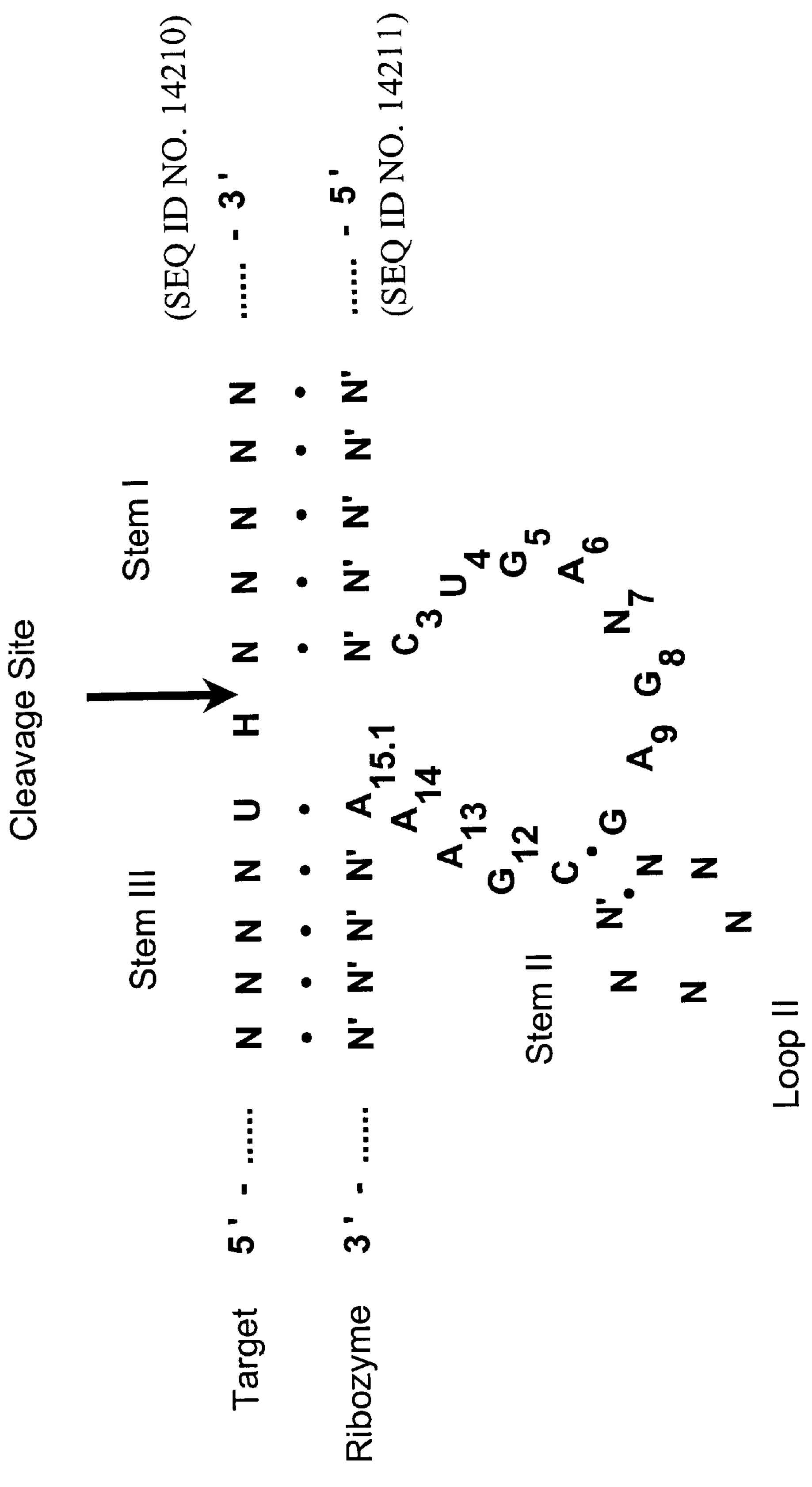

Figure 2. Hammerhead Ribozyme Substrate Motifs
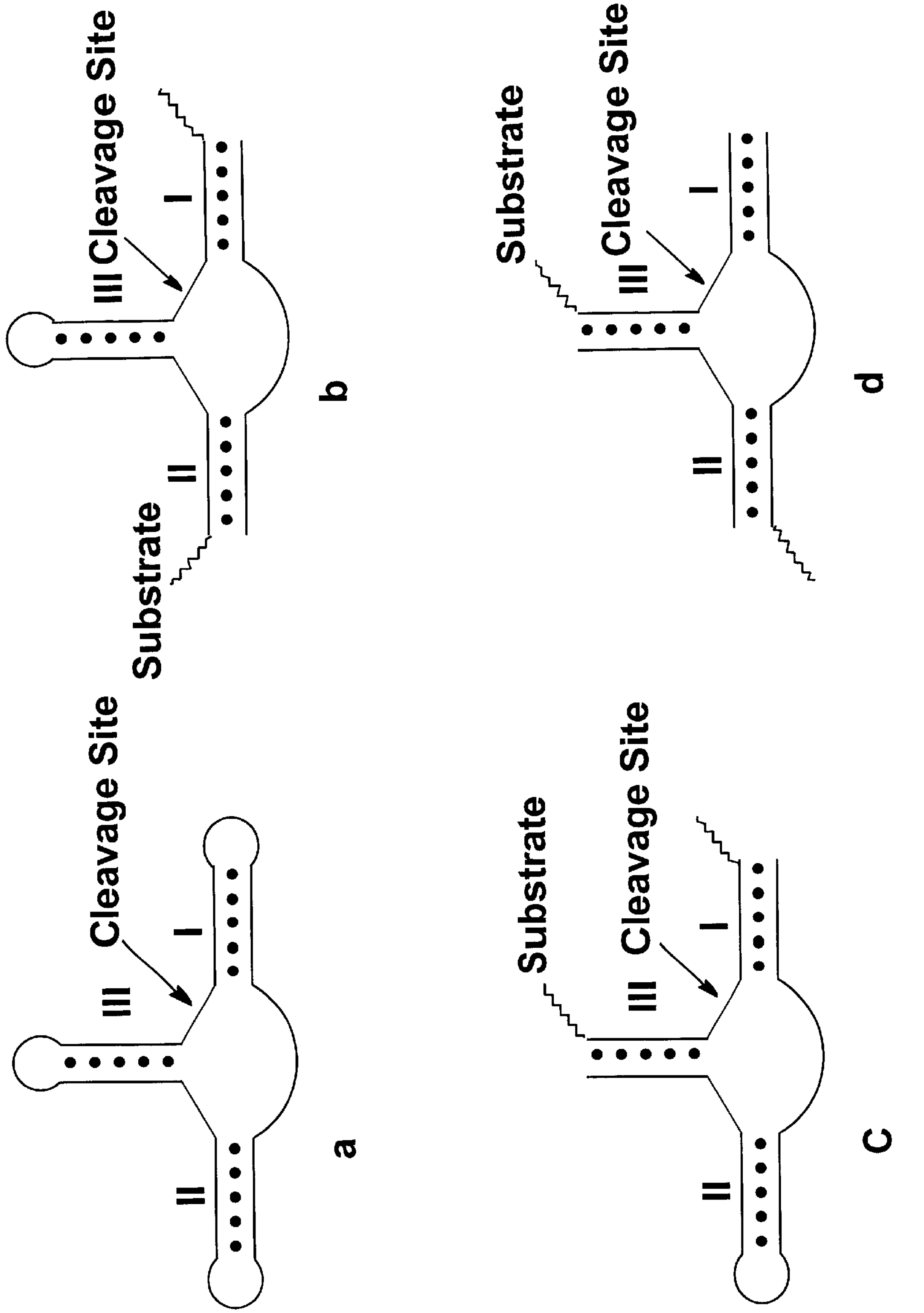

Figure 3: Hairpin Ribozyme
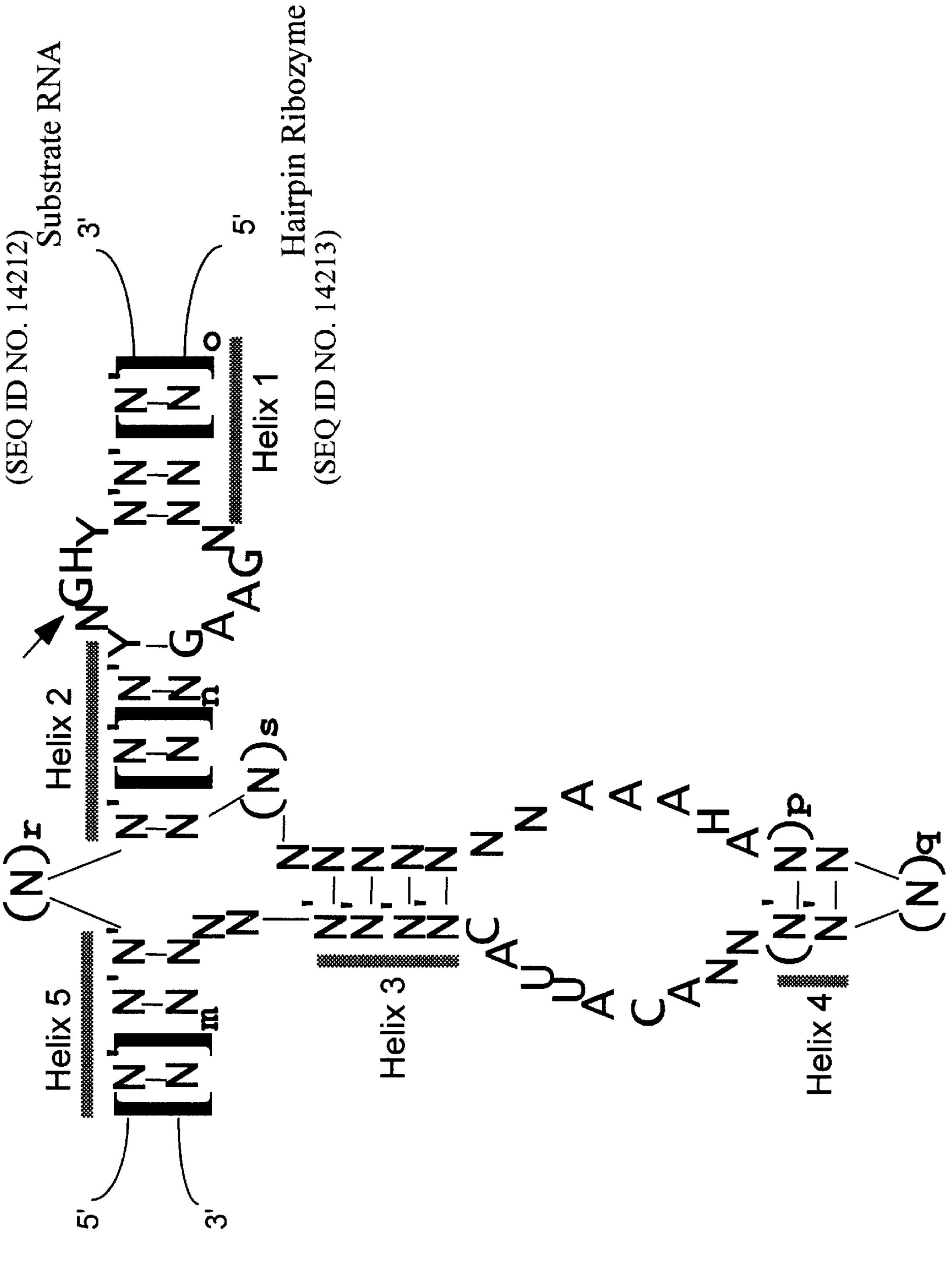

Figure 4: Hepatitis Delta Virus Ribozyme
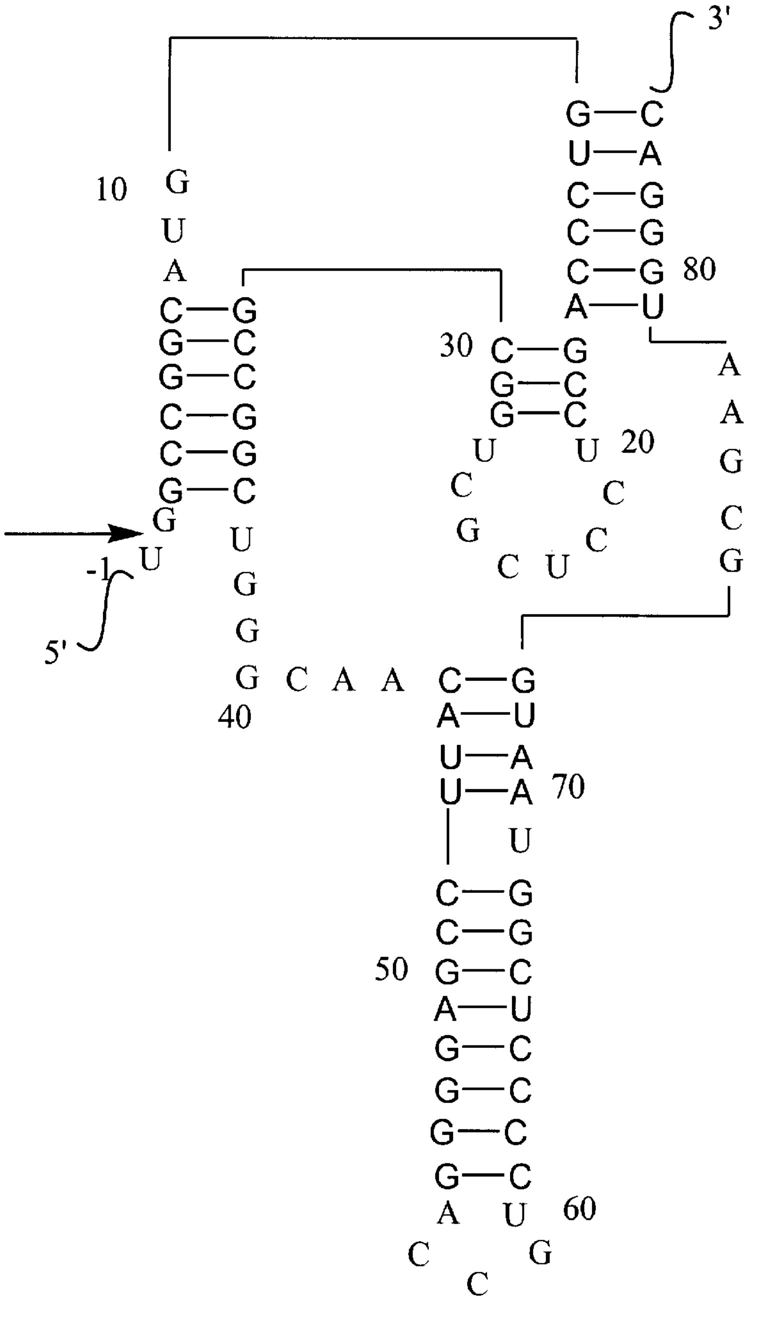
(SEQ ID NO 14214)

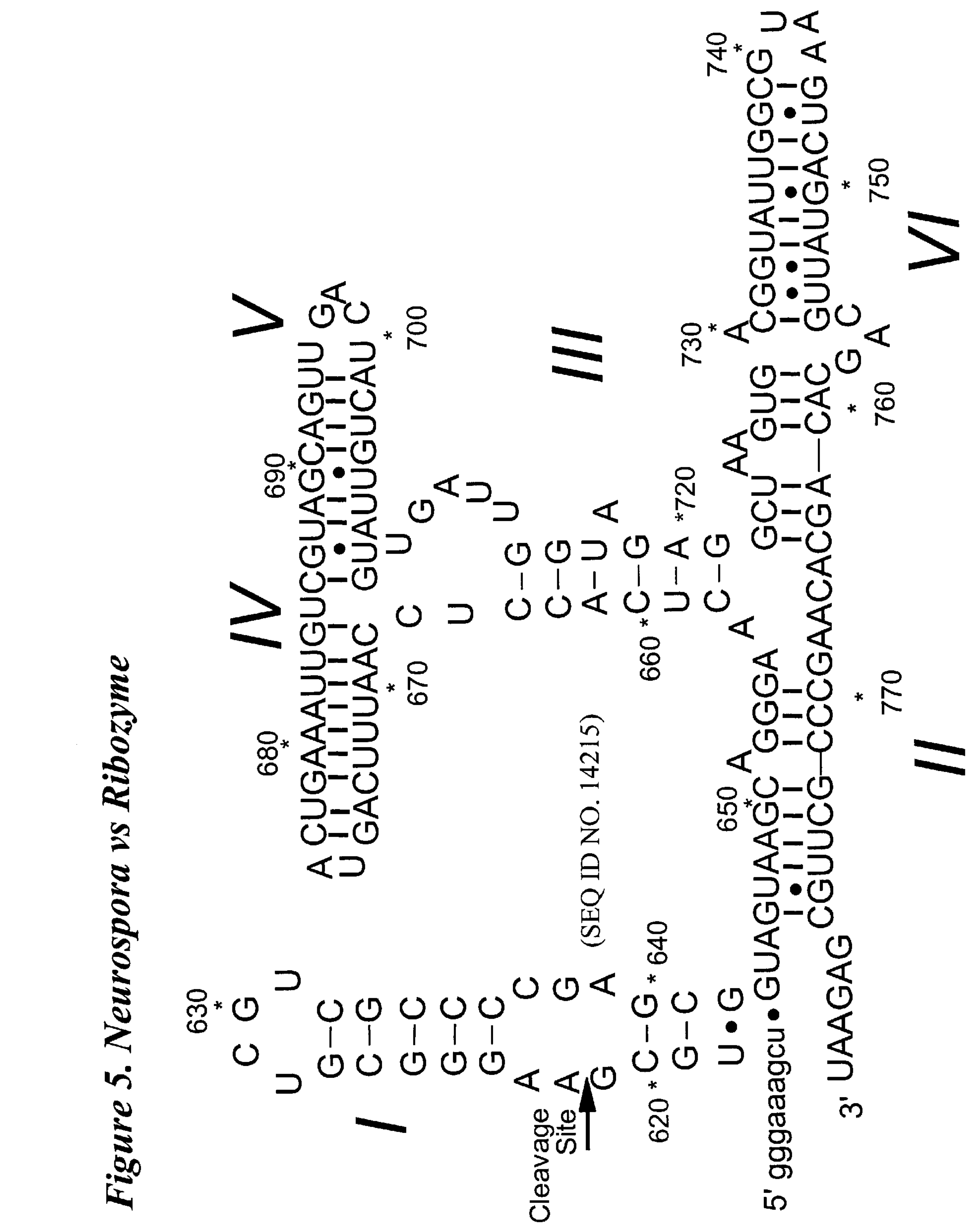
*Figure 5. Neurospora vs Ribozyme*

Figure 6: RNase H Assay
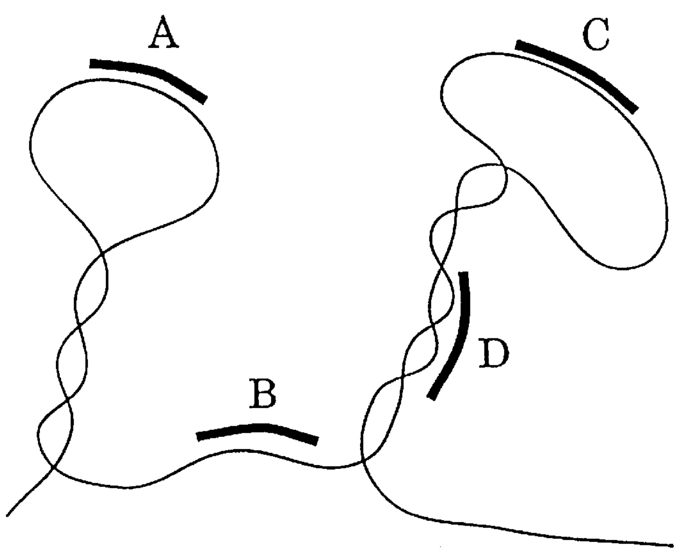
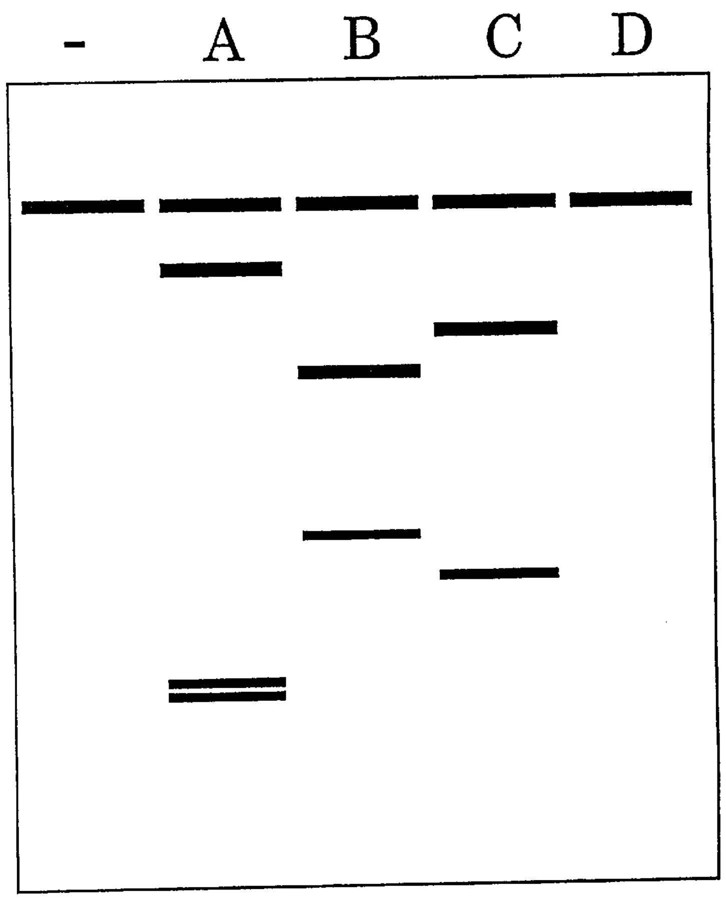
- Body-labeled transcript (not purified)
- DNA oligo (10 nM, 100 nM and 1000 nM)
- RNAse H (0.08 -1.0 u/μl)
- $37^{\circ}C$, 10 min

Figure 9: Specificity of Anti-FLT Ribozyme-Mediated Inhibition of VEGF Binding (Human Microvascular Endothelial Cells)

*Figure 11A1: Hammerhead Ribozymes Targeted Against flt-1 RNA*
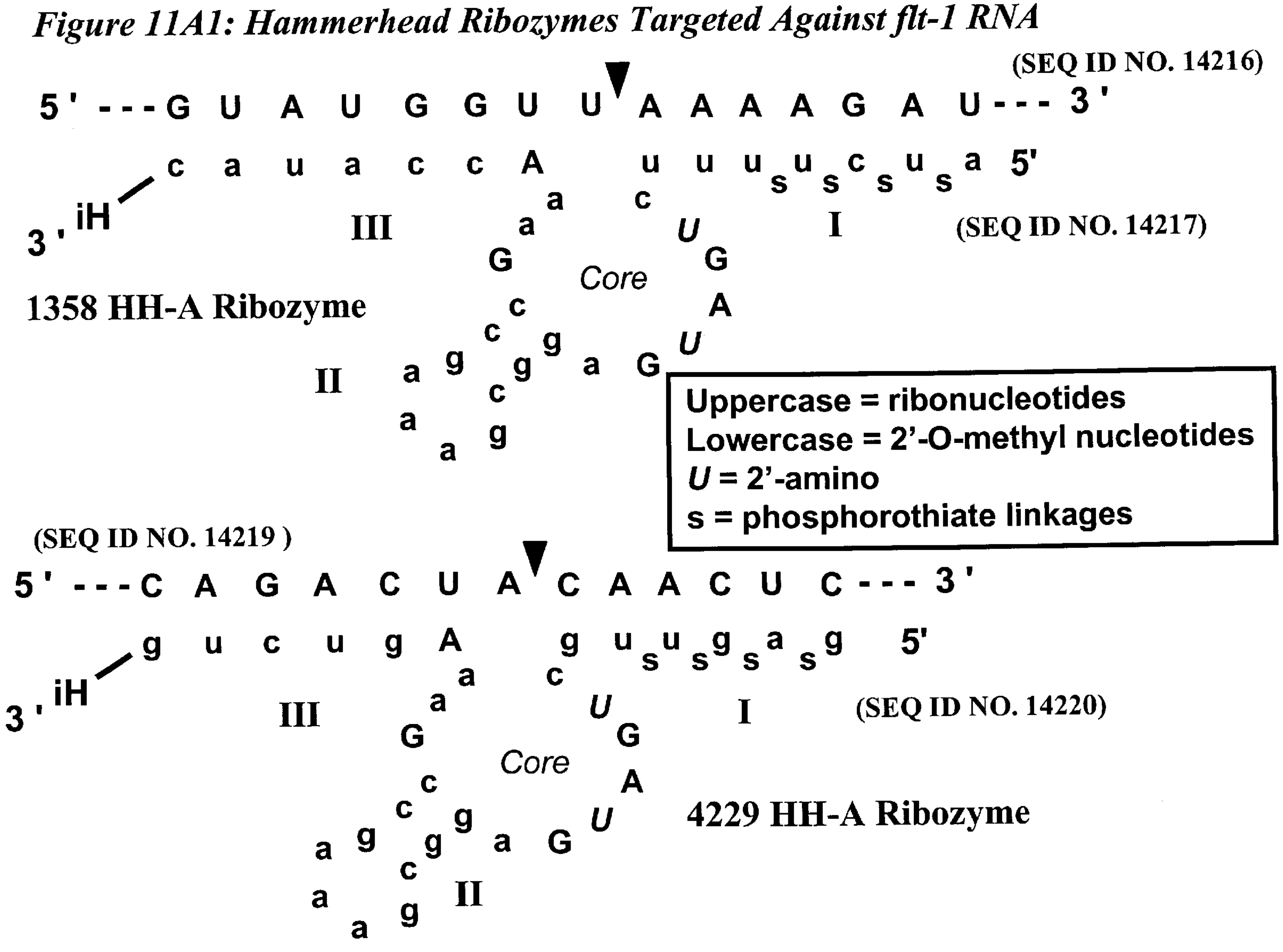

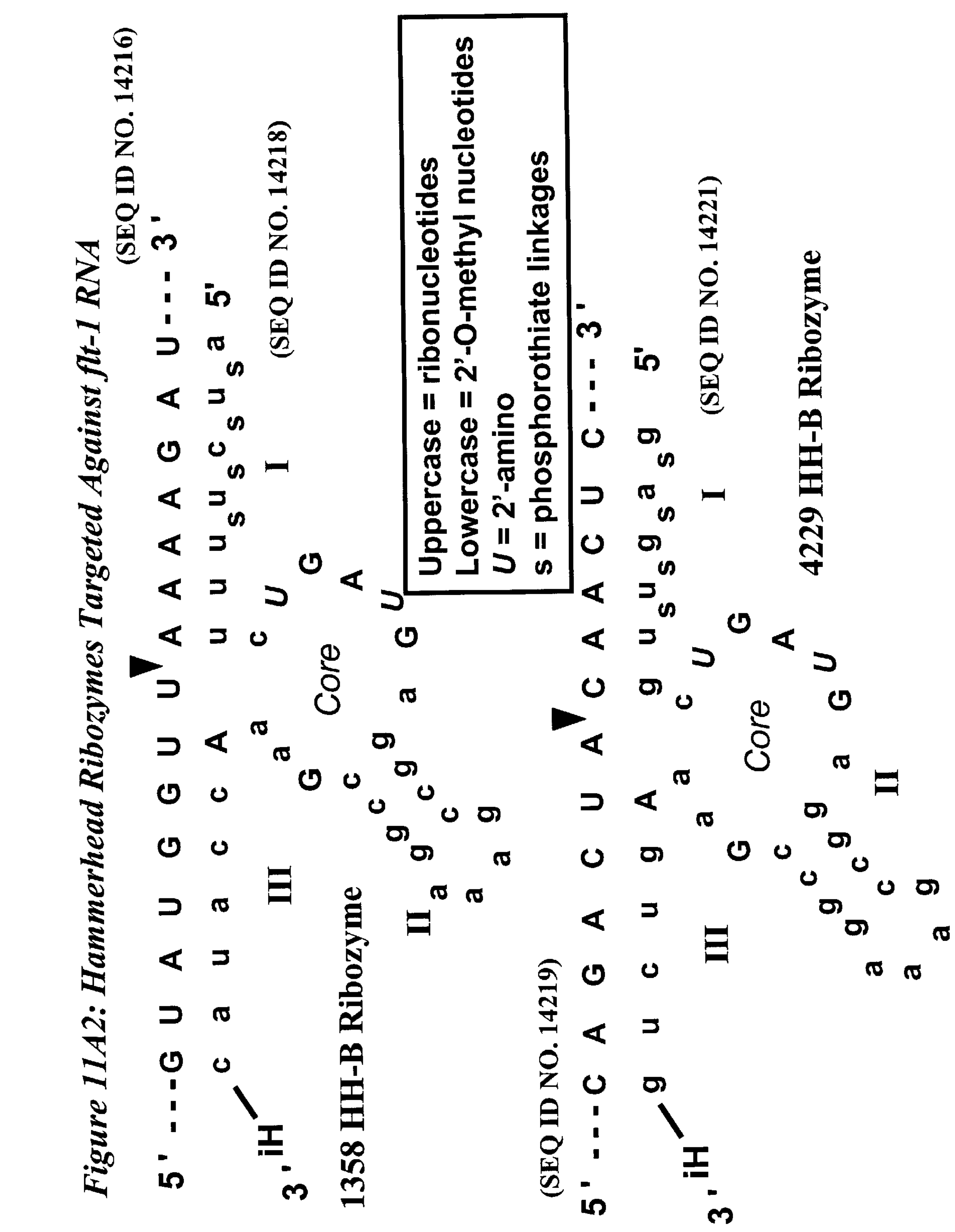

Figure 11A2: Hammerhead Ribozymes Targeted Against flt-1 RNA (SEQ ID NO. 14216)

5'---GUAUGGUU▼AAAAGAU---3'
         c  a u a c c A           u u u$_s$c$_s$u$_s$a 5'    (SEQ ID NO. 14218)
   ³'iH                         a           c   U     I
                          III   G     Core  A
                                 c         G
                             a g g c g a G
                            II   c     c
                                 a   g
                                  a 1358 HH-B Ribozyme Uppercase = ribonucleotides
Lowercase = 2'-O-methyl nucleotides
U = 2'-amino
s = phosphorothioate linkages (SEQ ID NO. 14219)

5'---CAGACUA▼CAACUC---3'
        g u c u g a A            g u$_s$u$_s$g$_s$a$_s$g 5'    (SEQ ID NO. 14221)
   ³'iH                        a          c   U     I
                        III   G     Core  A
                               c         G
                           a g c g a G
                          II   c     c
                               a   g
                                a 4229 HH-B Ribozyme

*Figure 12A1: Hammerhead Ribozymes Targeted Against flt-1 RNA*
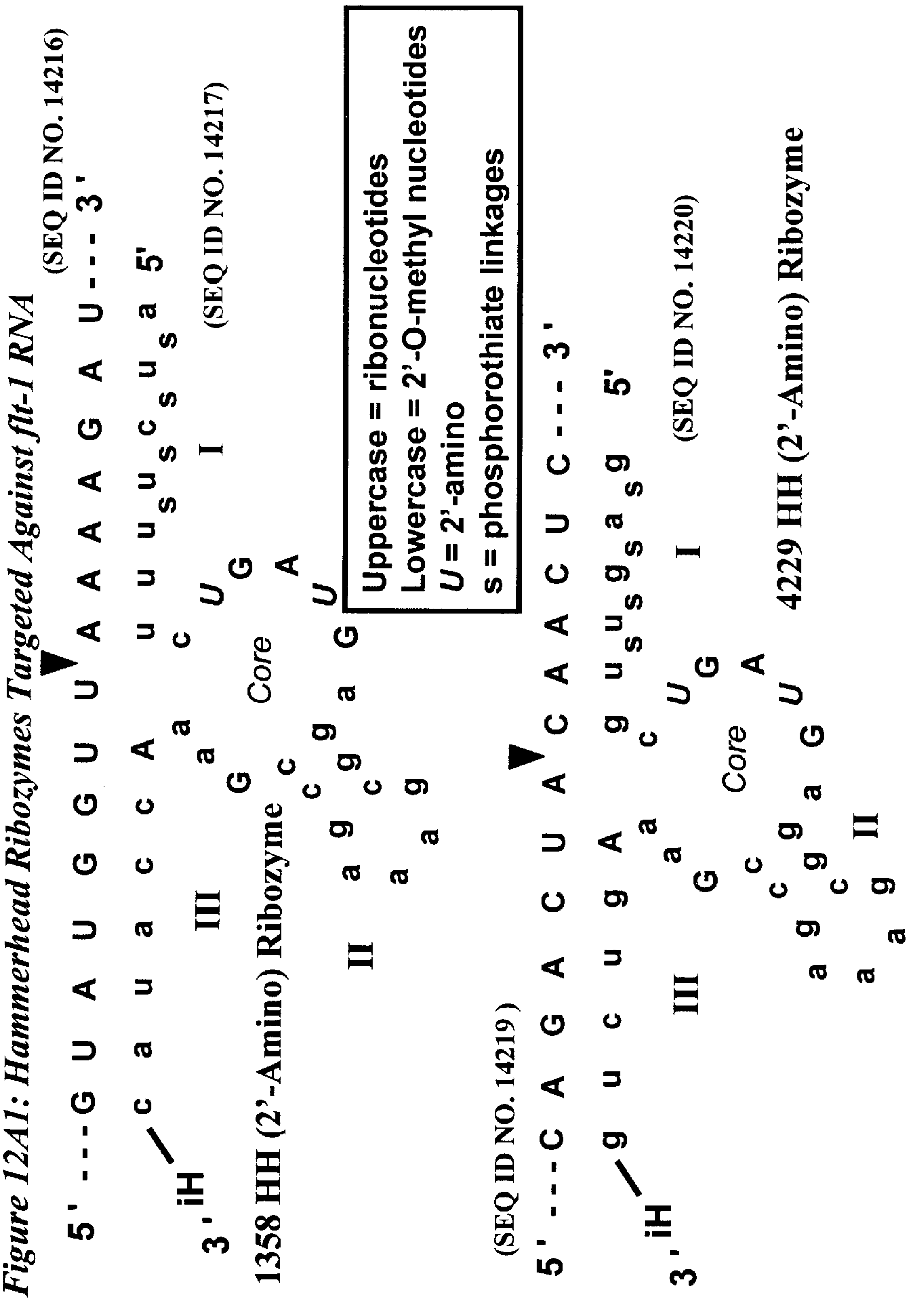

*Figure 12A2: Hammerhead Ribozymes Targeted Against flt-1 RNA*
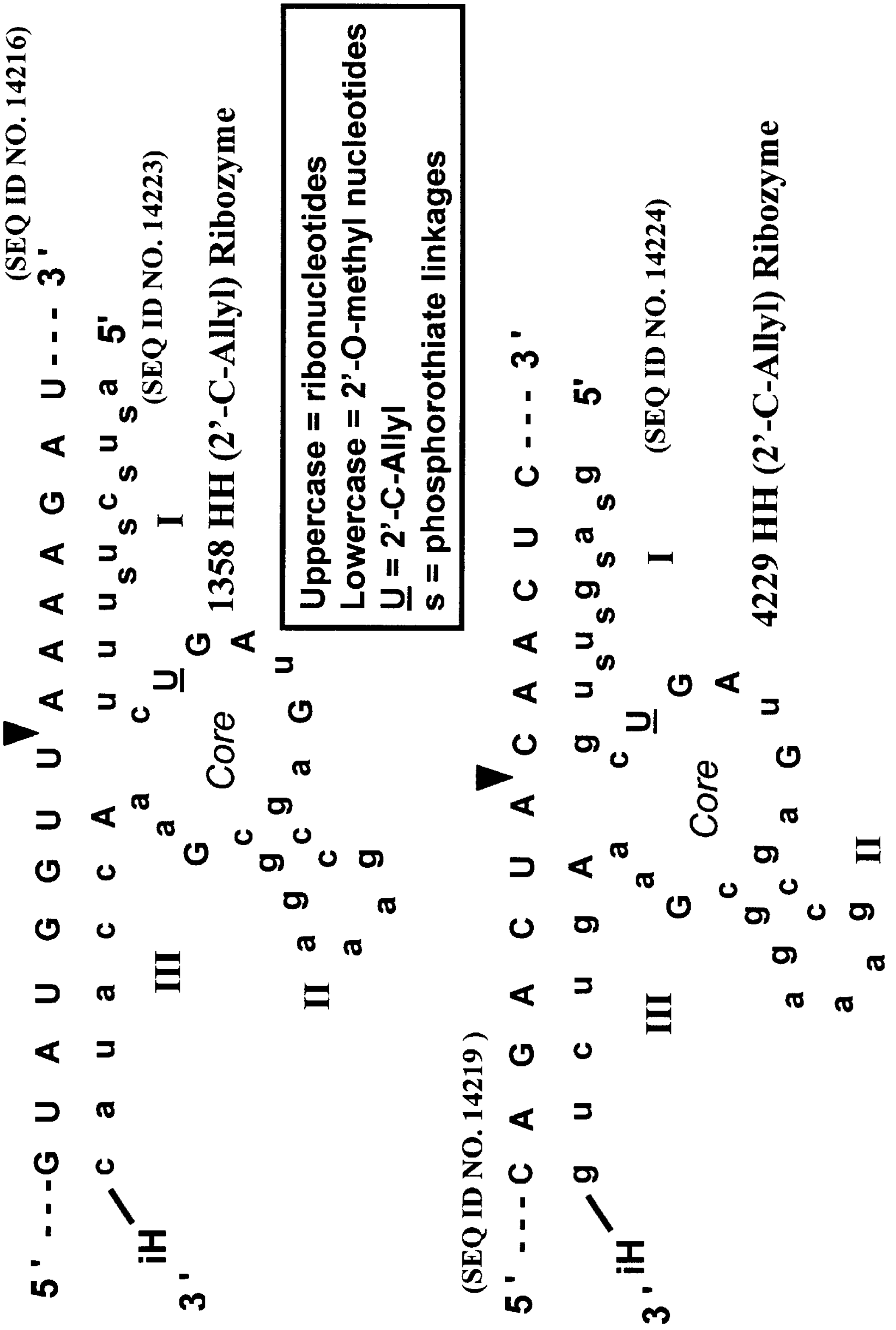

Figure 14: Cleavage of KDR RNA by Hammerhead Ribozymes

Figure 15: Cleavage of KDR RNA by Hammerhead ribozymes

Figure 18: Inhibition of Angiogenesis by Hammerhead Ribozymes *In Vivo*

Figure 19: Ribozyme-mediated inhibition of Cell Proliferation

Figure 20: Target Specificity of Ribozymes

Figure 21: Anti-angiogenic activity of anti-flt ribozyme

Figure 22: Anti-angiogenic activity of anti-kdr ribozyme

Figure 23: Ribozyme-Mediated Inhibition of Tumor Growth

Figure 24: Effect of Ribozyme in Combination with Cytotoxic Agents on Primary Tumor Growth Figure 25: Effect of Ribozyme in Combination with Cytotoxic Agents on Lung Metastases Figure 26 Anti-Flt-1 Ribozyme: ANGIOZYME

METHOD AND REAGENT FOR THE TREATMENT OF DISEASES OR CONDITIONS RELATED TO LEVELS OF VASCULAR ENDOTHELIAL GROWTH FACTOR RECEPTOR

This patent application is a continuation-in-part of Pavco et al., U.S. Ser. No. 08/584,040, filed Jan. 11, 1996, now U.S. Pat. No. 6,346,398 which claims the benefit of Pavco et al., U.S. Ser. No. 60/005,974, filed on Oct. 26, 1995, all of these earlier applications are entitled "Method and Reagent for Treatment of Diseases or Conditions Related To Levels of Vascular Endothelial Growth Factor Receptor". Each of these applications is hereby incorporated by reference herein in it's entirety including the drawings and tables.

The Sequence Listing file named "MBHB00,876-J SequenceListing.txt" (2,998,328 bytes in size) submitted on Compact Disc-Recordable (CD-R) medium ("010813_1449") in compliance with 37 C.F.R. §1.52(e) is incorporated herein by reference.

BACKGROUND OF THE INVENTION

This invention relates to methods and reagents for the treatment of diseases or conditions relating to the levels of expression of vascular endothelial growth factor (VEGF) receptor(s).

The following is a discussion of relevant art, none of which is admitted to be prior art to the present invention.

VEGF, also referred to as vascular permeability factor (VPF) and vasculotropin, is a potent and highly specific mitogen of vascular endothelial cells (for a review see Ferrara, 1993 *Trends Cardiovas. Med.* 3, 244; Neufeld et al., 1994 *Prog. Growth Factor Res.* 5, 89). VEGF induced neovascularization is implicated in various pathological conditions such as tumor angiogenesis, proliferative diabetic retinopathy, hypoxia-induced angiogenesis, rheumatoid arthritis, psoriasis, wound healing and others.

VEGF, an endothelial cell-specific mitogen, is a 34–45 kDa glycoprotein with a wide range of activities that include promotion of angiogenesis, enhancement of vascular-permeability and others. VEGF belongs to the platelet-derived growth factor (PDGF) family of growth factors with approximately 18% homology with the A and B chain of PDGF at the amino acid level. Additionally, VEGF contains the eight conserved cysteine residues common to all growth factors belonging to the PDGF family (Neufeld et al., supra). VEGF protein is believed to exist predominantly as disulfide-linked homodimers; monomers of VEGF have been shown to be inactive (Plouet et al., 1989 *EMBO J.* 8, 3801).

VEGF exerts its influence on vascular endothelial cells by binding to specific high-affinity cell surface receptors. Covalent cross-linking experiments with $^{125}$I-labeled VEGF protein have led to the identification of three high molecular weight complexes of 225, 195 and 175 kDa presumed to be VEGF and VEGF receptor complexes (Vaisman et al., 1990 *J. Biol. Chem.* 265, 19461). Based on these studies VEGF-specific receptors of 180, 150 and 130 kDa molecular mass were predicted. In endothelial cells, receptors of 150 and the 130 kDa have been identified. The VEGF receptors belong to the superfamily of receptor tyrosine kinases (RTKs) characterized by a conserved cytoplasmic catalytic kinase domain and a hydrophylic kinase sequence. The extracellular domains of the VEGF receptors consist of seven immunoglobulin-like domains that are thought to be involved in VEGF binding functions.

The two most abundant and high-affinity receptors of VEGF are flt-1 (fms-like tyrosine kinase) cloned by Shibuya et al., 1990 Oncogene 5, 519 and KDR (kinase-insert-domain-containing receptor) cloned by Terman et al., 1991 Oncogene 6, 1677. The murine homolog of KDR, cloned by Mathews et al., 1991, *Proc. Natl. Acad. Sci., USA*, 88, 9026, shares 85% amino acid homology with KDR and is termed as flk-1 (fetal liver kinase-1). Recently it has been shown that the high-affinity binding of VEGF to its receptors is modulated by cell surface-associated heparin and heparin-like molecules (Gitay-Goren et al., 1992 *J. Biol. Chem.* 267, 6093).

VEGF expression has been associated with several pathological states such as tumor angiogenesis, several forms of blindness, rheumatoid arthritis, psoriasis and others. Following is a brief summary of evidence supporting the involvement of VEGF in various diseases:

1) Tumor angiogenesis: Increased levels of VEGF gene expression have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362,841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576).
2) Ocular diseses: Aiello et a/., 1994 *New Engl. J. Med.* 331, 1480, showed that the ocular fluid, of a majority of patients suffering from diabetic retinopathy and other retinal disorders, contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases.
3) Psoriasis: Detmar et al. 1994 *J. Exp. Med.* 180, 1141 reported that VEGF and its receptors were over-expressed in psoriatic skin and psoriatic dermal microvessels, suggesting that VEGF plays a significant role in psoriasis.
4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis.

In addition to the above data on pathological conditions involving excessive angiogenesis, a number of studies have demonstrated that VEGF is both necessary and sufficient for neovascularization. Takashita et al., 1995 *J. Clin. Invest.* 93, 662, demonstrated that a single injection of VEGF augmented collateral vessel development in a rabbit model of ischemia. VEGF also can induce neovascularization when injected into the cornea. Expression of the VEGF gene in CHO cells is sufficient to confer tumorigenic potential to the cells. Kim et al., supra and Millauer et al., supra used monoclonal antibodies against VEGF or a dominant negative form of flk-1 receptor to inhibit tumor-induced neovascularization.

During development, VEGF and its receptors are associated with regions of new vascular growth (Millauer et al., 1993 *Cell* 72, 835; Shalaby et al., 1993 *J. Clin. Invest.* 91, 2235). Furthermore, transgenic mice lacking either of the VEGF receptors are defective in blood vessel formation, in fact these mice do not survive; flk-1 appears to be required for differentiation of endothelial cells, while flt-1 appears to be required at later stages of vessel formation (Shalaby et al., 1995 *Nature* 376, 62; Fung et al., 1995 *Nature* 376, 66). Thus, these receptors must be present to properly signal endothelial cells or their precursors to respond to vascularization-promoting stimuli.

All of the conditions listed above, involve extensive vascularization. This hyper-stimulation of endothelial cells may be alleviated by VEGF antagonists. Thus most of the therapeutic efforts for the above conditions have concentrated on finding inhibitors of the VEGF protein.

Kim et al., 1993 *Nature* 362, 841 have been successful in inhibiting VEGF-induced tumor growth and angiogenesis in nude mice by treating the mice with VEGF-specific monoclonal antibody.

Koch et al., 1994 *J. Immunol.* 152, 4149 showed that the mitogenic activity of microvascular endothelial cells found in rheumatoid arthritis (RA) synovial tissue explants and the chemotactic property of endothelial cells from RA synovial fluid can be neutralized significantly by treatment with VEGF-specific antibodies.

Ullrich et al., International PCT Publication No. WO 94/11499 and Millauer et al., 1994 *Nature* 367, 576 used a soluble form of flk-1 receptor (dominant-negative mutant) to prevent VEGF-mediated tumor angiogenesis in immunodeficient mice.

Kendall and Thomas, International PCT Publication No. WO 94/21679 describe the use of naturally occuring or recombinantly-engineered soluble forms of VEGF receptors to inhibit VEGF activity.

Robinson, International PCT Publication No. WO 95/04142 describes the use of antisense oligonucleotides targeted against VEGF RNA to inhibit VEGF expression. jellinek et al., 1994 *Biochemistry* 33, 10450 describe the use of VEGF-specific high-affinity RNA aptamers to inhibit the binding of VEGF to its receptors.

Rockwell and Goldstein, International PCT Publication No. WO 95/21868, describe the use of anti-VEGF receptor monoclonal antibodies to neutralize the the effect of VEGF on endothelial cells.

SUMMARY OF THE INVENTION

The invention features novel nucleic acid-based techniques [e.g., enzymatic nucleic acid molecules (ribozymes), antisense nucleic acids, 2-5A antisense chimeras, triplex DNA, antisense nucleic acids containing RNA cleaving chemical groups (Cook et al., U.S. Pat. No. 5,359,051)] and methods for their use to down regulate or inhibit the expression of receptors of VEGF (VEGF-R).

In a preferred embodiment, the invention features use of one or more of the nucleic acid-based techniques to inhibit the expression of flt-1 and/or flk-1/KDR receptors.

By "inhibit" it is meant that the activity of VEGF-R or level of mRNAs or equivalent RNAs encoding VEGF-R is reduced below that observed in the absence of the nucleic acid. In one embodiment, inhibition with ribozymes preferably is below that level observed in the presence of an enzymatically inactive or attenuated molecule that is able to bind to the same site on the mRNA, but is unable to cleave that RNA. In another embodiment, inhibition with antisense oligonucleotides is preferably below that level observed in the presence of for example, an oligonucleotide with scrambled sequence or with mismatches. In another embodiment, inhibition of VEGF-R genes with the nucleic acid molecule of the instant invention is greater than in the presence of the nucleic acid molecule than in its absence.

By "enzymatic nucleic acid molecule" it is meant an RNA molecule which has complementarity in a substrate binding region to a specified gene target, and also has an enzymatic activity which is active to specifically cleave target RNA. That is, the enzymatic RNA molecule is able to intermolecularly cleave RNA and thereby inactivate a target RNA molecule. This complementary regions allow sufficient hybridization of the enzymatic RNA molecule to the target RNA and thus permit cleavage. One hundred percent complementarity is preferred, but complementarity as low as 50–75% may also be useful in this invention. The nucleic acids may be modified at the base, sugar, and/or phosphate groups. The term enzymatic nucleic acid is used interchangeably with phrases such as ribozymes, catalytic RNA, enzymatic RNA, catalytic DNA, catalytic oligonucleotides, nucleozyme, DNAzyme, RNA enzyme, endoribonuclease, endonuclease, minizyme, leadzyme, oligozyme or DNA enzyme. All of these terminologies describe nucleic acid molecules with enzymatic activity. The specific enzymatic nucleic acid molecules described in the instant application are not meant to be limiting and those skilled in the art will recognize that all that is important in an enzymatic nucleic acid molecule of this invention is that it have a specific substrate binding site which is complementary to one or more of the target nucleic acid regions, and that it have nucleotide sequences within or surrounding that substrate binding site which impart a nucleic acid cleaving activity to the molecule (Cech et al., U.S. Pat. No. 4,987,071; Cech et al., 1988, JAMA).

By "enzymatic portion" or "catalytic domain" is meant that portion/region of the ribozyme essential for cleavage of a nucleic acid substrate (for example see FIG. 1).

By "substrate binding arm" or "substrate binding domain" is meant that portion/region of a ribozyme which is complementary to (i.e., able to base-pair with) a portion of its substrate. Generally, such complementarity is 100%, but can be less if desired. For example, as few as 10 bases out of 14 may be base-paired. Such arms are shown generally in FIG. 1. That is, these arms contain sequences within a ribozyme which are intended to bring ribozyme and target RNA together through complementary base-pairing interactions. The ribozyme of the invention may have binding arms that are contiguous or non-contiguous and may be of varying lengths. The length of the binding arm(s) are preferably greater than or equal to four nucleotides and of sufficient length to stably interact with the target RNA; specifically 12–100 nucleotides; more specifically 14–24 nucleotides long. If two binding arms are chosen, the design is such that the length of the binding arms are symmetrical (i.e., each of the binding arms is of the same length; e.g., five and five nucleotides, six and six nucleotides or seven and seven nucleotides long) or asymmetrical (i.e., the binding arms are of different length; e.g., six and three nucleotides; three and six nucleotides long; four and five nucleotides long; four and six nucleotides long; four and seven nucleotides long; and the like).

By DNAzyme is meant, an enzymatic nucleic acid molecule lacking a 2'-OH group. In particular embodiments the enzymatic nucleic acid molecule may have an attached linker(s) or other attached or associated groups, moieties, or chains containing one or more nucleotides with 2'-OH groups.

By "sufficient length" is meant an oligonucleotide of greater than or equal to 3 nucleotides.

By "stably interact" is meant, interaction of the oligonucleotides with target nucleic acid (e.g., by forming hydrogen bonds with complementary nucleotides in the target under physiological conditions).

By "equivalent" RNA to VEGF-R is meant to include those naturally occurring RNA molecules having homology (partial or complete) to VEGF-R or encoding for proteins with similar function as VEGF-R in various animals, including human, rodent, primate, rabbit and pig. The equivalent RNA sequence also includes in addition to the coding region, regions such as 5'-untranslated region, 3'-untranslated region, introns, intron-exon junction and the like.

By "homology" is meant the nucleotide sequence of two or more nucleic acid molecules is partially or completely identical.

By "antisense nucleic acid" it is meant a non-enzymatic nucleic acid molecule that binds to target RNA by means of RNA-RNA or RNA-DNA or RNA-PNA (protein nucleic acid; Egholm et al., 1993 *Nature* 365, 566) interactions and alters the activity of the target RNA (for a review see Stein and Cheng, 1993 *Science* 261, 1004). Typically, antisense molecules will be complementary to a target sequence along a single contiguous sequence of the antisense molecule. However, in certain embodiments, an antisense molecule may bind to substrate such that the substrate molecule forms a loop, and/or an antisense molecule may bind such that the antisense molecule forms a loop. Thus, the antisense molecule may be complementary to two (or even more) non-contiguous substrate sequences or two (or even more) non-contiguous sequence portions of an antisense molecule may be complementary to a target sequence or both. 237/198

By "2-5A antisense chimera" it is meant, an antisense oligonucleotide containing a 5' phosphorylated 2'-5'-linked adenylate residues. These chimeras bind to target RNA in a sequence-specific manner and activate a cellular 2-5A-dependent ribonuclease which, in turn, cleaves the target RNA (Torrence et al., 1993 *Proc. Natl. Acad. Sci. USA* 90, 1300).

By "triplex DNA" it is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 *Proc. Natl. Acad. Sci. USA* 89, 504).

By "gene" it is meant a nucleic acid that encodes an RNA.

By "complementarity" is meant that a nucleic acid can form hydrogen bond(s) with another RNA sequence by either traditional Watson-Crick or other non-traditional types. In reference to the nucleic molecules of the present invention, the binding free energy for a nucleic acid molecule with its target or complementary sequence is sufficient to allow the relevant function of the nucleic acid to proceed, e.g., ribozyme cleavage, antisense or triple helix inhibition. Determination of binding free energies for nucleic acid molecules is well known in the art (see, e.g., Turner et al., 1987, CSH Symp. Quant. Biol. LII pp.123–133; Frier et al., 1986, Proc. Nat. Acad. Sci. USA 83:9373–9377; Turner et al., 1987, J. Am. Chem. Soc. 109:3783–3785. A percent complementarity indicates the percentage of contiguous residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence.

Seven basic varieties of naturally-occurring enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets. Thus, a single ribozyme molecule is able to cleave many molecules of target RNA. In addition, the ribozyme is a highly specific inhibitor of gene expression, with the specificity of inhibition depending not only on the base-pairing mechanism of binding to the target RNA, but also on the mechanism of target RNA cleavage. Single mismatches, or base-substitutions, near the site of cleavage can completely eliminate catalytic activity of a ribozyme.

Ribozymes that cleave the specified sites in VEGF-R mRNAs represent a novel therapeutic approach to treat tumor angiogenesis, ocular diseases, rhuematoid arthritis, psoriasis and others. Applicant indicates that ribozymes are able to inhibit the activity of VEGF-R (specifically flt-1 and flk-1/KDR) and that the catalytic activity of the ribozymes is required for their inhibitory effect. Those of ordinary skill in the art will find that it is clear from the examples described that other ribozymes that cleave VEGF-R mRNAs may be readily designed and are within the invention.

In one of the preferred embodiments of the inventions described herein, the enzymatic nucleic acid molecule is formed in a hammerhead or hairpin motif, but may also be formed in the motif of a hepatitis delta virus, group I intron, group II intron or RNase P RNA (in association with an RNA guide sequence), Neurospora VS RNA, DNAzymes, NCH cleaving motifs, or G-cleavers. Examples of such hammerhead motifs are described by Dreyfus, supra, Rossi et al., 1992, *AIDS Research and Human Retroviruses* 8, 183; of hairpin motifs by Hampel et al., EP0360257, Hampel and Tritz, 1989 *Biochemistry* 28, 4929, Feldstein et al., 1989, *Gene* 82, 53, Haseloff and Gerlach, 1989, Gene, *82, 43*, and Hampel et al., 1990 *Nucleic Acids Res.* 18, 299; Chowrira & McSwiggen, U.S. Pat. No. 5,631,359; of the hepatitis delta virus motif is described by Perrotta and Been, 1992 *Biochemistry* 31, 16; of the RNase P motif by Guerrier-Takada et al., 1983 *Cell* 35, 849; Forster and Altman, 1990, *Science* 249, 783; Li and Altman, 1996, *Nucleic Acids Res.* 24, 835; Neunospora VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemistry* 32, 2795–2799; Guo and Collins, 1995, *EMBO. J.* 14, 363); Group II introns are described by Griffin et al., 1995, *Chem. Biol.* 2, 761; Michels and Pyle, 1995, *Biochemistry* 34, 2965; Pyle et al., International PCT Publication No. WO 96/22689; of the Group I intron by Cech et al., U.S. Pat. No. 4,987,071 and of DNAzymes by Usman et al., International PCT Publication No. WO 95/11304; Chartrand et al., 1995, *NAR* 23, 4092; Breaker et al., 1995, Chem. Bio. 2, 655; Santoro et al., 1997, *PNAS* 94, 4262. NCH cleaving motifs are described in Ludwig & Sproat, International PCT Publication No. WO 98/58058; and G-cleavers are described in kore et al., 1998, *Nucleic Acids Research* 26, 4116A4120 and Eckstein et al., International PCT Publication No. WO 99/16871. These specific motifs are not limiting in the invention and those skilled in the art will recognize that all that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule (Cech et al., U.S. Pat. No. 4,987,071).

In preferred embodiments of the present invention, a nucleic acid molecule, e.g., an antisense molecule, a triplex DNA, or a ribozyme, is 13 to 100 nucleotides in length, e.g., in specific embodiments 35, 36, 37, or 38 nucleotides in length (e.g., for particular ribozymes). In particular embodiments, the nucleic acid molecule is 15-100, 17-100, 20-100, 21-100, 23-100, 25-100, 27-100, 30-100, 32-100, 35-100, 40-100, 50-100, 60-100, 70-100, or 80-100 nucleotides in length. Instead of 100 nucleotides being the upper limit on the length ranges specified above, the upper limit of the length range can be, for example, 30, 40, 50, 60, 70, or 80 nucleotides. Thus, for any of the length ranges, the length range for particular embodiments has lower limit as specified, with an upper limit as specified which is greater than the lower limit. For example, in a particular embodiment, the length range can be 35–50 nucleotides in length. All such ranges are expressly included. Also in particular embodiments, a nucleic acid molecule can have a length which is any of the lengths specified above, for example, 21 nucleotides in length.

In a preferred embodiment the invention provides a method for producing a class of enzymatic cleaving agents which exhibit a high degree of specificity for the RNA of a desired target. The enzymatic nucleic acid molecule is preferably targeted to a highly conserved sequence region of target mRNAs encoding VEGF-R proteins (specifically flt-1 and flk-1/KDR) such that specific treatment of a disease or condition can be provided with either one or several enzymatic nucleic acids. Such enzymatic nucleic acid molecules can be delivered exogenously to specific tissue or cellular targets as required. Alternatively, the ribozymes can be expressed from DNA and/or RNA vectors that are delivered to specific cells.

By "highly conserved sequence region" is meant a nucleotide sequence of one or more regions in a nucleic acid molecule does not vary significantly from one generation to the other or from one biological system to the other.

Synthesis of nucleic acids greater than 100 nucleotides in length is difficult using automated methods, and the therapeutic cost of such molecules is prohibitive. In this invention, small nucleic acid motifs (e.g., antisense oligonucleotides, hammerhead or the hairpin ribozymes) are used for exogenous delivery. The simple structure of these molecules increases the ability of the nucleic acid to invade targeted regions of the mRNA structure. However, these nucleic acid molecules can also be expressed within cells from eukaryotic promoters (e.g., Izant and Weintraub, 1985 *Science* 229, 345; McGarry and Lindquist, 1986 *Proc. Natl. Acad. Sci. USA* 83, 399; SullengerScanlon et al, 1991, *Proc. Natl. Acad. Sci. USA*, 88, 10591–5; Kashani-Sabet et al., 1992 *Antisense Res. Dev.*, 2, 3–15; Dropulic et al., 1992 *J. Virol*, 66, 1432–41; Weerasinghe et al., 1991 *J. Virol*, 65, 5531–4; Ojwang et al., 1992 *Proc. Natl. Acad. Sci. USA* 89, 10802–6; Chen et al., 1992 *Nucleic Acids Res*., 20, 4581–9; Sarver et al., 1990 Science 247, 1222–1225; Thompson et al., 1995 *Nucleic Acids Res*. 23, 2259). Those skilled in the art realize that any nucleic acid can be expressed in eukaryotic cells from the appropriate DNA/RNA vector. The activity of such nucleic acids can be augmented by their release from the primary transcript by a ribozyme (Draper et al., PCT WO93/23569, and Sullivan et al., PCT WO94/02595, both hereby incorporated in their totality by reference herein; Ohkawa et al., 1992 *Nucleic Acids Symp. Ser*., 27, 15–6; Taira et al., 1991, *Nucleic Acids Res*., 19, 5125–30; Ventura et al., 1993 *Nucleic Acids Res*., 21, 3249–55; Chowrira et al., 1994 *J. Biol. Chem*. 269, 25856).

Such nucleic acid molecules are useful for the prevention of the diseases and conditions including cancer, diabetic retinopathy, macular degeneration, neovascular glaucoma, myopic degeneration, arthritis, psoriasis, verruca vulgaris, angiofibroma of tuberous sclerosis, pot-wine stains, Sturge Weber syndrome, Kippel-Trenaunay-Weber syndrome, Osler-Weber-Rendu syndrome and any other diseases or conditions that are related to the levels of VEGF-R (specifically flt-1 and flk-1/KDR) in a cell or tissue.

By "related" is meant that the reduction of VEGF-R (specifically flt-1 and flk-1/KDR) RNA levels and thus reduction in the level of the respective protein will relieve, to some extent, the symptoms of the disease or condition.

Ribozymes are added directly, or can be complexed with cationic lipids, packaged within liposomes, or otherwise delivered to target cells or tissues. The nucleic acid or nucleic acid. complexes can be locally administered to relevant tissues ex vivo, or in vivo through injection, infusion pump or stent, with or without their incorporation in biopolymers. In preferred embodiments, the ribozymes have binding arms which are complementary to the sequences in Tables II to IX. Examples of such ribozymes also are shown in Tables II to XVII. Examples of such ribozymes consist essentially of sequences defined in these Tables.

In yet another embodiment, the invention features antisense nucleic acid molecules and 2-5A chimera including sequences complementary to the target sequences shown in tables II to XVII. Such nucleic acid molecules can include sequences as shown for the binding arms of the ribozymes in Tables II to XVII. Similarly, triplex molecules can be provided targeted to the corresponding DNA target regions, and containing the DNA equivalent of a target sequence or a sequence complementary to the specified target (substrate) sequence. Typically, antisense molecules will be complementary to a target sequence along a single contiguous sequence of the antisense molecule. However, in certain embodiments, an antisense molecule may bind to substrate such that the substrate molecule forms a loop, and/or an antisense molecule may bind such that the antisense molecule forms a loop. Thus, the antisense molecule may be complementary to two (or even more) non-contiguous substrate sequences or two (or even more) non-contiguous sequence portions of an antisense molecule may be complementary to a target sequence or both.

By "consists essentially of" is meant that the active ribozyme contains an enzymatic center or core equivalent to those in the examples, and binding arms able to bind mRNA such that cleavage at the target site occurs. Other sequences may be present which do not interfere with such cleavage. Thus, a core region may, for example, include on or more loop or stem-loop structures which do not prevent enzymatic activity. Thus, the underlined regions in the sequences in Tables II, IV, VI, VIII, XIV, and XVI can be such a loop or stem-loop, and can be represented generally as sequence "X". For example, a core sequence can be a conserved sequence, such as 5'-CUGAUGAG-3' and 5'-CGAA-3' connected by "X", where X is 5'-GCCGUUAGGC-3' (SEQ ID NO 14225), or any other Stem II region known in the art.

In another aspect of the invention, ribozymes that cleave target RNA molecules and inhibit VEGF-R (specifically flt-1 and flk-1/KDR) activity are expressed from transcription units inserted into DNA or RNA vectors. The recombinant vectors are preferably DNA plasmids or viral vectors. Ribozyme expressing viral vectors could be constructed based on, but not limited to, adeno-associated virus, retrovirus, adenovirus, or alphavirus. Preferably, the recombinant vectors capable of expressing the ribozymes are delivered as described above, and persist in target cells. Alternatively, viral vectors may be used that provide for transient expression of ribozymes. Such vectors might be repeatedly administered as necessary. Once expressed, the ribozymes cleave the target mRNA. Delivery of ribozyme expressing vectors could be systemic, such as by intravenous or intramuscular administration, by administration to target cells ex-planted from the patient followed by reintroduction into the patient, or by any other means that would allow for introduction into the desired target cell.

By "vectors" is meant any nucleic acid- and/or viral-based technique used to deliver a desired nucleic acid.

By "patient" is meant an organism which is a donor or recipient of explanted cells or the cells themselves. "Patient" also refers to an organism to which the nucleic acid molecules of the invention can be administered. Preferably, a patient is a mammal or mammalian cells. More preferably, a patient is a human or human cells.

The nucleic acid molecules of the instant invention, individually, or in combination or in conjunction with other drugs, can be used to treat diseases or conditions discussed above. For example, to treat a disease or condition associated with VEGF-R, the patient may be treated, or other appropriate cells may be treated, as is evident to those skilled in the art, individually or in combination with one or more drugs under conditions suitable for the treatment.

In a further embodiment, the described molecules, such as antisene or ribozymes can be used in combination with other known treatments to treat conditions or diseases discussed above. For example, the described molecules could be used in combination with one or more known therapeutic agents to treat cancer.

In another preferred embodiment, the invention features nucleic acid-based techniques (e.g., enzymatic nucleic acid molecules (ribozymes), antisense nucleic acids, 2-5A antisense chimeras, triplex DNA, antisense nucleic acids containing RNA cleaving chemical groups) and methods for their use to down regulate or inhibit the expression of genes (e.g., flt-1 and kdr) capable of inducing angiogenesis.

In another preferred embodiment, the invention features nucleic acid-based techniques (e.g., enzymatic nucleic acid molecules (ribozymes), antisense nucleic acids, 2-5A antisense chimeras, triplex DNA, antisense nucleic acids containing RNA cleaving chemical groups) and methods for their use to down regulate or inhibit the expression of VEGF receptor.

By "comprising" is meant including, but not limited to, whatever follows the word "comprising". Thus, use of the term "comprising" indicates that the listed elements are required or mandatory, but that other elements are optional and may or may not be present. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

Other features and advantages of the invention will be apparent from the following description of the preferred embodiments thereof, and from the claims.

DESCRIPTION OF THE PREFERRED EMBODIMENTS

First the drawings will be described briefly.

DRAWINGS

FIG. 1 is a diagrammatic representation of the hammerhead ribozyme domain known in the art. Stem II can be ≧2 base-pair long.

FIGS. 2*a*–2*d* is a diagrammatic representation of the hammerhead ribozyme domain known in the art; FIG. 2*b* is a diagrammatic representation of the hammerhead ribozyme as divided by Uhlenbeck (1987, *Nature,* 327, 596–600) into a substrate and enzyme portion; FIG. 2*c* is a similar diagram showing the hammerhead divided by Haseloff and Gerlach (1988, *Nature*, 334, 585–591) into two portions; and FIG. 2*d* is a similar diagram showing the hammerhead divided by Jeffries and Symons (1989, *Nucl. Acids. Res.*, 17, 1371–1371) into two portions.

FIG. 3 is a diagrammatic representation of the general structure of a hairpin ribozyme. Helix 2 (H2) is provided with at least 4 base pairs (i.e., n is 1, 2, 3 or 4) and helix 5 can be optionally provided of length 2 or more bases (preferably 3–20 bases, i.e., m is from 1–20 or more). Helix 2 and helix 5 may be covalently linked by one or more bases (i.e., r is ≧1 base). Helix 1, 4 or 5 may also be extended by 2 or more base pairs (e.g., 4–20 base pairs) to stabilize the ribozyme structure, and preferably is a protein binding site. In each instance, each N and N' independently is any normal or modified base and each dash represents a potential base-pairing interaction. These nucleotides may be modified at the sugar, base or phosphate. Complete base-pairing is not required in the helices, but is preferred. Helix 1 and 4 can be of any size (i.e., o and p is each independently from 0 to any number, e.g., 20) as long as some base-pairing is maintained. Essential bases are shown as specific bases in the structure, but those in the art will recognize that one or more may be modified chemically (abasic, base, sugar and/or phosphate modifications) or replaced with another base without significant effect. Helix 4 can be formed from two separate molecules, i.e., without a connecting loop. The connecting loop when present may be a ribonucleotide with or without modifications to its base, sugar or phosphate. "q" is ≧2 bases. The connecting loop can also be replaced with a non-nucleotide linker molecule. H refers to bases A, U, or C. Y refers to pyrimidine bases. "__" refers to a covalent bond.

FIG. 4 is a representation of the general structure of the hepatitis delta virus ribozyme domain known in the art.

FIG. 5 is a representation of the general structure of the VS RNA ribozyme domain.

FIG. 6 is a schematic representation of an RNAseH accessibility assay. Specifically, the left side of FIG. 6 is a diagram of complementary DNA oligonucleotides bound to accessible sites on the target RNA. Complementary DNA oligonucleotides are represented by broad lines labeled A, B, and C. Target RNA is represented by the thin, twisted line. The right side of FIG. 6 is a schematic of a gel separation of uncut target RNA from a cleaved target RNA. Detection of target RNA is by autoradiography of body-labeled, T7 transcript. The bands common to each lane represent uncleaved target RNA; the bands unique to each lane represent the cleaved products.

Figure 7:
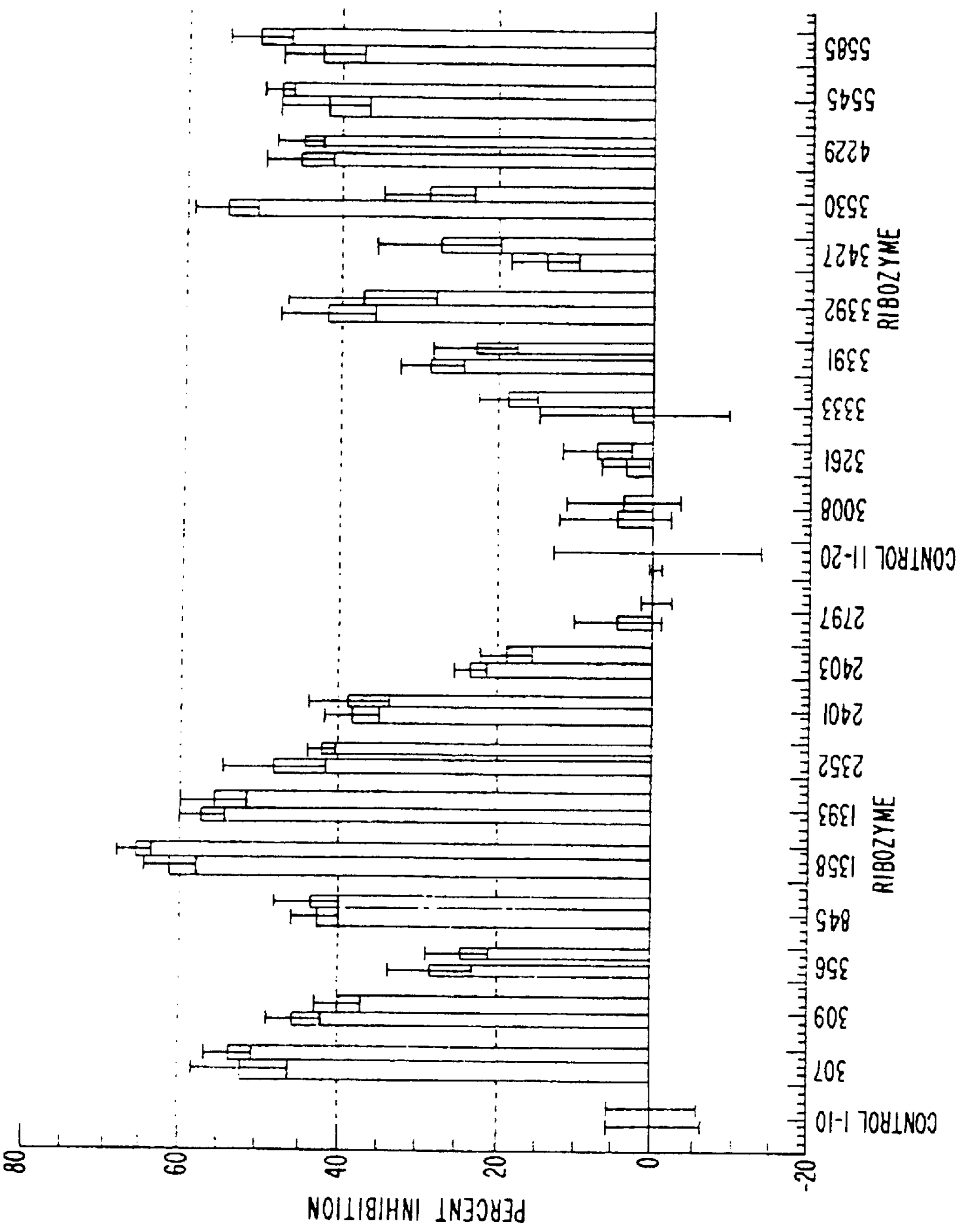

FIG. 7 shows the effect of hammerhead ribozymes targeted against flt-1 receptor on the binding of VEGF to the surface of human microvascular endothelial cells. Sequences of the ribozymes used are shown in Table II; the length of stem 11 region is 3 bp. The hammerhead ribozymes were chemically modified such that the ribozyme consists of ribose residues at five positions (see FIG. 11); U4 and U7 positions contain 2'-NH2 modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The results of two separate experiments are shown as separate bars for each set. Each bar represents the average of triplicate samples. The standard deviation is shown with error bars. For the flt-1 data, 500 nM ribozyme (3:1 charge ratio with LipofectAMINE®) was used. Control 1–10 is the control for ribozymes 307–2797, control 11–20 is the control for ribozymes 3008–5585. The Control 1–10 and Control 11–20 represent the treatment of cells with LipofectAMINE® alone without any ribozymes.

Figure 8:
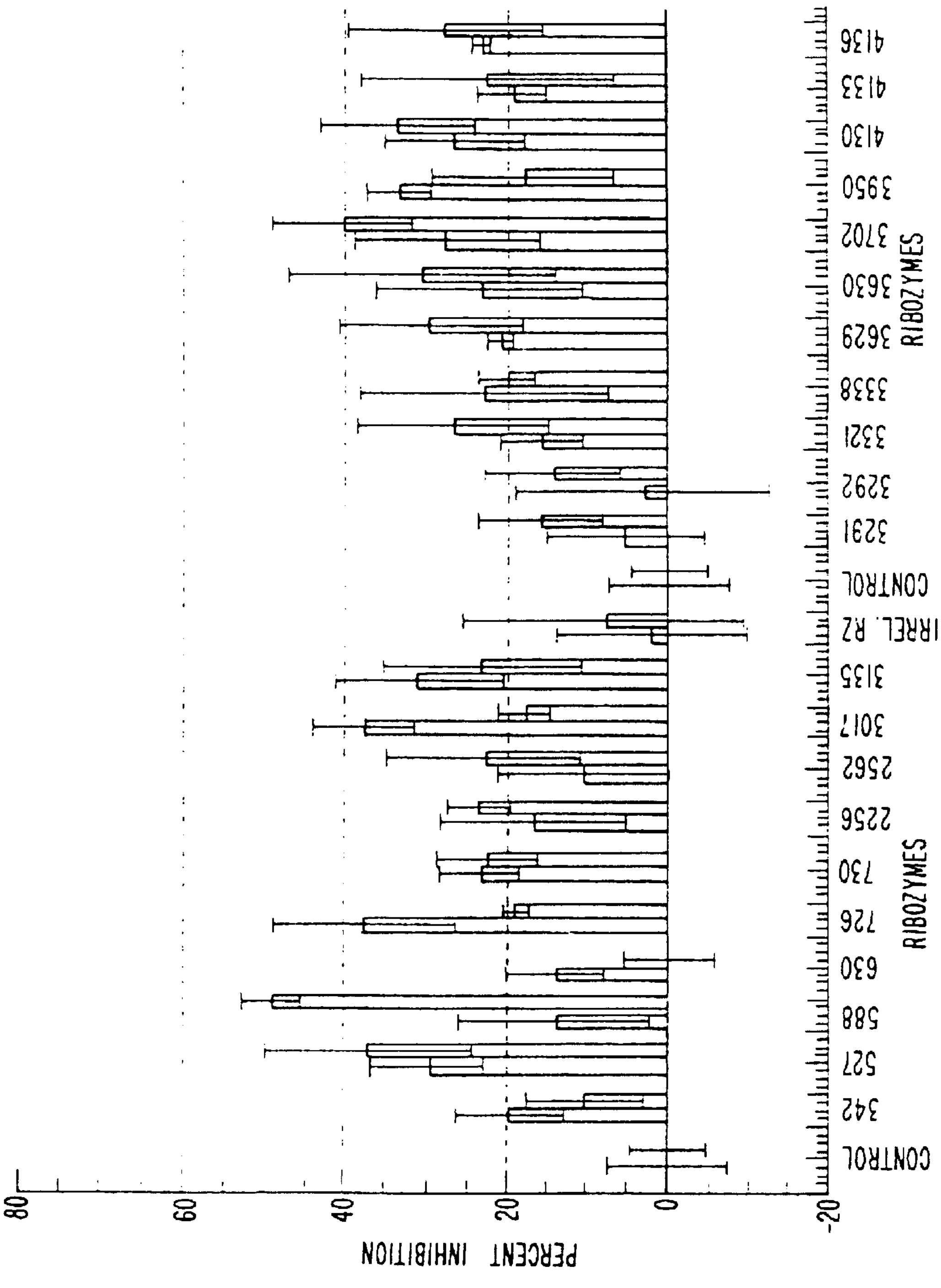

FIG. 8 shows the effect of hammerhead ribozymes targeted against KDR receptor on the binding of VEGF to KDR on the surface of human microvascular endothelial cells. Sequences of the ribozymes used are shown in Table IV; the length of stem II region is 3 bp. The hammerhead ribozymes were chemically modified such that the ribozyme consists of ribose residues at five positions (see FIG. 11); U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The Control 1–10 and Control 11–20 represent the treatment of cells with LipofectAMINE ® alone without any ribozymes. Irrel. RZ, is a control experiment wherein the cells are treated with a non-KDR-targeted ribozyme complexed with Lipofectamine®. 200 nM ribozyme (3:1 charge ratio with LipofectAMINE®) was used. In addition to the KDR-targeted ribozymes, the effect on VEGF binding of a ribozyme targeted to an irrelevant mRNA (irrel. RZ) is also shown. Because the affinity of KDR for VEGF is about 10-fold lower than the affinity of flt-1 for VEGF, a higher concentration of VEGF was used in the binding assay.

Figure 9:
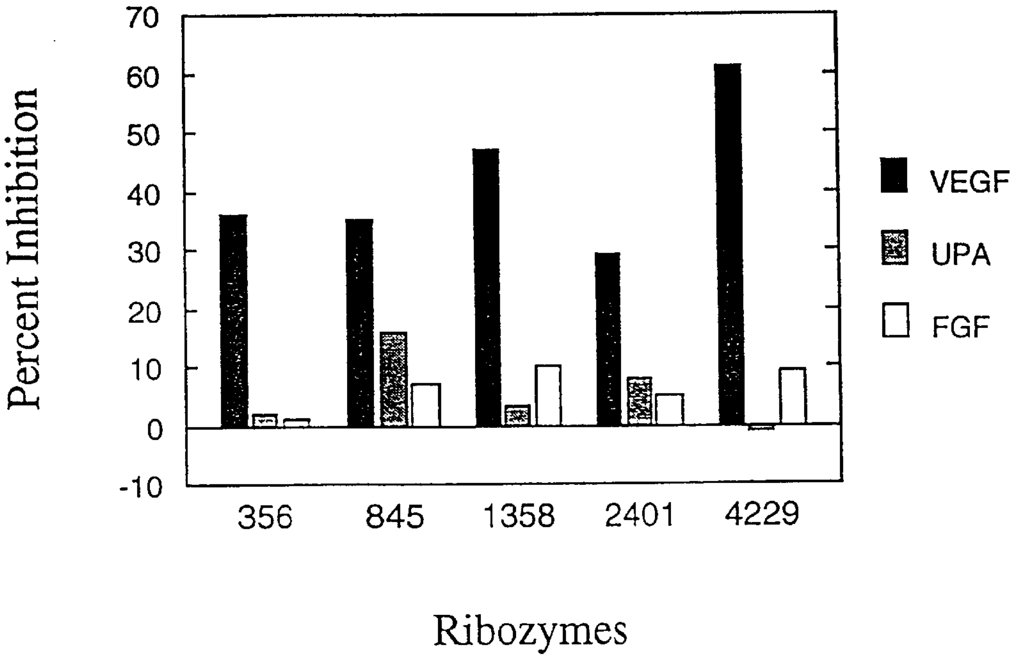

FIG. 9 shows the specificity of hammerhead ribozymes targeted against flt-1 receptor. Inhibition of the binding of VEGF, urokinase plasminogen activator (UPA) and fibroblast growth factor (FGF) to their corresponding receptors as a function of anti-FLT ribozymes is shown. The sequence and description of the ribozymes used are as described under FIG. 7 above. The average of triplicate samples is given; percent inhibition as calculated below.

Figure 10:
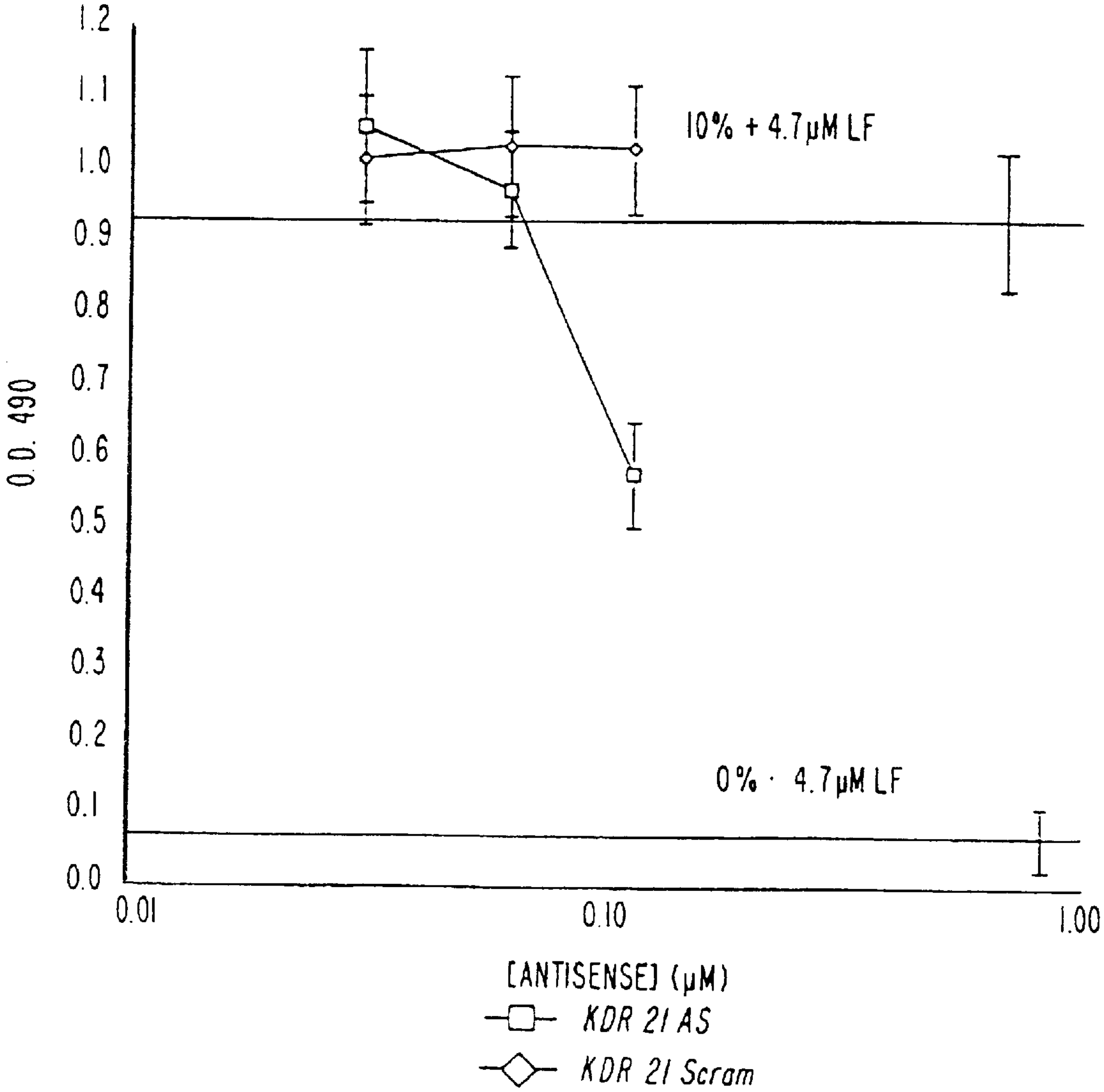

FIG. 10 shows the inhibition of the proliferation of Human aortic endothelial cells (HAEC) mediated by phosphorothioate antisense oligodeoxynucleotides targeted against human KDR receptor RNA. Cell proliferation (O.D. 490) as a function of antisense oligodeoxynucleotide concentration is shown. KDR 21AS represents a 21 nt phosphorothioate antisense oligodeoxynucleotide targeted against KDR RNA. KDR 21 Scram represents a 21 nt phosphorothioate oligodeoxynucleotide having a scrambled sequence. LF represents the lipid carrier Lipofectin.

Figure 11B:
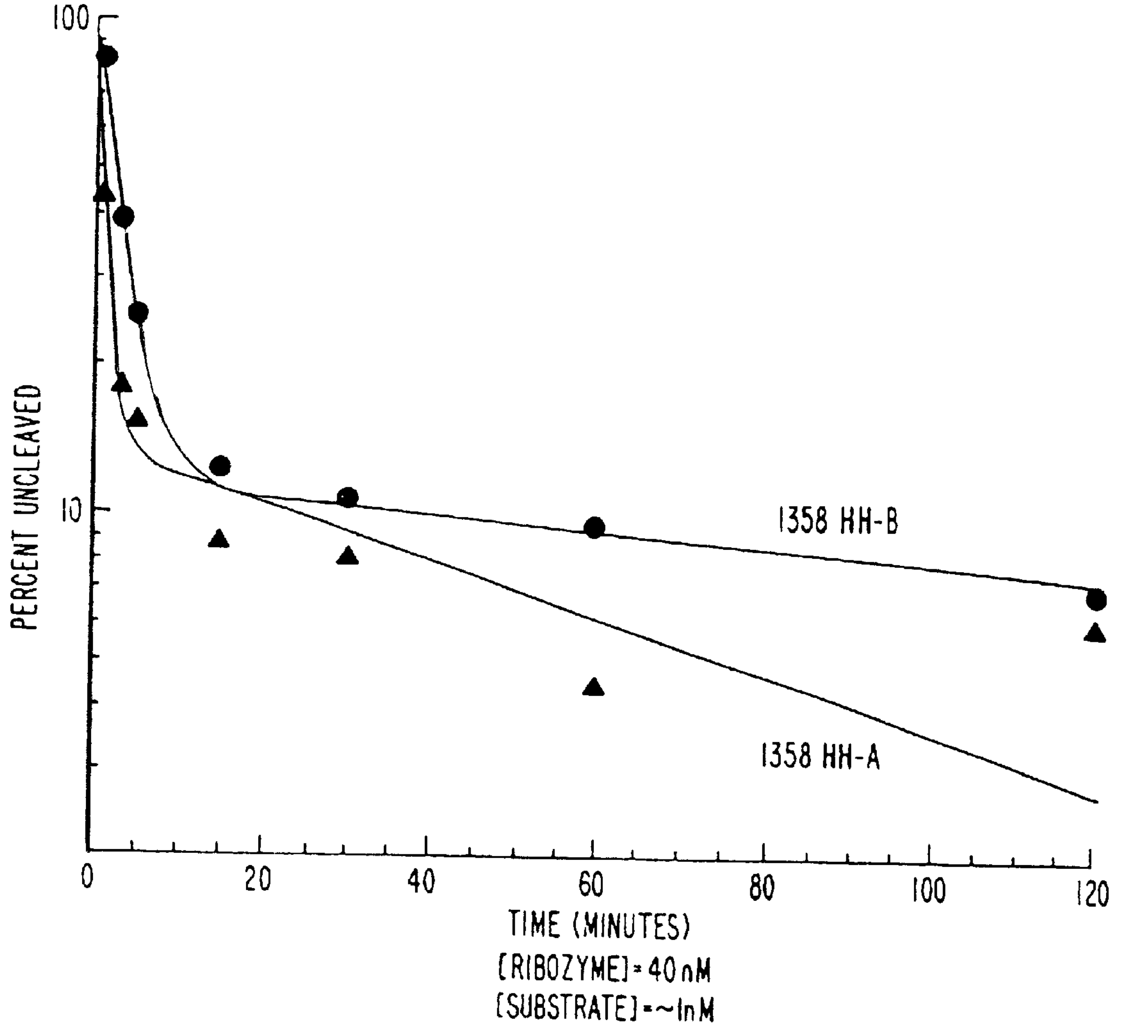
Figure 11C:
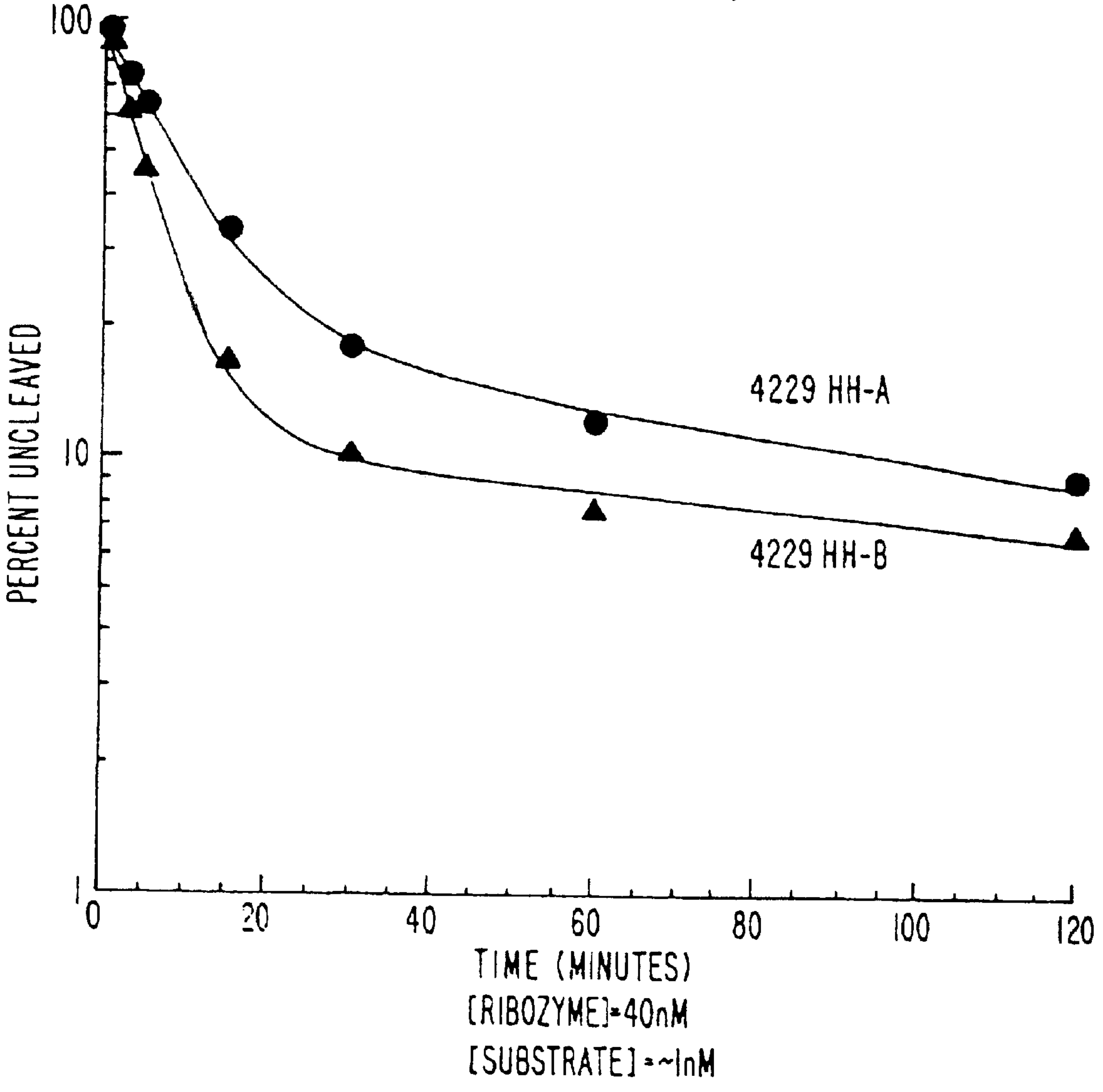

FIGS. 11A–11C show in vitro cleavage of flt-1 RNA by hammerhead ribozymes. 11A1–11A2 diagrammatic representation of hammerhead ribozymes targeted against flt-1 RNA. The hammerhead (HH) ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose (designated as 3'-iH). 1358 HH-A and 4229 HH-A contain 3 base-paired stem 11 region. 1358 HH-B and 4229 HH-B contain 4 base-paired stem 11 region. 11B and 11C, shows in vitro cleavage kinetics of HH ribozymes targeted against sites 1358 and 4229 within the flt-1 RNA.

FIGS. 12A1–12B show inhibition of human microvascular endothelial cell proliferation mediated by anti-flt-1 hammerhead ribozymes. 12A1–12A2 Diagrammatic representation of hammerhead (HH) ribozymes targeted against sites 1358 and 4229 within the flt-1 RNA. 11B Graphical representation of the inhibition of cell proliferation mediated by 1358HH and 4229HH ribozymes.

Figure 13:
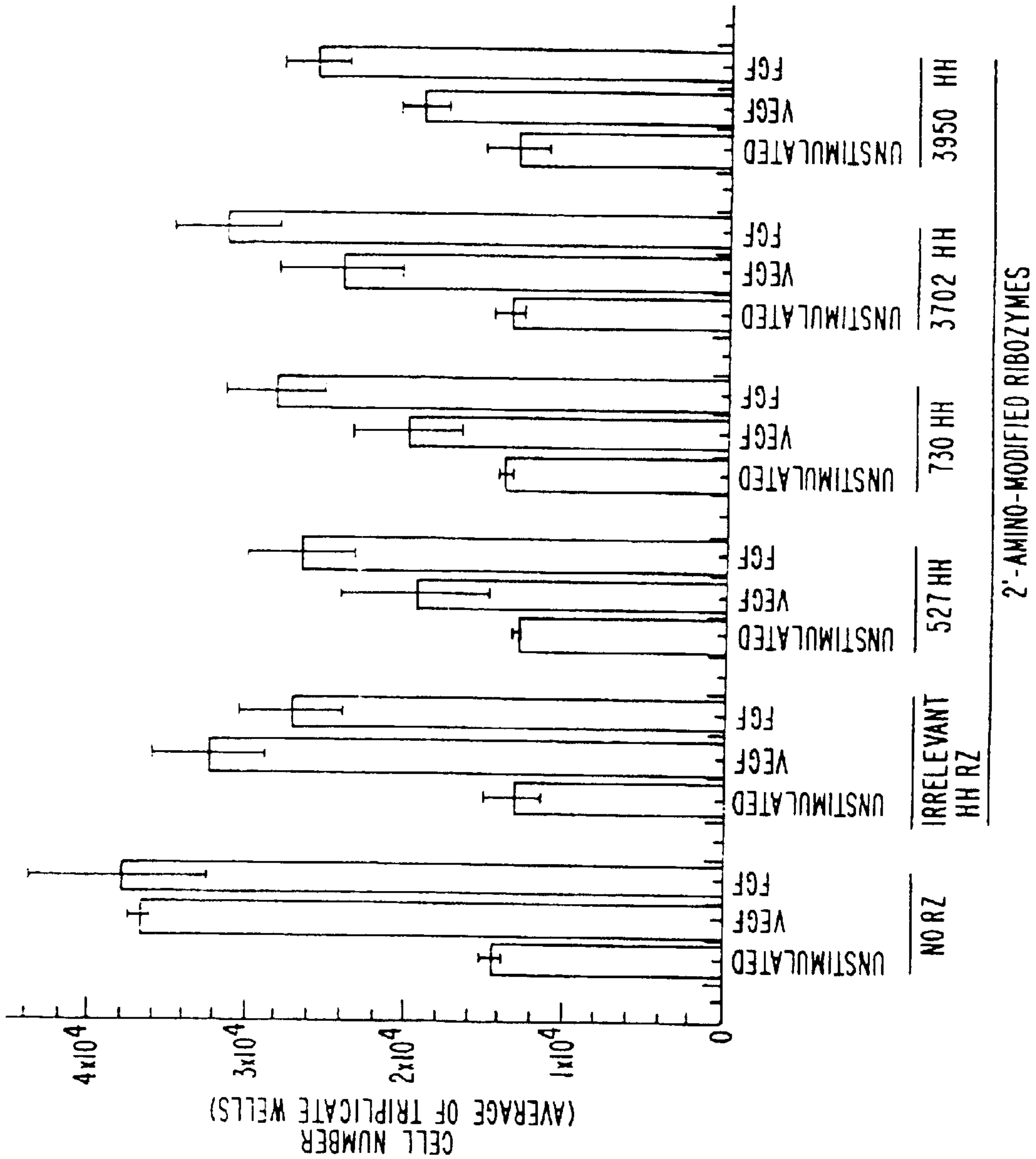

FIG. 13 shows inhibition of human microvascular endothelial cell proliferation mediated by anti-KDR hammerhead ribozymes. The figure is a graphical representation of the inhibition of cell proliferation mediated by hammerhead ribozymes targeted against sites 527, 730, 3702 and 3950 within the KDR RNA. Irrelevant. HH RZ is a hammerhead ribozyme targeted to an irrelevant target. All of these ribozymes, including the Irrelevant HH RZ, were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 14:
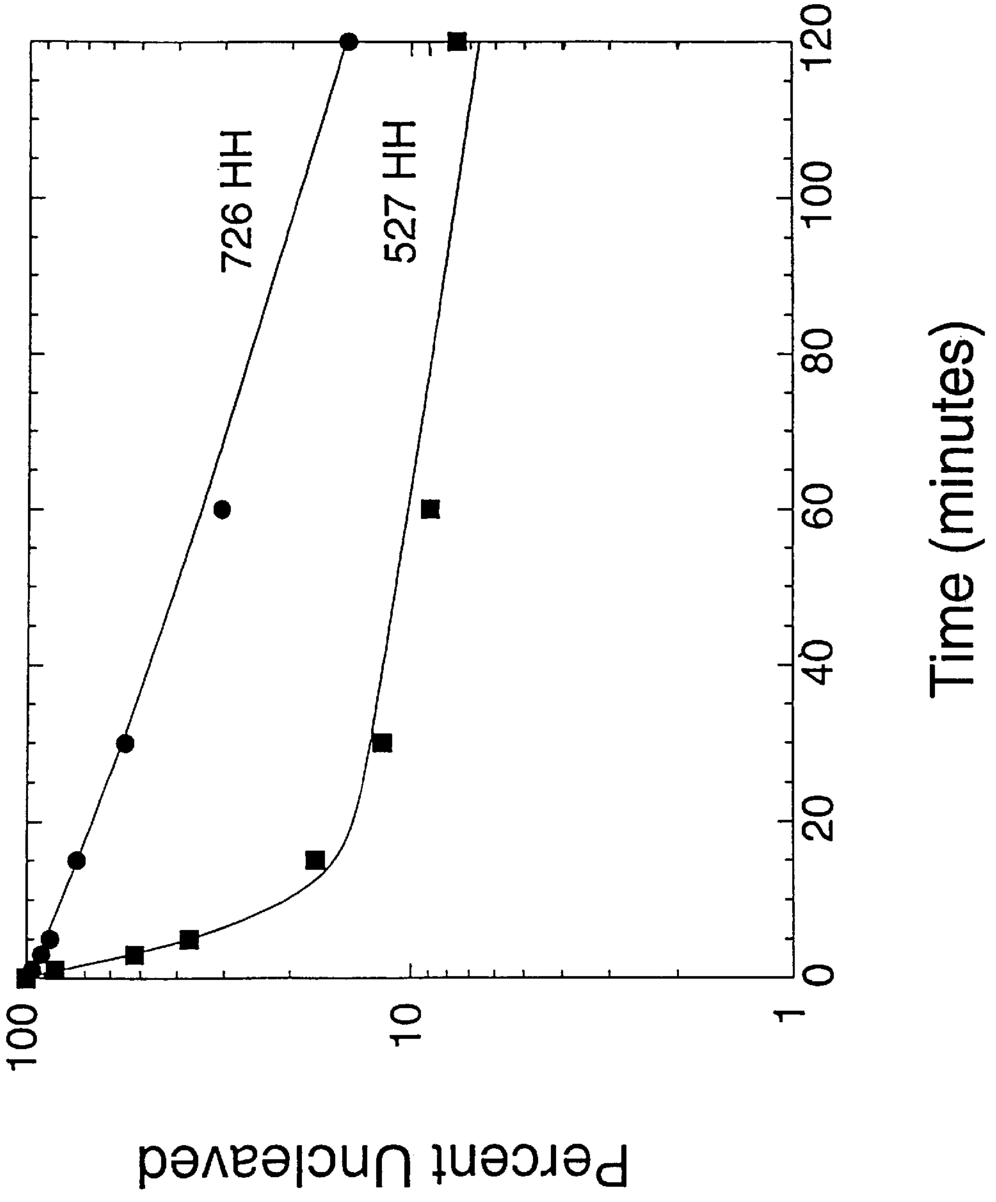

FIG. 14 shows in vitro cleavage of KDR RNA by hammerhead ribozymes. The hammerhead (HH) ribozymes were chemically modified such that the ribozyme consists of ribose residues at five positions; U4 and U7 positions contain 2'-$NH_2$ modifications, the remaining nucleotide positions contain 2'-O-methyl substitutions. Additionally, the 3' end of the ribozyme contains a 3'-3' linked inverted abasic deoxyribose (designated as 3'-iH). 726 HH and 527 HH contain 4 base-paired stem 11 region. Percent in vitro cleavage kinetics as a function of time of HH ribozymes targeted against sites 527 and 726 within the KDR RNA is shown.

Figure 15:
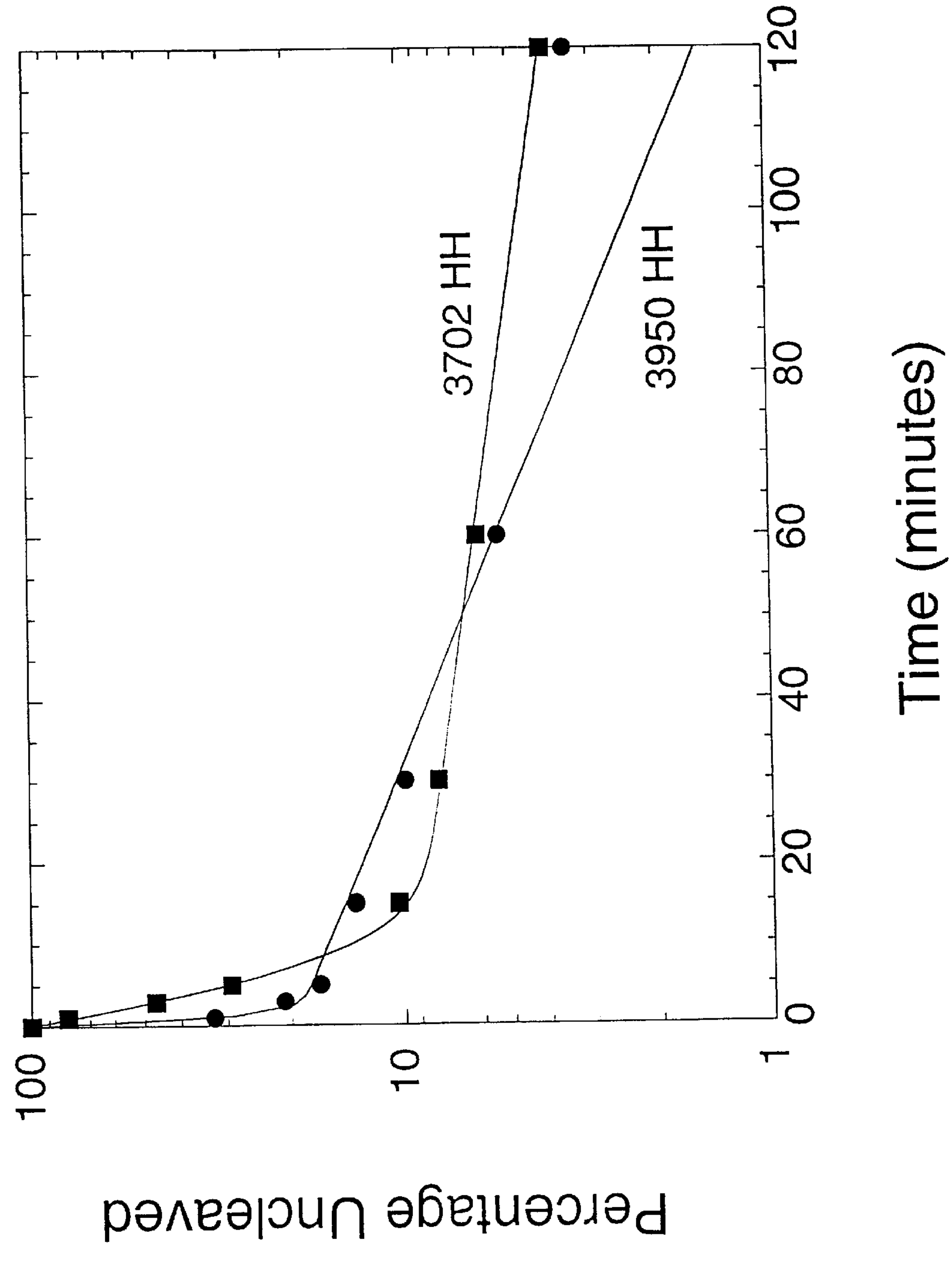

FIG. 15 shows in vitro cleavage of KDR RNA by hammerhead ribozymes. The hammerhead (HH) ribozymes were chemically modified such that the ribozyme consists of ribose residues at five positions; U4 and U7 positions contain 2'-$NH_2$ modifications, the remaining nucleotide positions contain 2'-O-methyl substitutions. Additionally, the 3' end of the ribozyme contains a 3'-3' linked inverted abasic deoxyribose (designated as 3'-iH). 3702 HH and 3950 HH contain 4 base-paired stem 11 region. Percent in vitro cleavage kinetics as a function of time of HH ribozymes targeted against sites 3702 and 3950 within the KDR RNA is shown.

Figure 16:
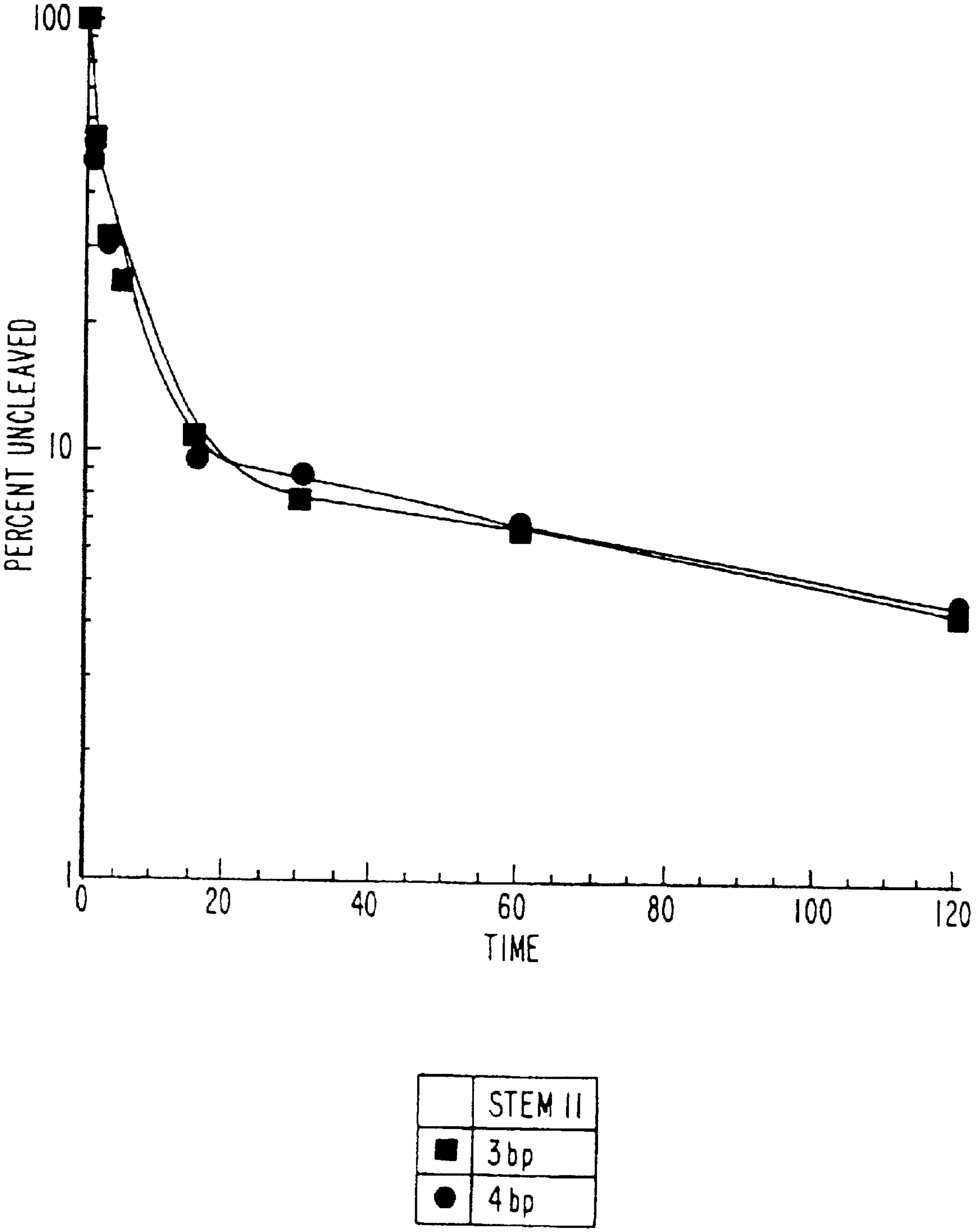

FIG. 16 shows in vitro cleavage of RNA by hammerhead ribozymes that are targeted to sites that are conserved between flt-1 and KDR RNA. The hammerhead (HH) ribozymes were chemically modified such that the ribozyme consists of ribose residues at five positions; U4 and U7 positions contain 2'-$NH_2$ modifications, the remaining nucleotide positions contain 2'-O-methyl substitutions. Additionally, the 3' end of the ribozyme contains a 3'-3' linked inverted abasic deoxyribose (designated as 3'-iH). FLT/KDR-l HH ribozyme was synthesized with either a 4 base-paired or a 3 base-paired stem II region. FLT/KDR-I HH can cleave site 3388 within flt-1 RNA and site 3151 within KDR RNA. Percent in vitro cleavage kinetics as a function of time of HH ribozymes targeted against sites 3702 and 3950 within the KDR RNA is shown.

Figure 17:
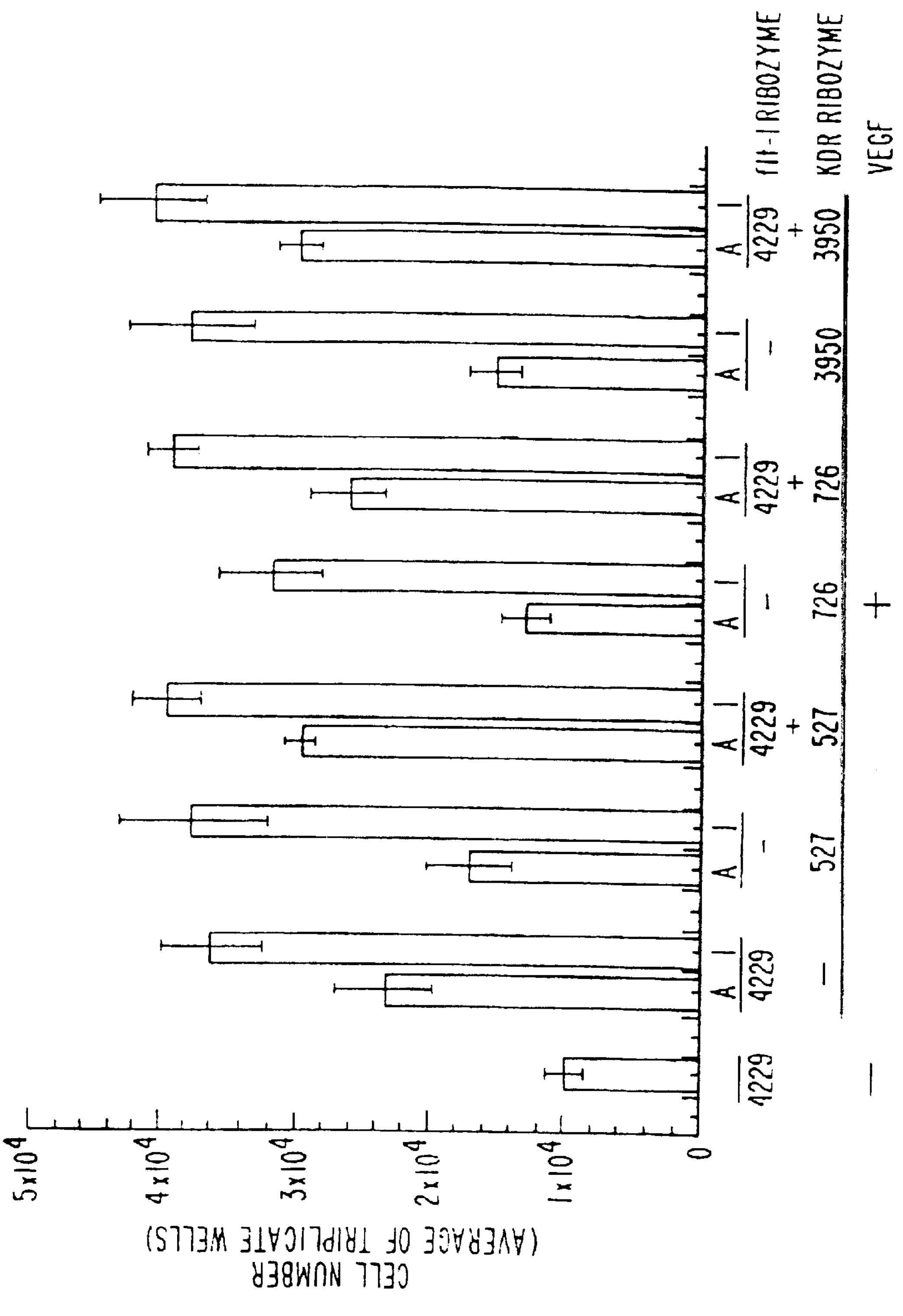

FIG. 17 shows inhibition of human microvascular endothelial cell proliferation mediated by anti-KDR and anti-flt-1 hammerhead ribozymes. The figure is a graphical representation of the inhibition of cell proliferation mediated by hammerhead ribozymes targeted against sites KDR sites—527, 726 or 3950 or flt-1 site 4229. The figure also shows enhanced inhibition of cell proliferation by a combination of flt-1 and KDR hammerhead ribozymes. 4229+527, indicates the treatment of cells with both the fit 4229 and the KDR 527 ribozymes. 4229+726, indicates the treatment of cells with both the fit 4229 and the KDR 726 ribozymes. 4229+3950, indicates the treatment of cells with both the fit 4229 and the KDR 3950 ribozymes. VEGF -, indicates the basal level of cell proliferation in the absence of VEGF. A, indicates catalytically active ribozyme; I, indicates catalytically inactive ribozyme. All of these ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 18:
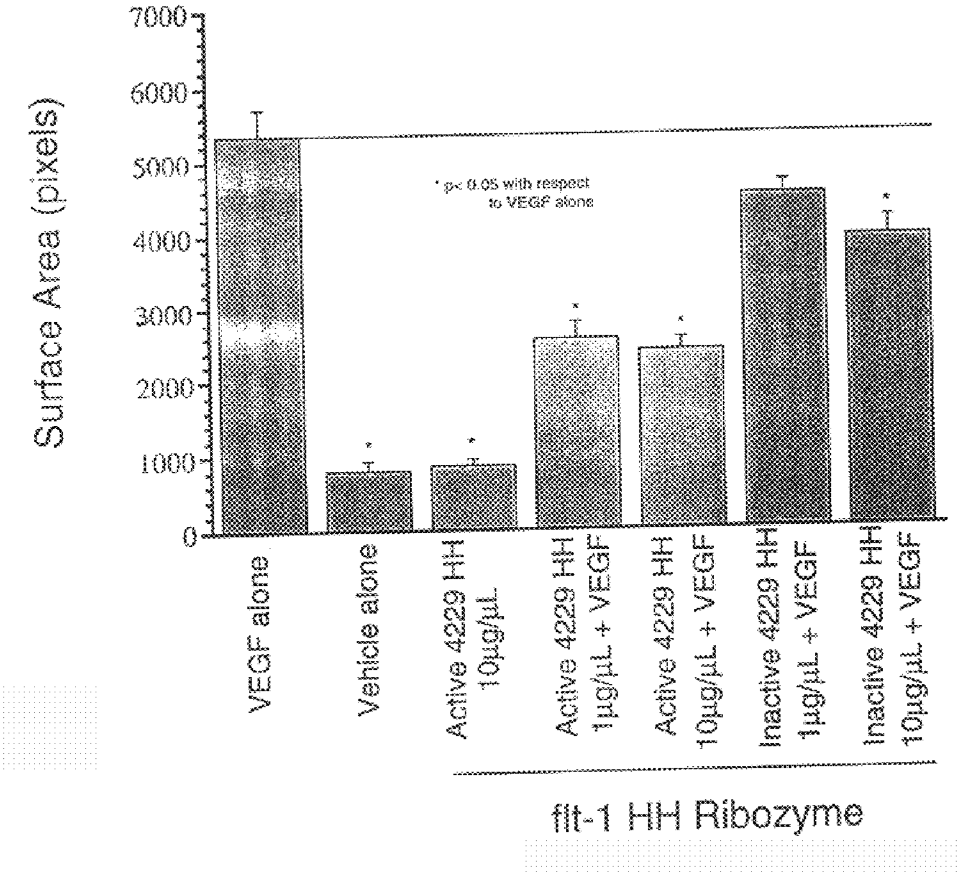

FIG. 18 shows the inhibition of VEGF-induced angiogenesis in rat cornea mediated by anti4it-1 hammerhead ribozyme. All of these ribozymes were chemically modified such that the ribozyme consists of ribose residues at five positions; U4 position contains 2'-C-allyl modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH). A decrease in the Surface Area corresponds to a reduction in angiogenesis. VEGF alone, corresponds to treatment of the cornea with VEGF and no ribozymes. Vehicle alone, corresponds to the treatment of the cornea with the carrier alone and no VEGF. This control gives a basal level of Surface Area. Active 4229 HH, corresponds to the treatment of cornea with the flt-1 4229 HH ribozyme in the absence of any VEGF. This control also gives a basal level of Surface Area. Active 4229 HH+VEGF, corresponds to the co-treatment of cornea with the flt-1 4229 HH ribozyme and VEGF. Inactive 4229 HH+VEGF, corresponds to the co-treatment of cornea with a catalytically inactive version of 4229 HH ribozyme and VEGF.

FIGS. 19A–19D show Ribozyme mediated inhibition of cell proliferation. Cultured HMVEC-d were treated with ribozyme or attenuated controls as LIPOFECTAMINE™ complexes. After treatment, cells were stimulated with $VEGF_{165}$ or bFGF and allowed to grow for 48 h prior to determining the cell number. Each ribozyme was tested in triplicate at three concentrations and data are presented as mean cell number per well +SD. The data obtained following ribozyme treatment and VEGF stimulation are presented in panels A & B for anti-Flt-1 ribozymes and panels D & E for anti-KDR ribozymes. Representative data obtained following ribozyme treatment and bFGF stimulation are shown in panel C for one anti-Flt-1 ribozyme and in panel F for one anti-KDR ribozyme. In all panels, active ribozymes are represented with filled symbols;

attenuated controls with open symbols. In addition to the ribozymes and attenuated controls listed in Table XII, a second set having the same sequences but with an additional basepair in the "stem II" region of the ribozyme are also shown for VEGF-induced proliferation studies. These 4 bp stem II ribozymes and attenuated controls have one additional base pair such that the stem II/loop sequence is ggccgaaaggcc (Seq ID No. 14206). Therefore, ribozymes and controls with 3 or 4 basepair stem IIs are denoted with circles and squares, respectively. The data for one irrelevant ribozyme (filled triangle, panel B) are also shown. This irrelevant ribozyme contains an active core sequence but has no binding site in either Flt-1 or KDR mRNA. Its sequence is 5'-$g_sa_sa_sg_s$gaacUGAuGaggccgaaaggccGaaAgauggcT-3' (Seq ID No. 14207) with modifications as in Table XII except that T indicates a 3'-3' inverted deoxythymidine. For reference, the average number of cells in control wells after 48 h in the absence of VEGF or bFGF for each of the panels are as follows: A, B, C, 12477±617; D,E, F, 17182±1053.

Figure 20:
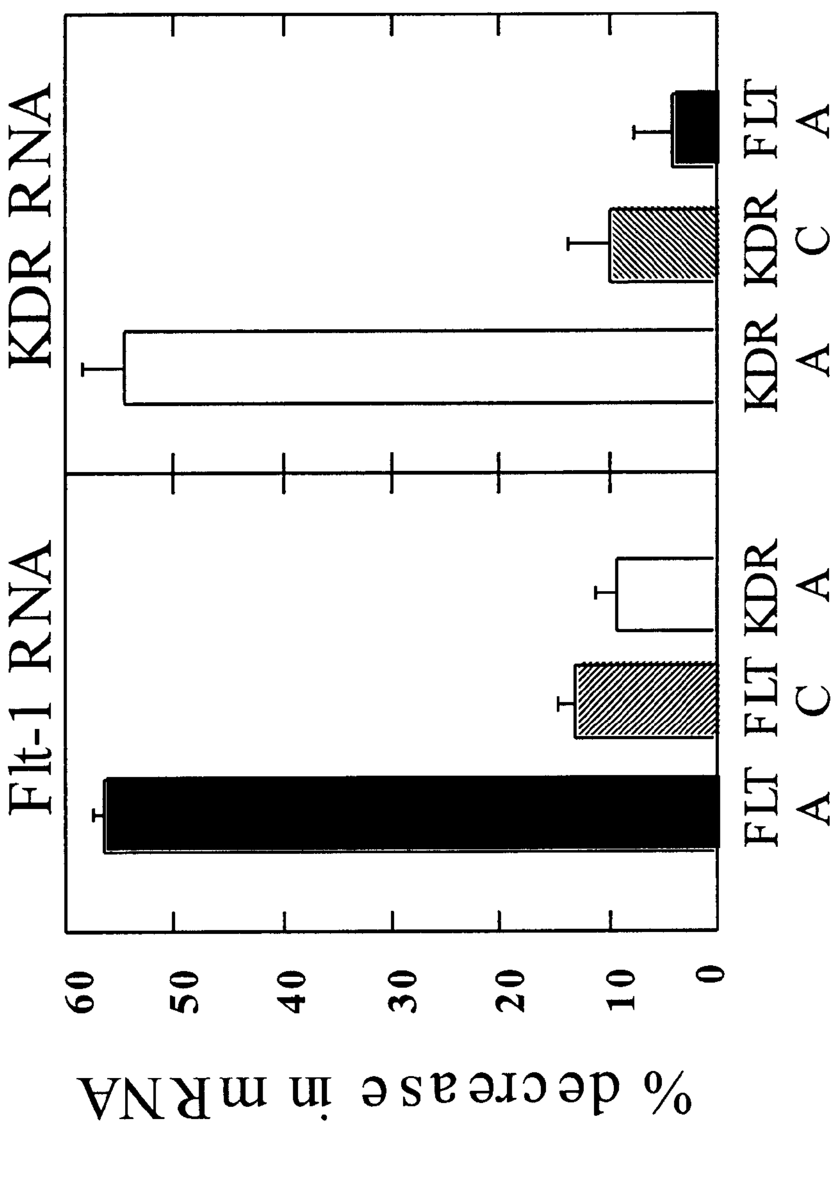

FIG. 20 shows target specificity of anti-Flt-1 and KDR ribozymes. Cultured HMVEC-D were treated with LIPOFECTAMINE™ complexes containing 200 nM active ribozyme (A) or attenuated control (C) and analyzed by RNAse protection following 24 h of VEGF-stimulated growth. Data obtained for ribozymes and attenuated controls that target Flt-1 site 4229 or KDR site 726 are shown. Data were normalized to the level of an internal mRNA control (cyclophilin) and are presented as percent decrease in Flt-1 (left panel) or KDR mRNA (right panel) relative to an untreated control. Error bars indicate the range of duplicate samples.

Figure 21:
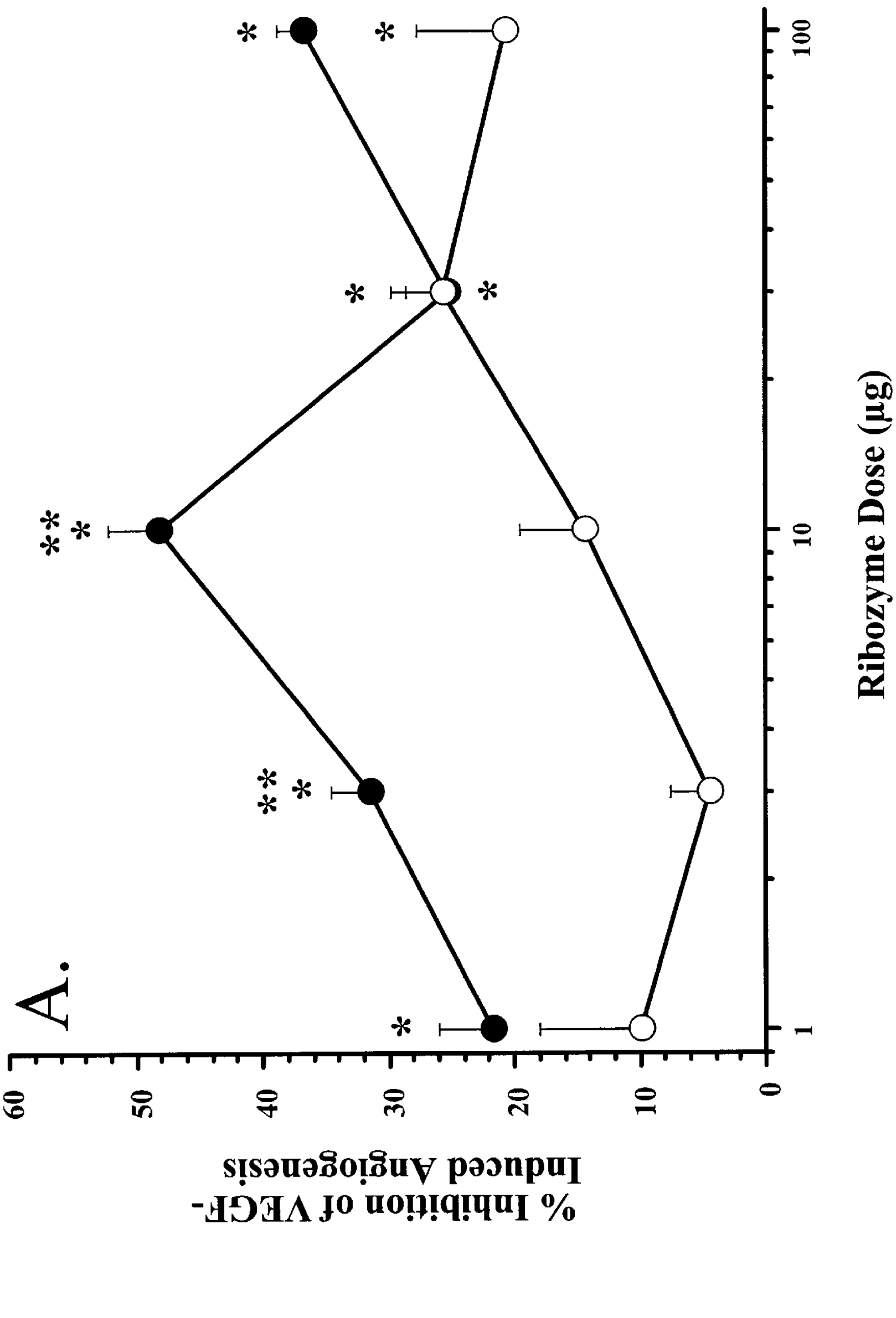
Figure 22:
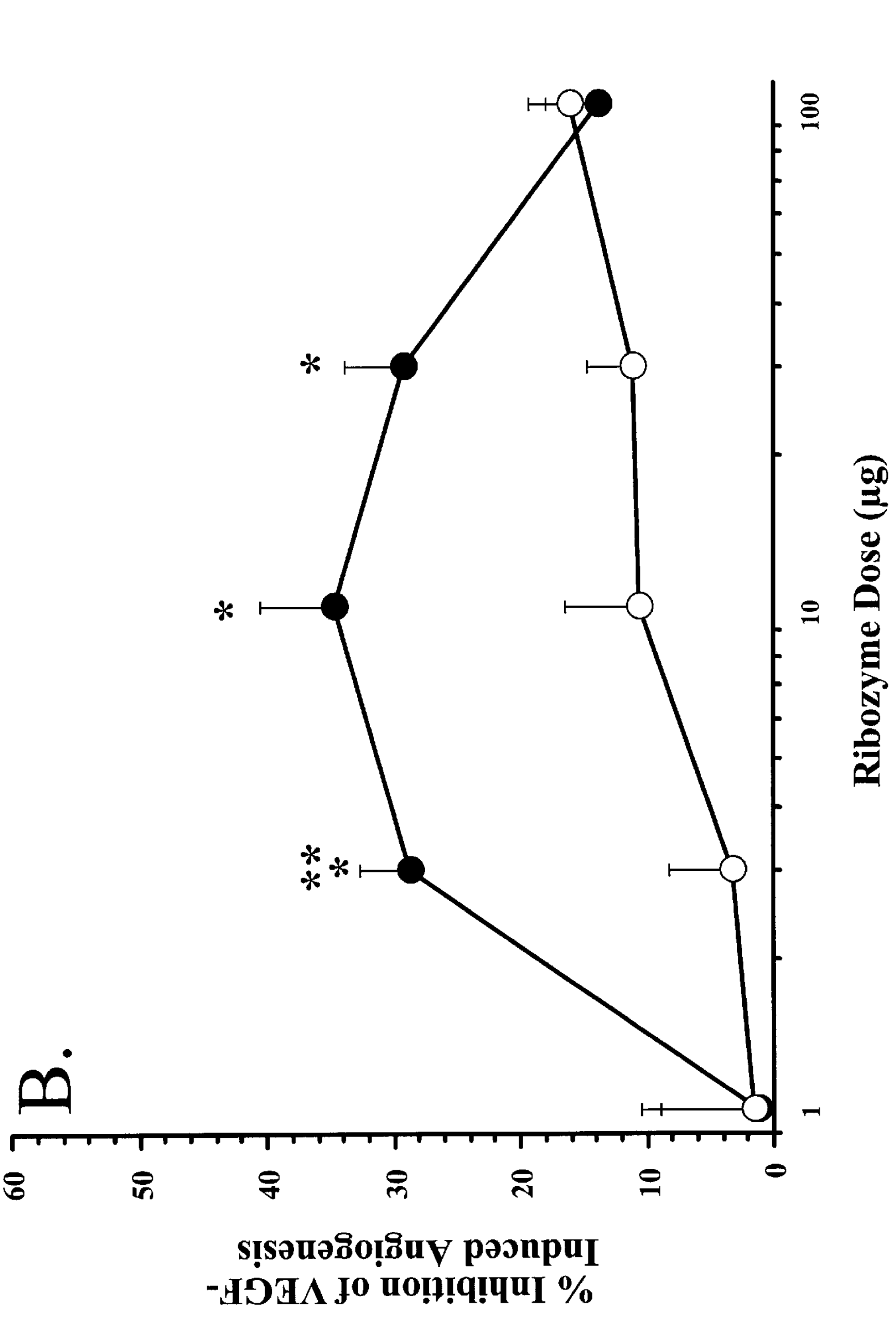

FIGS. 21 and 22 show antiangiogenic efficacy of ribozymes in the rat corneal model of VEGF-induced angiogenesis. The percent inhibition of VEGF-induced angiogenesis for locally administered FIG. 21, anti-Flt-1 (site 4229) and FIG. 22, anti-KDR (site 726) ribozymes (filled circles) and their attenuated controls (open circles) are plotted over the dose range tested. Pixels associated with background structures including the iris were subtracted from all treatment groups. Data are expressed as mean percent reduction in VEGF-induced angiogenesis ±SEM.*$p<0.05$ relative to VEGF/vehicle treated controls by Dunnett's, **$p<0.05$ relative to attenuated dose-matched controls by Tukey-Kramer.

Figure 23:
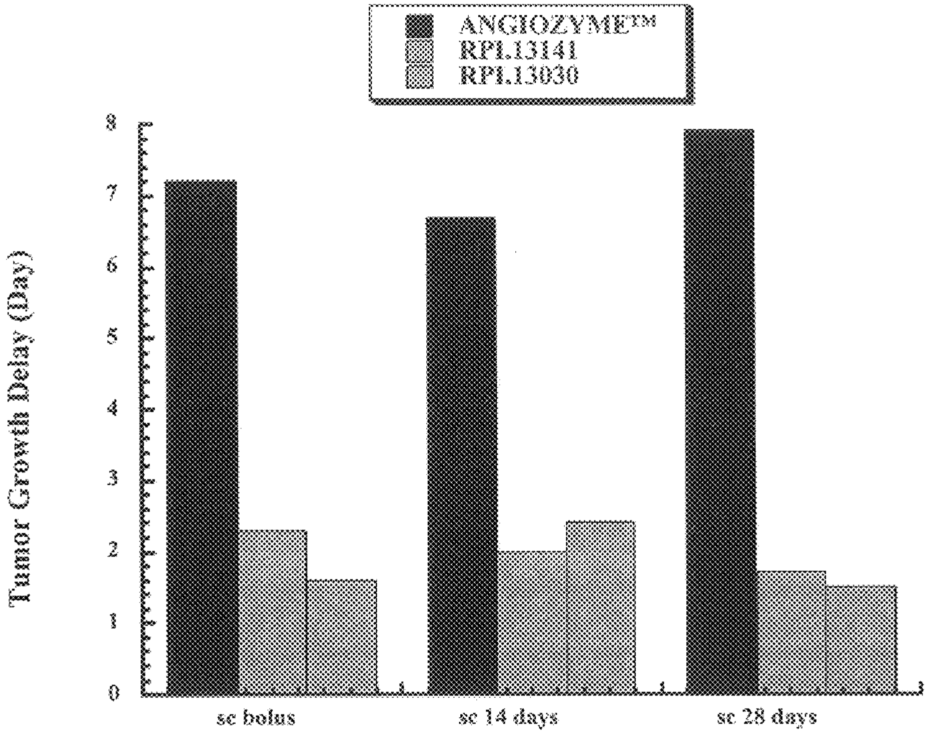

FIG. 23 shows the effect of subcutaneous bolus administration of ANGIOZYME™ in a mouse Lewis Lung Carcinoma (LLC) model.

Figure 24:
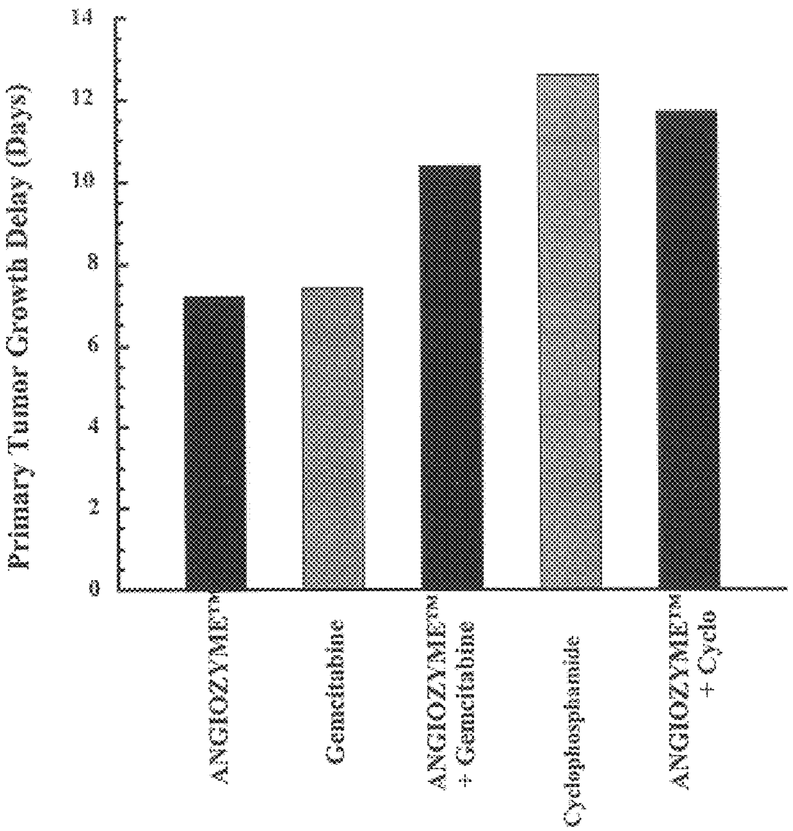

FIG. 24 shows the effect of ANGIOZYME™ in combination with gemcitabine or cyclophosphamide on primary tumor growth in the mouse LLC model.

Figure 25:
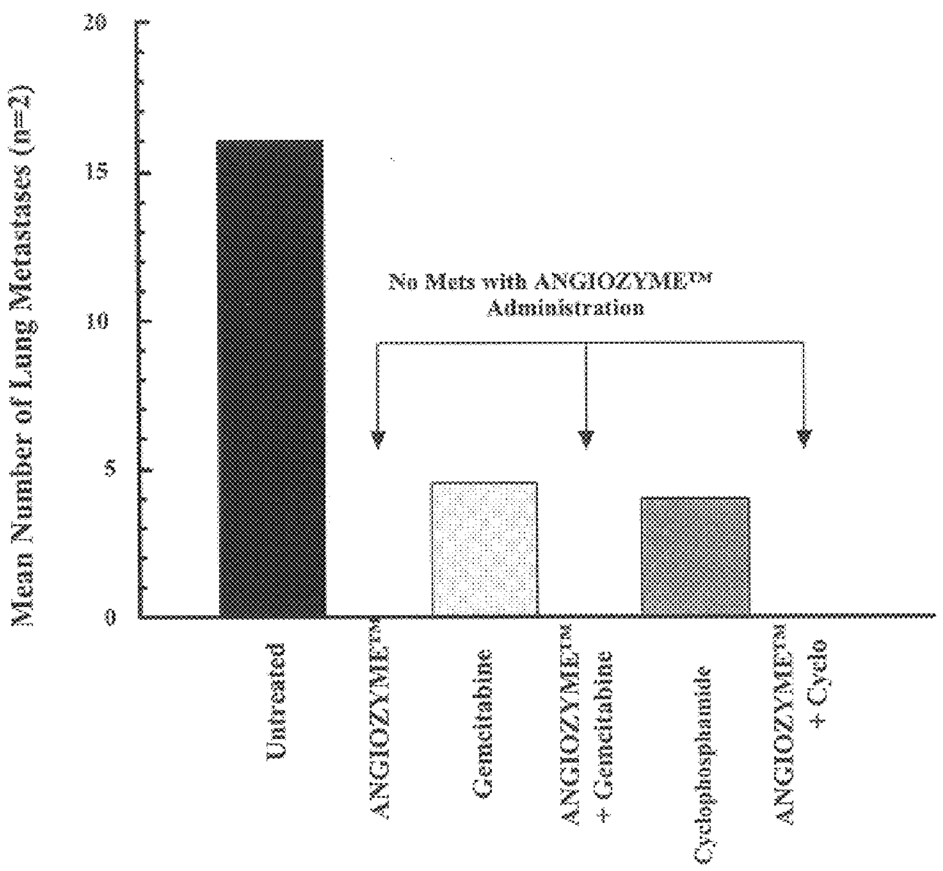

FIG. 25 shows the effect of ANGIOZYME™ in combination with gemcitabine or cyclophosphamide on tumor metastases in the mouse LLC model.

Figure 26:
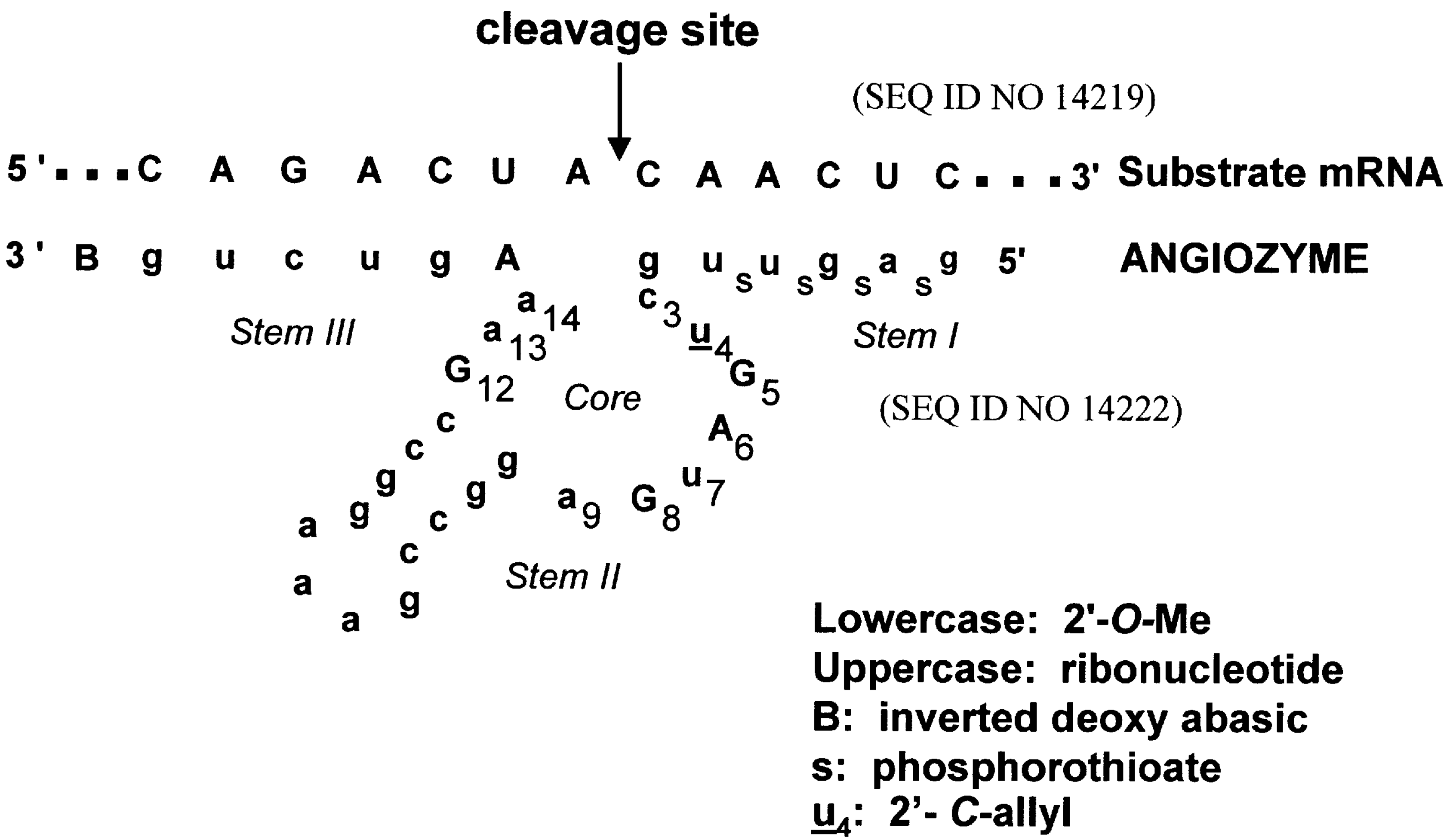

FIG. 26 shows a secondary structure model of ANGIOZYME™ ribozyme bound to its RNA target.

Figure 27:
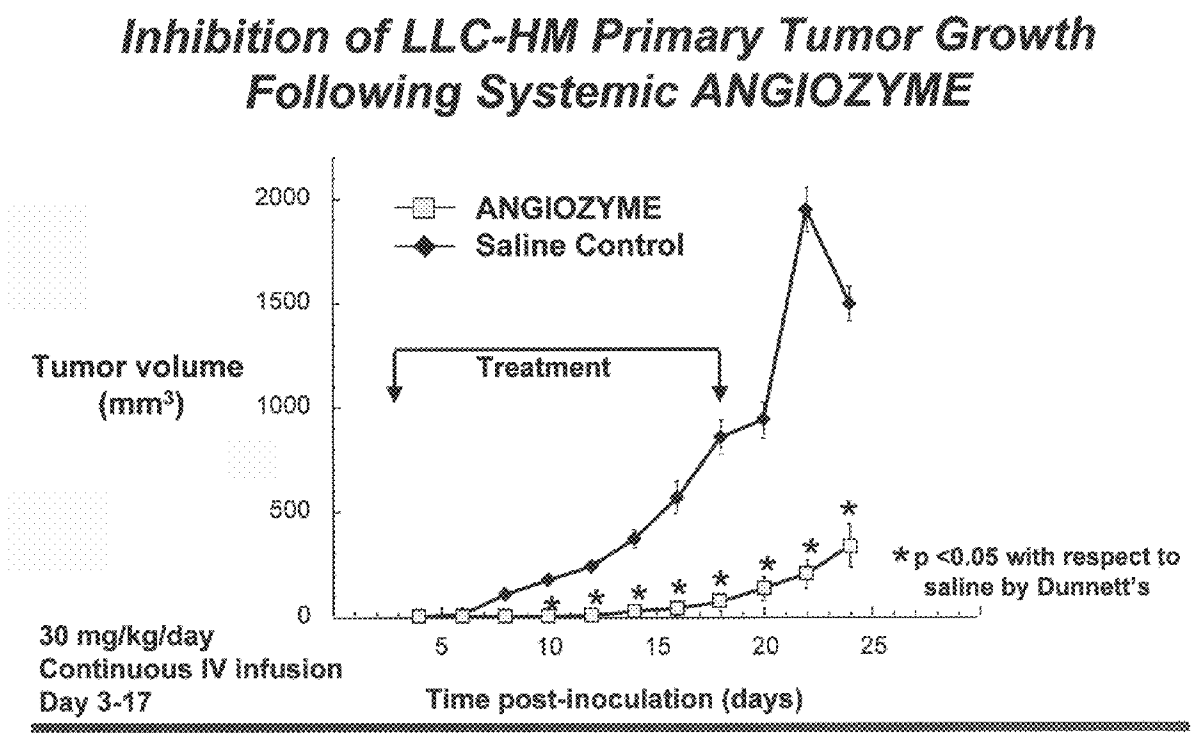

FIG. 27 shows a time course of inhibition of primary tumor growth following systemic administration of ANGIOZYME™ in the LLC mouse model.

Figure 28:
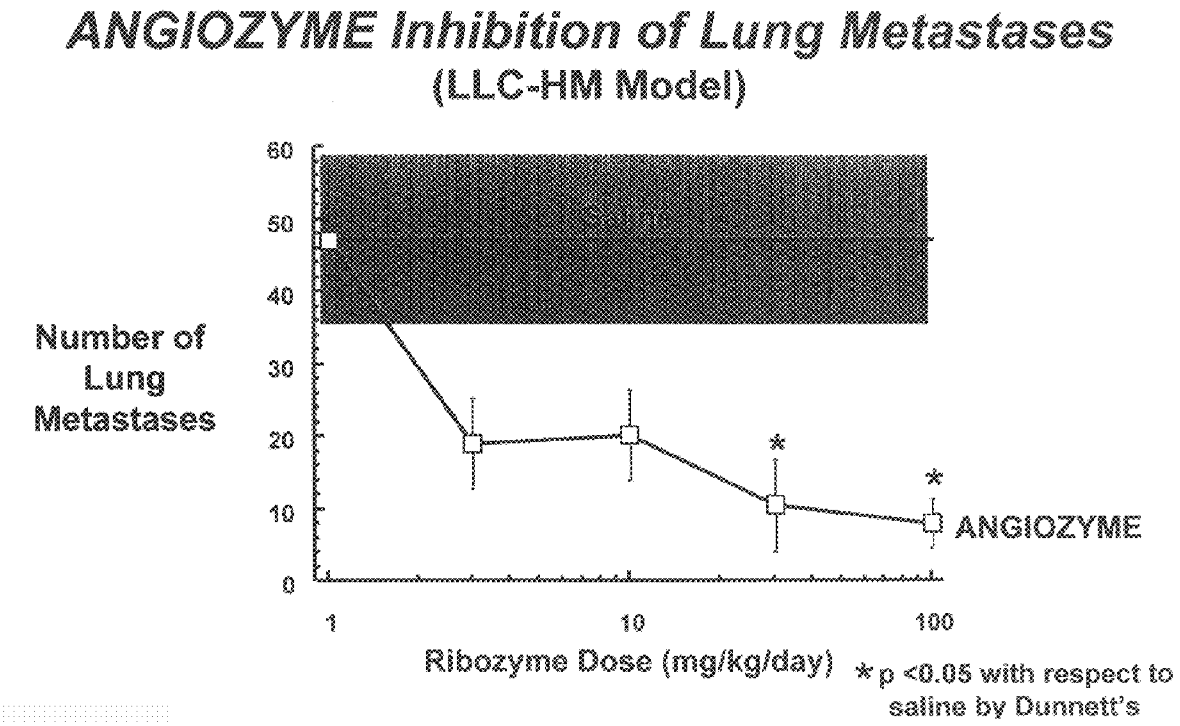

FIG. 28 shows inhibition of primary tumor growth following systemic administration of ANGIOZYME™ according to a certain dosing regimen in the LLC mouse model.

Figure 29:
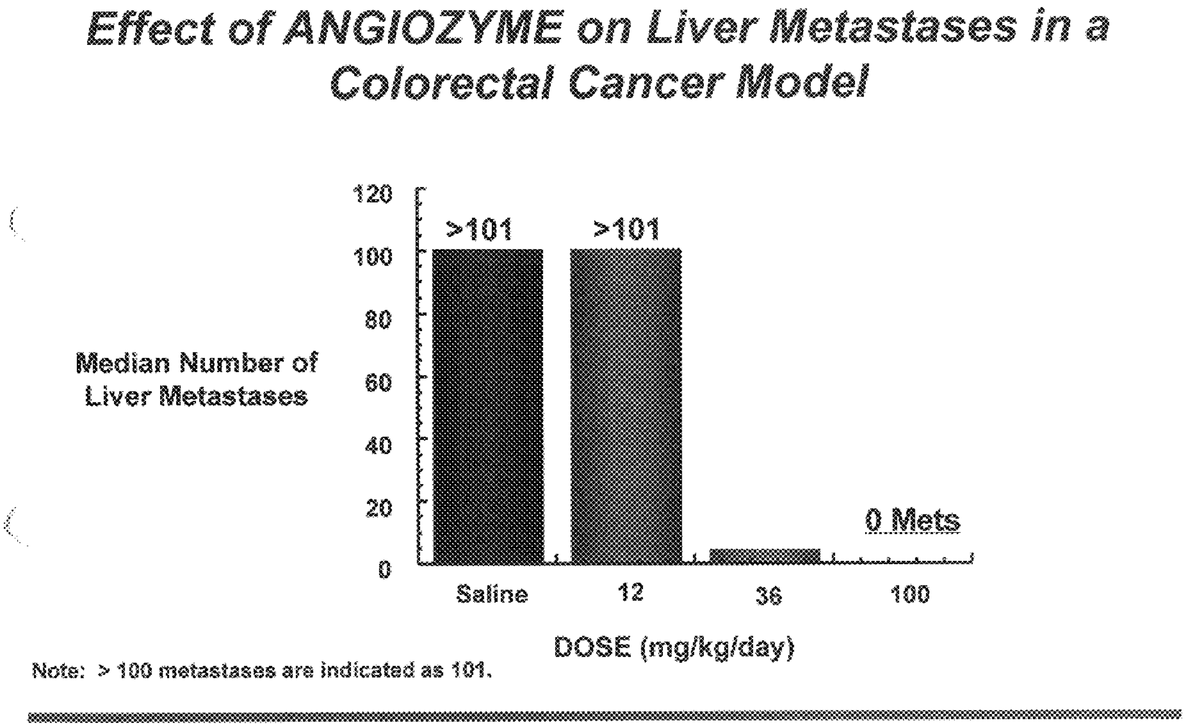

FIG. 29 shows a dose-dependent inhibition of tumor metastases following systemic administration of ANGIOZYME™ in a mouse colorectal model.

Figure 30:
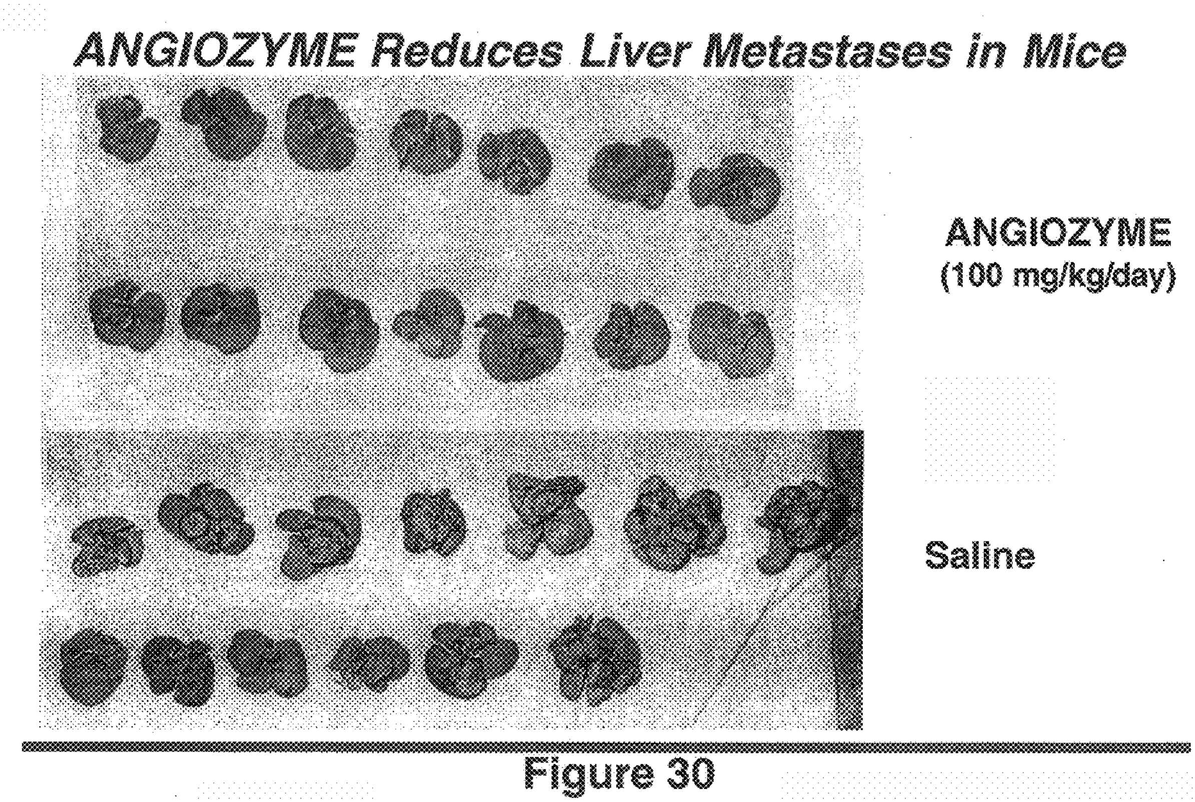

FIG. 30 shows inhibition of liver metastases following systemic administration of ANGIOZYME™ in a mouse colorectal model.

MECHANISM OF ACTION OF NUCLEIC ACID MOLECULES OF THE INVENTION

Antisense: Antisense molecules may be modified or unmodified RNA, DNA, or mixed polymer oligonucleotides and primarily function by specifically binding to matching sequences resulting in inhibition of peptide synthesis (Wu-Pong, November 1994, *BioPharm*, 20–33). The antisense oligonucleotide binds to target RNA by Watson Crick base-pairing and blocks gene expression by preventing ribosomal translation of the bound sequences either by steric blocking or by activating RNase H enzyme. Antisense molecules may also alter protein synthesis by interfering with RNA processing or transport from the nucleus into the cytoplasm (Mukhopadhyay & Roth, 1996, *Crit. Rev. in Oncogenesis* 7, 151–190).

In addition, binding of single stranded DNA to RNA may result in nuclease degradation of the heteroduplex (Wu-Pong, supra; Crooke, supra). To date, the only backbone modified DNA chemistry which will act as substrates for RNase H are phosphorothioates and phosphorodithioates. Recently it has been reported that 2'-arabino and 2'-fluoro arabino- containing oligos can also activate RNase H activity.

A number of antisense molecules have been described that utilize novel configurations of chemically modified nucleotides, secondary structure, and/or RNase H substrate domains (Woolf et al., International PCT Publication No. WO 98/13526; Thompson et al., U.S. Ser. No. 60/082,404 which was filed on Apr. 20, 1998; Hartmann et al., U.S. Ser. No. 60/101,174 which was filed on Sep. 21, 1998) all of these are incorporated by reference herein in their entirety.

Triplex Forming Oligonucleotides (TFO): Single stranded DNA may be designed to bind to genomic DNA in a sequence specific manner. TFOs are comprised of pyrimidine-rich oligonucleotides which bind DNA helices through Hoogsteen Base-pairing (Wu-Pong, supra). The resulting triple helix composed of the DNA sense, DNA antisense, and TFO disrupts RNA synthesis by RNA polymerase. The TFO mechanism may result in gene expression or cell death since binding may be irreversible (Mukhopadhyay & Roth, supra) 2-5A Antisense Chimera: The 2-5A system is an interferon mediated mechanism for RNA degradation found in higher vertebrates (Mitra et al., 1996, *Proc Nat Acad Sci USA* 93, 6780–6785). Two types of enzymes, 2-5A synthetase and RNase L, are required for RNA cleavage. The 2-5A synthetases require double stranded RNA to form 2'-5' oligoadenylates (2-5A). 2-5A then acts as an allosteric effector for utilizing RNase L which has the ability to cleave single stranded RNA. The ability to form 2-5A structures with double stranded RNA makes this system particularly useful for inhibition of viral replication. (2'-5') oligoadenylate structures may be covalently linked to antisense molecules to form chimeric oligonucleotides capable of RNA cleavage (Torrence, supra). These molecules putatively bind and activate a 2-5A dependent RNase, the oligonucleotide/enzyme complex then binds to a target RNA molecule which can then be cleaved by the RNase enzyme.

Enzymatic Nucleic Acid: Seven basic varieties of naturally-occurring enzymatic RNAs are presently known. In addition, several in vitro selection (evolution) strategies (Orgel, 1979, *Proc. R. Soc. London*, B 205, 435) have been used to evolve new nucleic acid catalysts capable of catalyzing cleavage and ligation of phosphodiester linkages (Joyce, 1989, *Gene*, 82, 83–87; Beaudry et al., 1992, *Science* 257, 635–641; Joyce, 1992, *Scientific American* 267, 90–97; Breaker et al., 1994, *TIBTECH* 12, 268; Bartel et al., 1993, *Science* 261:1411–1418; Szostak, 1993, *TIBS* 17, 89–93; Kumar et al., 1995, *FASEB J*., 9, 1183; Breaker, 1996, *Curr. Op. Biotech*., 7, 442; Santoro et al., 1997, *Proc. Natl. Acad. Sci*., 94, 4262; Tang et al., 1997, *RNA* 3, 914; Nakamaye & Eckstein, 1994, supra; Long & Uhlenbeck, 1994, supra; Ishizaka et al., 1995, supra; Vaish et al., 1997, *Biochemistry* 36, 6495; all of these are incorporated by reference herein). Each can catalyze a series of reactions including the hydrolysis of phosphodiester bonds in trans (and thus can cleave other RNA molecules) under physiological conditions.

Enzymatic nucleic acid molecules of this invention block to some extent VEGF-R (specifically flt-1 and flk-1/KDR) production and can be used to treat disease or diagnose such disease. Ribozymes will be delivered to cells in culture, to cells or tissues in animal models of angiogenesis and/or RA and to human cells or tissues ex vivo or in vivo. Ribozyme cleavage of VEGF-R RNAs (specifically RNAs that encode flt-1 and flk-1/KDR) in these systems may alleviate disease symptoms.

The enzymatic nature of a ribozyme has significant advantages, such as the concentration of ribozyme necessary to affect a therapeutic treatment is lower. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base-pairing mechanism of binding to the target RNA, but also on the mechanism of target RNA cleavage. Single mismatches, or base-substitutions, near the site of cleavage can be chosen to completely eliminate catalytic activity of a ribozyme.

Nucleic acid molecules having an endonuclease enzymatic activity are able to repeatedly cleave other separate RNA molecules in a nucleotide base sequence-specific manner. Such enzymatic nucleic acid molecules can be targeted to virtually any RNA transcript, and achieved efficient cleavage in vitro (Zaug et al., 324, *Nature* 429 1986; Uhlenbeck, 1987 *Nature* 328, 596; Kim et al., 84 *Proc. Natl. Acad. Sci. USA* 8788, 1987; Dreyfus, 1988, Einstein Quart. *J. Bio. Med*., 6, 92; Haseloff and Gerlach, 334 *Nature* 585, 1988; Cech, 260 *JAMA* 3030, 1988; =;and Jefferies et al., 17 *Nucleic Acids Research* 1371, 1989; Santoro et al., 1997 supra).

Because of their sequence specificity, trans-cleaving ribozymes show promise as therapeutic agents for human disease (Usman & McSwiggen, 1995 *Ann. Rep. Med. Chem*. 30, 285–294; Christoffersen and Marr, 1995 *J. Med. Chem*. 38, 2023–2037). Ribozymes can be designed to cleave specific RNA targets within the background of cellular RNA. Such a cleavage event renders the RNA non-functional and abrogates protein expression from that RNA. In this manner, synthesis of a protein associated with a disease state can be selectively inhibited.

Target Sites

Targets for useful ribozymes and antisense nucleic acids can be determined as disclosed in Draper et al., WO 93/23569; Sullivan et al., WO 93/23057; Thompson et al., WO 94/02595; Draper et al., WO 95/04818; McSwiggen et al., U.S. Pat. No. 5,525,468, and hereby incorporated by reference herein in totality. Other examples include the following PCT applications which concern inactivation of expression of disease-related genes: WO 95/23225, WO 95/13380, WO 94/02595, incorporated by reference herein. Rather than repeat the guidance provided in those documents here, below are provided specific examples of such methods, not limiting to those in the art. Ribozymes to such targets are designed as described in those applications and synthesized to be tested in vitro and in vivo, as also described.The sequence of human and mouse flt-1, KDR and/or flk-1 mRNAs were screened for optimal ribozyme target sites using a computer folding algorithm. Hammerhead, hairpin, NCH, or G-Cleaver ribozyme cleavage sites were identified. These sites are shown in Tables II to XVII (all sequences are 5' to 3' in the tables; X can be any base-paired sequence, the actual sequence is not relevant here). The nucleotide base position is noted in the Tables as that site to be cleaved by the designated type of ribozyme. While mouse and human sequences can be screened and ribozymes thereafter designed, the human targeted sequences are of most utility. However, as discussed in Stinchcomb et al., WO 95/23225, mouse targeted ribozymes may be useful to test efficacy of action of the ribozyme prior to testing in humans. The nucleotide base position is noted in the Tables as that site to be cleaved by the designated type of ribozyme.

Hammerhead or hairpin ribozymes were designed that could bind and cleave target RNA in a sequence-specific manner. The ribozymes were individually analyzed by computer folding jaeger et al., 1989 *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core were eliminated from consideration. Varying binding arm lengths can be chosen to optimize activity.

Referring to FIG. 6, mRNA is screened for accessible cleavage sites by the method described generally in Draper et al., PCT WO93/23569, hereby incorporated by reference herein. Briefly, DNA oligonucleotides complementary to potential hammerhead or hairpin ribozyme cleavage sites were synthesized. A polymerase chain reaction is used to generate substrates for T7 RNA polymerase transcription from human and mouse flt-1, KDR and/or flk-1 cDNA clones. Labeled RNA transcripts are synthesized in vitro from the templates. The oligonucleotides and the labeled transcripts were annealed, RNAseH was added and the mixtures were incubated for the designated times at 37° C. Reactions are stopped and RNA separated on sequencing polyacrylamide gels. The percentage of the substrate cleaved is determined by autoradiographic quantitation using a PhosphorImaging system. From these data, antisense oligonucleotides, and ribozymes, such as hammerhead or hairpin ribozyme sites are chosen as the most accessible.

Ribozymes of the hammerhead or hairpin motif were designed to anneal to various sites in the mRNA message. The binding arms are complementary to the target site sequences described above. The ribozymes were chemically synthesized. The method of synthesis used follows the procedure for normal RNA synthesis as described below and in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small refers to nucleic acid motifs no more than 100 nucleotides in length, preferably no more than 80 nucleotides in length, and most preferably no more than 50 nucleotides in length; e.g., antisense oligonucleotides, hammerhead or the hairpin ribozymes) are preferably used for exogenous delivery. The simple structure of these molecules increases the ability of the nucleic acid to invade targeted regions of RNA structure. Exemplary molecules of the instant invention were chemically synthesized, and others can similarly be synthesized. Oligodeoxyribonucleotides were synthesized using standard protocols as described in Caruthers et al., 1992*, Methods in Enzymology* 211,3–19, and is incorporated herein by reference.

The method of synthesis used for normal RNA including certain enzymatic nucleic acid molecules follows the procedure as described in Usman et al., 1987 *J. Am. Chem. Soc.,* 109, 7845; Scaringe et al., 1990 *Nucleic Acids Res.*, 18, 5433; and Wincott et al., 1995 *Nucleic Acids Res.* 23, 2677–2684 and makes use of common nucleic acid protecting and coupling groups, such as dimethoxytrityl at the 5'-end, and phosphoramidites at the 3'-end. In a non-limiting example, small scale syntheses were conducted on a 394 Applied Biosystems, Inc. synthesizer using a 0.2 μmol scale protocol with a 7.75 min coupling step for alkylsilyl protected nucleotides and a 2.5 min coupling step for 2'-O-methylated nucleotides. Table II outlines the amounts and the contact times of the reagents used in the synthesis cycle. Alternatively, syntheses at the 0.2 μmol scale can be done on a 96-well plate synthesizer, such as the instrument produced by Protogene (Palo Alto, Calif.) with minimal modification to the cycle. A 15-fold excess (31 μL of 0.1 M=3.1 μmol) of phosphoramidite and a 38.7-fold excess of S-ethyl tetrazole (31 μL of 0.25 M=7.75 μmol) relative to polymer-bound 5'-hydroxyl was used in each coupling cycle. Average coupling yields on the 394 Applied Biosystems, Inc. synthesizer, determined by colorimetric quantitation of the trityl fractions, were 97.5–99%. Other oligonucleotide synthesis reagents for the 394 Applied Biosystems, Inc. synthesizer; detritylation solution was 3% TCA in methylene chloride (ABI); capping was performed with 16% N-methyl imidazole in THF (ABI) and 10% acetic anhydride/10% 2,6-lutidine in THF (ABI); oxidation solution was 16.9 mM $I_2$, 49 mM pyridine, 9% water in THF (PERSEPTIVE™). Burdick & Jackson Synthesis Grade acetonitrile was used directly from the reagent bottle. S-Ethyltetrazole solution (0.25 M in acetonitrile) was made up from the solid obtained from American International Chemical, Inc.

Deprotection of the RNA was performed using either a two-pot or one-pot protocol. For the two-pot protocol, the polymer-bound trityl-on oligoribonucleotide was transferred to a 4 mL glass screw top vial and suspended in a solution of 40% aq. methylamine (1 mL) at 65° C. for 10 min. After cooling to −20° C., the supernatant was removed from the polymer support. The support was washed three times with 1.0 mL of EtOH:MeCN:H2O/3:1:1, vortexed and the supernatant was then added to the first supernatant. The combined supernatants, containing the oligoribonucleotide, were dried to a white powder. The base deprotected oligoribonucleotide was resuspended in anhydrous TEA/HF/NMP solution (300 μL of a solution of 1.5 mL N-methylpyrrolidinone, 750 μL TEA and 1 mL TEA·3HF to provide a 1.4 M HF concentration) and heated to 65° C. After 1.5 h, the oligomer was quenched with 1.5 M $NH_4HCO_3$.

Alternatively, for the one-pot protocol, the polymer-bound trityl-on oligoribonucleotide was transferred to a 4 mL glass screw top vial and suspended in a solution of 33% ethanolic methylamine/DMSO:1/1 (0.8 mL) at 65° C. for 15 min. The vial was brought to r.t. TEA·3HF (0.1 mL) was added and the vial was heated at 65° C. for 15 min. The sample was cooled at −20° C. and then quenched with 1.5 M $NH_4HCO_3$.

For purification of the trityl-on oligomers, the quenched $NH_4HCO_3$ solution was loaded onto a C-18 containing cartridge that had been prewashed with acetonitrile followed by 50 mM TEAA. After washing the loaded cartridge with water, the RNA was detritylated with 0.5% TFA for 13 min. The cartridge was then washed again with water, salt exchanged with 1 M NaCl and washed with water again. The oligonucleotide was then eluted with 30% acetonitrile.

Inactive hammerhead ribozymes or binding attenuated control (BAC) oligonucleotides) were synthesized by substituting a U for G5 and a U for A14 (numbering from Hertel, K. J., et al., 1992*, Nucleic Acids Res*., 20, 3252).

The average stepwise coupling yields were >98% (Wincott et al., 1995 *Nucleic Acids Res.* 23, 2677–2684). Those of ordinary skill in the art will recognize that the scale of synthesis can be adapted to be larger or smaller than the example described above including but not limited to 96 well format, all that is important is the ratio of chemicals used in the reaction.

Alternatively, the nucleic acid molecules of the present invention can be synthesized separately and joined together by ligation (Moore et al., 1992, *Science* 256, 9923; Draper et al., International PCT publication No. WO 93/23569; Shabarova et al., 1991*, Nucleic Acids Research* 19, 4247)

Ribozymes are modified extensively to enhance stability by modification with nuclease resistant groups, for example, 2'-amino, 2'-C-allyl, 2'-flouro, 2'-O-methyl, 2'-H (for a review see Usman and Cedergren, 1992 *TIBS* 17, 34; Usman et al., 1994 *Nucleic Acids Symp.* Ser. 31, 163). Ribozymes are purified by gel electrophoresis using general methods or are purified by high pressure liquid chromatography (HPLC; See Wincott et al., Supra, the totality of which is hereby incorporated herein by reference) and are resuspended in water.

The sequences of the ribozymes that are chemically synthesized, useful in this study, are shown in Tables II to XVII. Those in the art will recognize that these sequences are representative only of many more such sequences where the enzymatic portion of the ribozyme (all but the binding arms) is altered to affect activity. Stem-loop IV sequence of hairpin ribozymes listed in, for example, Table III (5'-CACGUUGUG-3') can be altered (substitution, deletion, and/or insertion) to contain any sequence, provided a minimum of two base-paired stem structure can form. Preferably, no more than 200 bases are inserted at these locations. The sequences listed in Tables II to XVII may be formed of ribonucleotides or other nucleotides or non-nucleotides. Such ribozymes with enzymatic activity are equivalent to the ribozymes described specifically in the Tables.

Optimizing Activity of the Nucleic Acid Molecule of the Invention.

Ribozyme activity can be optimized as described by Stinchcomb et al., supra. The details will not be repeated here, but include altering the length of the ribozyme binding arms (stems I and III, see FIG. 2*c*), or chemically synthesizing ribozymes with modifications that prevent their degradation by serum ribonucleases (see e.g., Eckstein et al., International Publication No. WO 92/07065; Perrault et al., 1990 *Nature* 344, 565; Pieken et al., 1991 *Science* 253, 314; Usman and Cedergren, 1992 Trends in *Biochem. Sci.* 17, 334; Usman et al., International Publication No. WO 93/15187; Rossi et al., International Publication No. WO 91/03162; Beigelman et al., 1995 *J. Biol Chem.* in press; as well as Sproat, U.S. Pat. No. 5,334,711 which describe various chemical modifications that can be made to the sugar moieties of enzymatic RNA molecules). Modifications which enhance their efficacy in cells, and removal of stem II bases to shorten RNA synthesis times and reduce chemical requirements are desired. (All these publications are hereby incorporated by reference herein).

There are several examples in the art describing sugar, base and phosphate modifications that can be introduced into enzymatic nucleic acid molecules without significantly effecting catalysis and with significant enhancement in their nuclease stability and efficacy. Ribozymes are modified to enhance stability and/or enhance catalytic activity by modification with nuclease resistant groups, for example, 2'-amino, 2'-C-allyl, 2'-fluoro, 2'-O-methyl, 2'-H, nucleotide base modifications (for a review see Usman and Cedergren, 1992 TIBS 17, 34; Usman et al., 1994 *Nucleic Acids Symp.* Ser. 31, 163; Burgin et al., 1996 *Biochemistry* 35, 14090). Sugar modification of enzymatic nucleic acid molecules have been extensively described in the art (see Eckstein et al., International Publication PCT No. WO 92/07065; Perrault et al. *Nature* 1990, 344, 565–568; Pieken et al. *Science* 1991, 253, 314–317; Usman and Cedergren, Trends in *Biochem. Sci.* 1992, 17, 334–339; Usman et al. International Publication PCT No. WO 93/15187; Sproat, U.S. Pat. No. 5,334,711 and Beigelman et al., 1995 *J. Biol. Chem.* 270, 25702; all of the references are hereby incorporated in their totality by reference herein). Such publications describe general methods and strategies to determine the location of incorporation of sugar, base and/or phosphate modifications and the like into ribozymes without inhibiting catalysis, and are incorporated by reference herein. In view of such teachings, similar modifications can be used as described herein to modify the nucleic acid catalysts of the instant invention.

Nucleic acid catalysts having chemical modifications which maintain or enhance enzymatic activity are provided. Such nucleic acid is also generally more resistant to nucleases than unmodified nucleic acid. Thus, in a cell and/or in vivo the activity may not be significantly lowered. As exemplified herein such ribozymes are useful in a cell and/or in vivo even if activity over all is reduced 10 fold (Burgin et al., 1996, *Biochemistry*, 35, 14090). Such ribozymes herein are said to "maintain" the enzymatic activity of an all RNA ribozyme.

Therapeutic nucleic acid molecules (e.g., enzymatic nucleic acid molecules and antisense nucleic acid molecules) delivered exogenously must optimally be stable within cells until translation of the target RNA has been inhibited long enough to reduce the levels of the undesirable protein. This period of time varies between hours to days depending upon the disease state. Clearly, these nucleic acid molecules must be resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

By "enhanced enzymatic activity" is meant to include activity measured in cells and/or in vivo where the activity is a reflection of both catalytic activity and ribozyme stability. In this invention, the product of these properties is increased or not significantly (less that 10 fold) decreased in vivo compared to an all RNA ribozyme.

In yet another preferred embodiment, nucleic acid catalysts having chemical modifications which maintain or enhance enzymatic activity is provided. Such nucleic acid is also generally more resistant to nucleases than unmodified nucleic acid. Thus, in a cell and/or in vivo the activity may not be significantly lowered. As exemplified herein such ribozymes are useful in a cell and/or in vivo even if activity over all is reduced 10 fold (Burgin et al., 1996*, Biochemistry,* 35, 14090). Such ribozymes herein are said to "maintain" the enzymatic activity on all RNA ribozyme.

In another aspect the nucleic acid molecules comprise a 5' and/or a 3'-cap structure.

By "cap structure" is meant chemical modifications, which have been incorporated at the terminus of the oligonucleotide (see for example Wincott et al., WO 97/26270, incorporated by reference herein). These terminal modifications protect the nucleic acid molecule from exonuclease degradation, and may help in delivery and/or localization within a cell. The cap may be present at the 5'-terminus (5'-cap) or at the 3'-terminus (3'-cap) or may be present on both terminus. In non-limiting examples: the 5'-cap is selected from the group comprising inverted abasic residue (moiety), 4',5'-methylene nucleotide; 1-(beta-D-erythrofuranosyl) nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety (for more details see Beigelman et al., International PCT publication No. WO 97/26270, incorporated by reference herein). In yet another preferred embodiment the 3'-cap is selected from a group comprising, 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moeity; 5'-5'-inverted abasic moeity; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moeities (for more details see Beaucage and lyer, 1993, Tetrahedron 49, 1925; incorporated by reference herein). By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine.

By "nucleotide" as used herein is as recognized in the art to include natural bases (standard), and modified bases well known in the art. Such bases are generally located at the 1' position of a sugar moiety. A nucleotide generally comprises a base, sugar and a phosphate group. The nucleotide may also be abasic, i.e., lacking a base. The nucleotides can be unmodified or modified at the sugar, phosphate and/or base moiety, (also referred to interchangeably as nucleotide analogs, modified nucleotides, non-natural nucleotides, non-standard nucleotides and other; see for example, Usman and McSwiggen, supra; Eckstein et al., International PCT Publication No. WO 92/07065; Usman et al., International PCT Publication No. WO 93/15187; all hereby incorporated by reference herein). Several examples of modified nucleic acid bases are known in the art and has recently been summarized by Limbach et al., 1994*, Nucleic Acids Res.* 22, 2183. Some of the non-limiting examples of base modifications that can be introduced into enzymatic nucleic acids without significantly effecting their catalytic activity include, inosine, purine, pyridin-4-one, pyridin-2-one, phenyl, pseudouracil, 2, 4, 6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine) and others (Burgin et al., 1996*, Biochemistry*, 35, 14090). By "modified bases" in this aspect is meant nucleotide bases other than adenine, guanine, cytosine and uracil at 1' position or their equivalents; such bases may be used within the catalytic core of the enzyme and/or in the substrate-binding regions.

By "abasic" is meant sugar moieties lacking a base or having other chemical groups in place of a base at the 1' position.

By "unmodified nucleoside" is meant one of the bases adenine, cytosine, guanine, uracil joined to the 1' carbon of β-D-ribo-furanose.

By "modified nucleoside" is meant any nucleotide base which contains a modification in the chemical structure of an unmodified nucleotide base, sugar and/or phosphate.

In connection with 2'-modified nucleotides as described for the present invention, by "amino" is meant 2'-$NH_2$ or 2'-O- $NH_2$, which may be modified or unmodified. Such modified groups are described, for example, in Eckstein et al., U.S. Pat. No. 5,672,695 and Matulic-Adamic et al., WO 98/28317, respectively, which are both incorporated by reference in their entireties.

Various modifications to nucleic acid (e.g., antisense and ribozyme) structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Use of these molecules will lead to better treatment of the disease progression by affording the possibility of combination therapies (e.g., multiple ribozymes targeted to different genes, ribozymes coupled with known small molecule inhibitors, or intermittent treatment with combinations of ribozymes (including different ribozyme motifs) and/or other chemical or biological molecules). The treatment of patients with nucleic acid molecules may also include combinations of different types of nucleic acid molecules. Therapies may be devised which include a mixture of ribozymes (including different ribozyme motifs), antisense and/or 2-5A chimera molecules to one or more targets to alleviate symptoms of a disease.

Administration of Nucleic Acid Molecules

Sullivan, et al., supra, describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Sullivan et al., supra and Draper et al., supra which have been incorporated by reference herein.

Methods for the delivery of nucleic acid molecules is described in Akhtar et al., 1992*, Trends Cell Bio*., 2, 139; and *Delivery Strategies for Antisense Oligonucleotide Therapeutics*, ed. Akhtar, 1995 which are both incorporated herein by reference. Sullivan et al., PCT WO 94/02595, further describes the general methods for delivery of enzymatic RNA molecules . These protocols may be utilized for the delivery of virtually any nucleic acid molecule. Nucleic acid molecules may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, nucleic acid molecules may be directly delivered ex vivo to cells or tissues with or without the aforementioned vehicles. Alternatively, the nucleic acid/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of nucleic acid delivery and administration are provided in Sullivan et al., supra and Draper et al., PCT WO93/23569 which have been incorporated by reference herein.

The molecules of the instant invention can be used as pharmaceutical agents. Pharmaceutical agents prevent, inhibit the occurrence, or treat (alleviate a symptom to some extent, preferably all of the symptoms) of a disease state in a patient.

The negatively charged polynucleotides of the invention can be administered (e.g., RNA, DNA or protein) and introduced into a patient by any standard means, with or without stabilizers, buffers, and the like, to form a pharmaceutical composition. When it is desired to use a liposome delivery mechanism, standard protocols for formation of liposomes can be followed. The compositions of the present invention may also be formulated and used as tablets, capsules or elixirs for oral administration; suppositories for rectal administration; sterile solutions; suspensions for injectable administration; and the like.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic administration, into a cell or patient, preferably a human. Suitable forms, in part, depend upon the use or the route of entry, for example oral, transdermal, or by injection. Such forms should not prevent the composition or formulation to reach a target cell (i.e., a cell to which the negatively charged polymer is desired to be delivered to). For example, pharmacological compositions injected into the blood stream should be soluble. Other factors are known in the art, and include considerations such as toxicity and forms which prevent the composition or formulation from exerting its effect.

By "systemic administration" is meant in vivo systemic absorption or accumulation of drugs in the blood stream followed by distribution throughout the entire body. Administration routes which lead to systemic absorption include, without limitations: intravenous, subcutaneous, intraperitoneal, inhalation, oral, intrapulmonary and intramuscular. Each of these administration routes expose the desired negatively charged polymers, e.g., nucleic acids, to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation which can facilitate the association of drug with the surface of cells, such as, lymphocytes and macrophages is also useful. This approach may provide enhanced delivery of the drug to target cells by taking advantage of the specificity of macrophage and lymphocyte immune recognition of abnormal cells, such as the cancer cells.

The invention also features the use of a composition comprising surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev*. 1995, 95, 2601–2627; Ishiwata et al., *Chem. Pharm. Bull*. 1995, 43, 1005–101 1). Such liposomes have been shown to accumulate selectively in tumors, presumably by extravasation and capture in the neovascularized target tissues (Lasic et al., *Science* 1995, 267, 1275–1276; Oku et al., 1995*, Biochim. Biophys*. Acta, 1238, 86–90). Long-circulating liposomes enhance the pharmacokinetics and pharmacodynamics of DNA and RNA, particularly compared to conventional cationic liposomes which are known to accumulate in tissues of the MPS (Liu et al., *J. Biol. Chem*. 1995, 42, 24864–24870; Choi et al., International PCT Publication No. WO 96/10391; Ansell et al., International PCT Publication No. WO 96/10390; Holland et al., International PCT Publication No. WO 96/10392; all of these are incorporated by reference herein). Long-circulating liposomes are also likely to protect drugs from nuclease degradation to a greater extent compared to cationic liposomes, based on their ability to avoid accumulation in metabolically aggressive MPS tissues such as the liver and spleen. All of these references are incorporated by reference herein.

The present invention also includes compositions prepared for storage or administration which include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985) hereby incorporated by reference herein. For example, preservatives, stabilizers, dyes and flavoring agents may be provided. Id. at 1449. These include sodium benzoate, sorbic acid and esters of p-hydroxybenzoic acid. In addition, antioxidants and suspending agents may be used. Id.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors which those skilled in the medical arts will recognize. Generally, an amount between 0.1 mg/kg and 100 mg/kg body weight/day of active ingredients is administered dependent upon potency of the negatively charged polymer.

The nucleic acid molecules of the present invention may also be administered to a patient in combination with other therapeutic compounds to increase the overall therapeutic effect. The use of multiple compounds to treat an indication may increase the beneficial effects while reducing the presence of side effects.

Another means of accumulating high concentrations of a nucleic acid molecule of the invention (e.g., ribozyme) within cells is to incorporate the ribozyme-encoding sequences into a DNA or RNA expression vector. Transcription of the ribozyme sequences are driven from a promoter for eukaryotic RNA polymerase I (pol I), RNA polymerase II (pol II ), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990 *Proc. Natl. Acad. Sci. U S A*, 87, 6743–7; Gao and Huang 1993 *Nucleic Acids Res*., 21, 2867–72; Lieber et al., 1993 *Methods Enzymol*., 217, 47–66; Zhou et al., 1990 *Mol. Cell. Biol*., 10, 4529–37; Thompson et al., 1995 supra). Several investigators have demonstrated that ribozymes or antisese expressed from such promoters can function in mammalian cells (e.g. Izant and Weintraub, 1985 *Science* 229, 345; McGarry and Lindquist, 1986 *Proc. Natl. Acad. Sci. USA* 83, 399; Kashani-Sabet et al., 1992 *Antisense Res. Dev*., 2, 3–15; Ojwang et al., 1992 *Proc. Natl. Acad. Sci. U S A*, 89, 10802–6; Chen et al., 1992 *Nucleic Acids Res*., 20, 4581–9; Yu et al., 1993 *Proc. Natl. Acad. Sci. U S A*, 90, 6340–4; L'Huillier et al., 1992 *EMBO J*. 11,4411–8; Lisziewicz et al., 1993 *Proc*. 237/198 *Natl. Acad. Sci. U. S. A*., 90, 80004; Thompson et al., 1995 *Nucleic Acids Res*. 23, 2259). The above ribozyme transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors).

In a preferred embodiment of the invention, a transcription unit expressing a ribozyme that cleaves RNAs that encode flt-1, KDR and/or flk-1 are inserted into a plasmid DNA vector or an adenovirus or adeno-associated virus DNA viral vector or a retroviral RNA vector. Viral vectors have been used to transfer genes and lead to either transient or long term gene expression (Zabner et al., 1993 *Cell* 75, 207; Carter, 1992 *Curr. Opi. Biotech*. 3, 533). The adenovirus, AAV or retroviral vector is delivered as recombinant viral particles. The DNA may be delivered alone or complexed with vehicles (as described for RNA above). The recombinant adenovirus or AAV or retroviral particles are locally administered to the site of treatment, e.g. through incubation or inhalation in vivo or by direct application to cells or tissues ex vivo. Retroviral vectors have also been used to express ribozymes in mammalian cells (Ojwang et al., 1992 supra; Thompson et al., 1995 supra).

flt-1, KDR and/or flk-1 are attractive nucleic acid-based therapeutic targets by several criteria. The interaction between VEGF and VEGF-R is well-established. Efficacy can be tested in well-defined and predictive animal models. Finally, the disease conditions are serious and current therapies are inadequate. Whereas protein-based therapies would inhibit VEGF activity nucleic acid-based therapy provides a direct and elegant approach to directly modulate flt-1, KDR and/or flk-1 expression.

Because flt-1 and KDR mRNAs are highly homologous in certain regions, some ribozyme target sites are also homologous (see Table X). In this case, a single ribozyme will target both flt-1 and KDR mRNAs. At partially homologous sites, a single ribozyme can sometimes be designed to accommodate a site on both mRNAs by including G/U base pairing. For example, if there is a G present in a ribozyme target site in KDR mRNA at the same position there is an A in the flt-1 ribozyme target site, the ribozyme can be synthesized with a U at the complementary position and it will bind both to sites. The advantage of one ribozyme that targets both VEGF-R mRNAs is clear, especially in cases where both VEGF receptors may contribute to the progression of angiogenesis in the disease state. "Angiogenesis" refers to formation of new blood vessels which is an essential process in reproduction, development and wound repair. "Tumor angiogenesis" refers to the induction of the growth of blood vessels from surrounding tissue into a solid tumor. Tumor growth and tumor metastasis are dependent on angiogenesis (for a review see Folkman, 1985 supra; Folkman 1990 *J. Natl. Cancer Inst*., 82, 4; Folkman and Shing, 1992 *J. Biol. Chem*. 267, 10931).

Angiogenesis plays an important role in other diseases such as arthritis wherein new blood vessels have been shown to invade the joints and degrade cartilage (Folkman and Shing, supra). "Retinopathy" refers to inflammation of the retina and/or degenerative condition of the retina which may lead to occlusion of the retina and eventual blindness. In "diabetic retinopathy" angiogenesis causes the capillaries in the retina to invade the vitreous resulting in bleeding and blindness which is also seen in neonatal retinopathy (for a review see Folkman, 1985 supra; Folkman 1990 supra; Folkman and Shing, 1992 supra).

EXAMPLE 1 flt-1, KDR and/or flk-1 Ribozymes

By engineering ribozyme motifs applicant has designed several ribozymes directed against flt-1, KDR and/or flk-1 encoded mRNA sequences. These ribozymes were synthesized with modifications that improve their nuclease resistance (Beigelman et al., 1995 *J. Biol. Chem*. 270, 25702) and enhance their activity in cells. The ability of ribozymes to cleave target sequences in vitro was evaluated essentially as described in Thompson et al., PCT Publication No. WO 93/23057; Draper et al., PCT Publication No. WO 95/04818.

EXAMPLE 2

Effect of Ribozymes on the Binding of VEGF to flt-1, KDR and/or flk-1 Receptors

Several common human cell lines are available that express endogenous flt-1, KDR and/or flk-1. flt-1, KDR and/or flk-1 which can be detected easily with monoclonal antibodies. Use of appropriate fluorescent reagents and fluorescence-activated cell-sorting (FACS) will permit direct quantitation of surface flt-1, KDR and/or flk-1 on a cell-by-cell basis. Active ribozymes are expected to directly reduce flt-1, KDR and/or flk-1 expression and thereby reduce VEGF binding to the cells. In this example, human umbelical cord microvascular endothelial cells were used.

Cell Preparation

Plates are coated with 1.5% gelatin and allowed to stand for one hour. Cells (e.g., microvascular endothelial cells derived from human umbilical cord vein) are plated at 20,000 cells/well (24 well plate) in 200 $\mu$l growth media and incubated overnight (~1 doubling) to yield ~40,000 cells (75–80% confluent).

Ribozyme Treatment

Media is removed from cells and the cells are washed two times with 300 $\mu$l 1×PBS: $Ca^{2+}$: $Mg^{2+}$ mixture. A complex of 200–500 nM ribozyme and LipofectAMINE® (3:1 lipid:phosphate ratio) in 200 $\mu$l OptiMEM® (5% FBS) was added to the cells. The cells are incubated for 6 hr (equivalent to 2–3 VEGF-R turnovers).

$^{125}$I VEGF binding assay:

The assay is carried out on ice to inhibit internalization of VEGF during the experiment. The media containing the ribozyme is removed from the cells and the cells are washed twice with 300 $\mu$l 1×PBS: $Ca^{2+}$: $Mg^{2+}$ mixture containing 1% BSA. Appropriate $^{125}$I VEGF solution (100,000 cpm/well, +/−10×) cold 1×PBS, 1% BSA) was applied to the cells. The cells are incubated on ice for 1 h. $^{125}$I VEGF-containing solution is removed and the cells are washed three times with 300 $\mu$l 1×PBS: $Ca^{2+}$: $Mg^{2+}$ mixture containing 1% BSA. To each well 300 $\mu$l of 100 mM Tris-HCl, pH 8.0, 0.5% Triton X-100 was added and the mixture was incubated for 2 min. The $^{125}$I VEGF-binding was quantitated using standard scintillation counting techniques. Percent inhibition was calculated as follows:

Percent Inhibition= cpm $^{1251}$I VEGF Bound by the Ribozyme-treated Samples X100 cpm $^{125}$I VEGF Bound by the Control Sample

EXAMPLE 3

Effect of Hammerhead Ribozymes Targeted Against flt-1 Receptor on the Binding of VEGF Hammerhead ribozymes targeted to twenty sites within flt-1 RNA were synthesized as described above. The sequences of the ribozymes used are shown in Table II; the length of the stem 11 region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, 3' end of the ribozyme contains a 3'-3' linked inverted abasic ribose.

Referring to FIG. 7, the effect of hammerhead ribozymes targeted against flt-1 receptor on the binding of VEGF to flt-1 on the surface of human microvascular endothelial cells is shown. The majority of the ribozymes tested were able to inhibit the expression of flt-1 and thereby were able to inhibit the binding of VEGF.

In order to determine the specificity of ribozymes targeted against flt-1 RNA, the effect of five anti-flt-1 ribozymes on the binding of VEGF, UPA (urokinase plasminogen activator) and FGF (fibroblast growth factor) to their corresponding receptors were assayed. As shown in FIG. 9, there was significant inhibition of VEGF binding to its receptors on cells treated with anti-flt-1 ribozymes. There was no specific inhibition of the binding of UPA and FGF to their corresponding receptors. These data strongly suggest that anti-flt-1 ribozymes specifically cleave flt-1 RNA and not RNAs encoding the receptors for UPA and FGF, resulting in the inhibition of flt-1 receptor expression on the surface of the cells. Thus the ribozymes are responsible for the inhibition of VEGF binding but not the binding of UPA and FGF.

EXAMPLE 4

Effect of Hammerhead Ribozymes Targeted Against KDR Receptor on the Binding of VEGF Hammerhead ribozymes targeted to twenty-one sites within KDR RNA were synthesized as described above. The sequences of the ribozymes used are shown in Table IV; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose.

Referring to FIG. 8, the effect of hammerhead ribozymes targeted against KDR receptor on the binding of VEGF to KDR on the surface of human microvascular endothelial cells is shown. A majority of the ribozymes tested were able to inhibit the expression of KDR and thereby were able to inhibit the binding of VEGF. As a control, the cells were treated with a ribozyme that is not targeted towards KDR RNA (irrel. RZ); there was no specific inhibition of VEGF binding. The results from this control experiment strongly suggest that the inhibition of VEGF binding observed with anti-KDR ribozymes is a ribozyme-mediated inhibition.

EXAMPLE 5

Effect of Ribozymes Targeted Against VEGF Receptors on Cell Proliferation

Cell Preparation:

24-well plates are coated with 1.5% gelatin (porcine skin 300 bloom). After 1 hr, excess gelatin is washed off of the plate. Microvascular endothelial cells are 25 plated at 5,000 cells/well (24 well plate) in 200 $\mu$l growth media. The cells are allowed to grow for ~18 hr (~1 doubling) to yield ~10,000 cells (25–30% confluent).

Ribozyme Treatment:

Media is removed from the cells, and the cells are washed two times with 300 $\mu$l 1×PBS: $Ca^{2+}$: $Mg^{2+}$ mixture.

For anti-flt-1 HH ribozyme experiment (FIG. 12) a complex of 500 nM ribozyme; 15 $\mu$M LFA (3:1 lipid:phosphate ratio) in 200 $\mu$l OptiMEM (5% FCS) media was added to the cells. Incubation of cells is carried out for 6 hr (equivalent to 2–3 VEGF receptor turnovers).

For anti-KDR HH ribozyme experiment (FIG. 13) a complex of 200 nM ribozyme; 5.25 $\mu$M LFA (3:1 lipid:phosphate ratio) in 200 $\mu$l OptiMEM (5% FCS) media was added to the cells. Incubation of cells is carried out for 3 hr.

Proliferation:

After three or six hours, the media is removed from the cells and the cells are washed with 300 μl 1×PBS: $Ca^{2+}$: $Mg^{2+}$ mixture. Maintenance media (contains dialyzed 10% FBS) +/− VEGF or basic FGF at 10 ng/ml is added to the cells. The cells are incubated for 48 or 72 h. The cells are trypsinized and counted (Coulter counter). Trypan blue is added on one well of each treatment as a control.

Figure 12B:
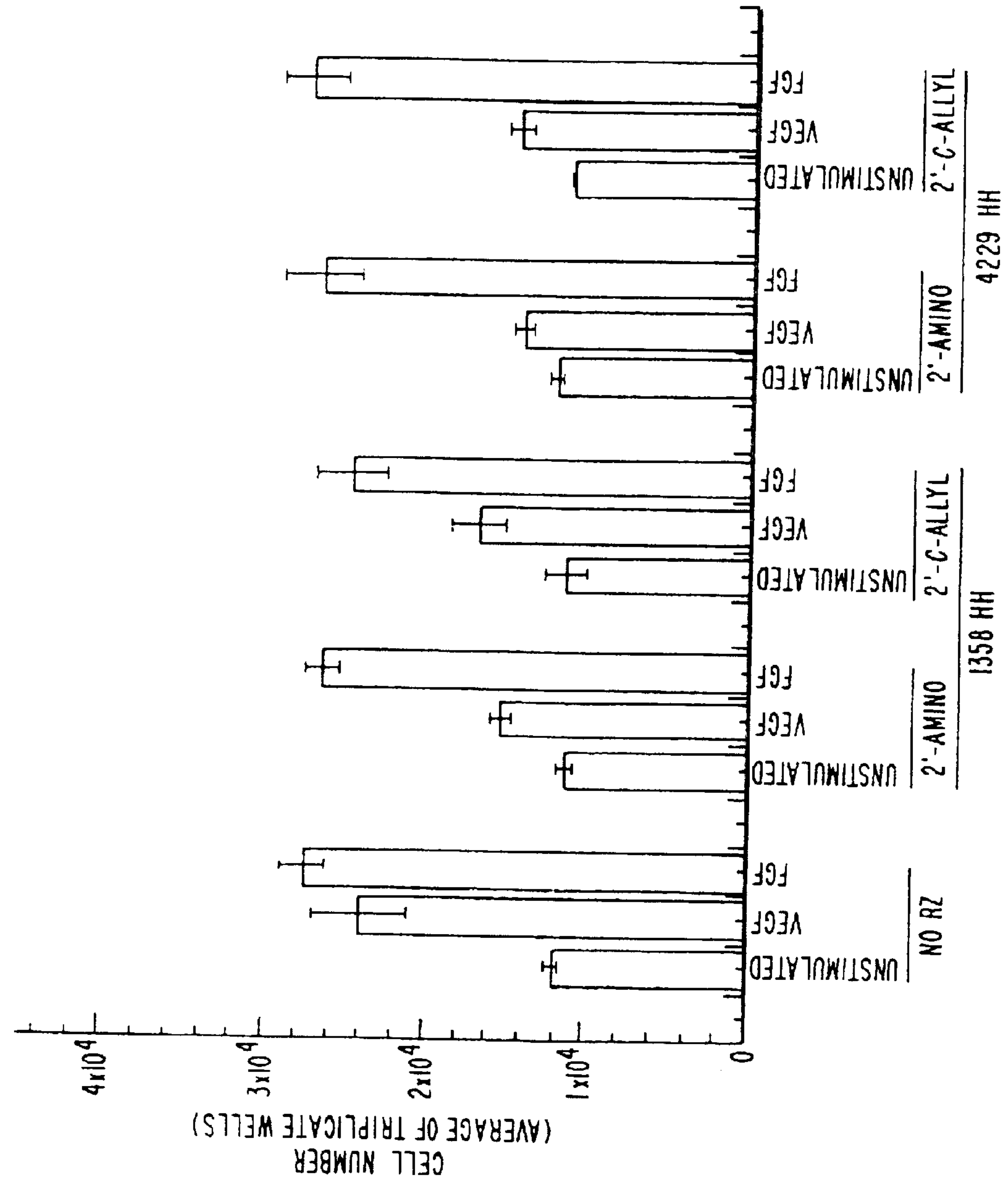

As shown in FIG. 12B, VEGF and basic FGF can stimulate human microvascular endothelial cell proliferation. However, treatment of cells with 1358 HH or 4229 HH ribozymes, targeted against flt-1 mRNA, results in a significant decrease in the ability of VEGF to stimulate endothelial cell proliferation. These ribozymes do not inhibit the FGF-mediated stimulation of endothelial cell proliferation.

Human microvascular endothelial cells were also treated with hammerhead ribozymes targeted against sites 527, 730, 3702 or 3950 within the KDR mRNA. As shown in FIG. 13, all four ribozymes caused significant inhibition of VEGF-mediated induction of cell proliferation. No significant inhibition of cell proliferation was observed when the cells were treated with a hammerhead ribozyme targeted to an irrelevant RNA. Additionally, none of the ribozymes inhibited FGF-mediated stimulation of cell proliferation.

These results strongly suggest that hammerhead ribozymes targeted against either flt-1 or KDR mRNA can specifically inhibit VEGF-mediated induction of endothelial cell proliferation.

EXAMPLE 6

Effect of Antisense Oligonucleotides Targeted Against VEGF Receptors on Cell Proliferation (Colorimetric Assay)

Following are some of the reagents used in the proliferation assay:

Cells: Human aortic endothelial cells (HAEC) from Clonetics®. Cells at early passage are preferably used.

Uptake Medium: EBM (from Clonetics®);1% L-Glutamine;20 mM Hepes;No serum;No antibiotics.

Growth Medium: EGM (from Clonetics®);FBS to 20%;1% L-Glutamine;20 mM Hepes.

Cell Plating: 96-well tissue culture plates are coated with 0.2% gelatin (50 μl/well). The gelatin is incubated in the wells at room temperature for 15–30 minutes. The gelatin is removed by aspiration and the wells are washed with PBS:$Ca^{2+}$: $Mg^{2+}$ mixture. PBS mixture is left in the wells until cells are ready to be added. HAEC cells were detached by trypsin treatment and resuspended at $1.25\times10^4$/ml in growth medium. PBS is removed from plates and 200 μl of cells (i.e. 2.5×103 cells/well) are added to each well. The cells are allowed to grow for 48 hours before the proliferation assay.

Assay: Growth medium is removed from the wells. The cells are washed twice with PBS:$Ca^{2+}$: $Mg^{2+}$ mixture without antibiotics. A formulation of lipidlantisense oligonucleotide (antisense oligonucleotide is used here as a non-limiting example) complex is added to each well (100 μl/well) in uptake medium. The cells are incubated for 2–3 hours at 37° C. in a $CO_2$ incubator. After uptake, 100 μl/well of growth medium is added (gives final FBS concentration of 10%). After approximately 72 hours, 40 μl MTS® stock solution (made as described by manufacturer) was added to each well and incubated at 37° C. for 1–3 hours, depending on the color development. (For this assay, 2 hours was sufficient). The intensity of color formation was determined on a plate reader at 490 nM.

Phosphorothioate-substituted antisense oligodeoxynucleotides were custom synthesized by The Midland Certified Reagent Company®, Midland, Tex. Following non-limiting antisense oligodeoxynucleotides targeted against KDR RNA were used in the proliferation assay: KDR 21 AS: 5'-GCA GCA CCT TGC TCT CCA TCC-3' (Seq ID No. 14208) SCRAMBLED CONTROL: 5'-CTG CCA ACT TCC CAT GCC TGC-3' (Seq ID No. 14209)

As shown in FIG. 10, proliferation of HAEC cells is specifically inhibited by increasing concentrations of the phosphorothioate anti-KDR-antisense oligodeoxynucleotide. The scrambled antisense oligonucleotide is not expected to bind the KDR RNA and therefore is not expected to inhibit KDR expression. As expected, there is no detectable inhibition of proliferation of HAEC cells treated with a phosphorothioate antisense oligonucleotide with scrambled sequence.

EXAMPLE 7

In Vitro Cleavage of flt-1 RNA by Hammerhead Ribozymes

Referring to FIG. 11A, hammerhead ribozymes (HH) targeted against sites 1358 and 4229 within the flt-1 RNA were synthesized as described above.

RNA Cleavage Assay in Vitro:

Substrate RNA was 5' end-labeled using [γ-$^{32}$P] ATP and T4 polynucleotide kinase (US Biochemicals). Cleavage reactions were carried out under ribozyme "excess" conditions. Trace amount (≦1 nM) of 5' end-labeled substrate and 40 nM unlabeled ribozyme were denatured and renatured separately by heating to 90° C. for 2 min and snap-cooling on ice for 10–15 min. The ribozyme and substrate were incubated, separately, at 37° C. for 10 min in a buffer containing 50 mM Tris-HCl and 10 mM $MgCl_2$. The reaction was initiated by mixing the ribozyme and substrate solutions and incubating at 37° C. Aliquots of 5 μl are taken at regular intervals of time and the reaction is quenched by mixing with equal volume of 2× formamide stop mix. The samples are resolved on 20% denaturing polyacrylamide gels. The results were quantified and percentage of target RNA cleaved is plotted as a function of time.

Referring to FIGS. 11B and 11C, hammerhead ribozymes targeted against sites 1358 and 4229 within the flt-1 RNA are capable of cleaving target RNA efficiently in vitro.

EXAMPLE 8

In Vitro Cleavage of KDR RNA by Hammerhead Ribozymes

In this non-limiting example, hammerhead ribozymes targeted against sites 726, 527, 3702 and 3950 within KDR RNA were synthesized as described above. RNA cleavage reactions were carried out in vitro essentially as described under EXAMPLE 7.

Referring to FIGS. 14 and 15, all four ribozymes were able to cleave their cognate target RNA efficiently in a sequence-specific manner.

EXAMPLE 9

In Vitro Cleavage of RNA by Hammerhead Ribozymes Targeted Against Cleavage Sites that are Homologous Between KDR and flt-1 mRNA Because flt-1 and KDR mRNAs are highly homologous in certain regions, some ribozyme target sites are also homologous (see Table X). In this case, a single ribozyme will target both flt-1 and KDR mRNAs. Hammerhead ribozyme (FLT/KDR-I) targeted against one of the homologous sites between flt-1 and KDR (flt-1 site 3388 and KDR site 3151) was synthesized as described above. Ribozymes with either a 3 bp stem II or a 4 bp stem II were synthesized. RNA cleavage reactions were carried out in vitro essentially as described under Example 7.

Referring to FIG. 16, FLT/KDR-I ribozyme with either a 3 or a 4 bp stem II was able to cleave its target RNA efficiently in vitro.

EXAMPLE 10

Effect of Multiple Ribozymes Targeted Against Both flt-1 and KDR RNA on Cell Proliferation Since both flt-1 and KDR receptors of VEGF are involved in angiogenesis, the inhibition of the expression of both of these genes may be an effective approach to inhibit angiogenesis.

Human microvascular endothalial cells were treated with hammerhead ribozymes targeted against sites flt-1 4229 alone, KDR 527 alone, KDR 726 alone, KDR 3950 alone, flt-1 4229+KDR 527, flt-1 4229+KDR 726 or flt-1 4229+KDR 3950. As shown in FIG. 17, all the combinations of active ribozymes (A) caused significant inhibition of VEGF-mediated induction of cell proliferation. No significant inhibition of cell proliferation was observed when the cells were treated with a catalytically inactive (I) hammerhead ribozymes. Additionally, cells treated with ribozymes targeted against both flt-1 and KDR RNAs- flt-1 4229 +KDR 527; flt-1 4229+KDR 726; flt-1 4229+KDR 3950, were able to cause a greater inhibition of VEGF-mediated induction of cell proliferation when compared with individual ribozymes targeted against either flt-1 or KDR RNA (see flt-1 4229 alone; KDR 527 alone; KDR 726 alone; KDR 3950 alone). This strongly suggests that treatment of cells with multiple ribozymes may be a more effective means of inhibition of gene expression.

Animal Models

There are several animal models in which the anti-angiogenesis effect of nucleic acids of the present invention, such as ribozymes, directed against VEGF-R mRNAs can be tested. Typically a corneal model has been used to study angiogenesis in rat and rabbit since recruitment of vessels can easily be followed in this normally avascular tissue (Pandey et al., 1995 *Science* 268: 567–569). In these models, a small Teflon or Hydron disk pretreated with an angiogenesis factor (e.g. bFGF or VEGF) is inserted into a pocket surgically created in the cornea. Angiogenesis is monitored 3 to 5 days later. Ribozymes directed against VEGF-R mRNAs would be delivered in the disk as well, or dropwise to the eye over the time course of the experiment. In another eye model, hypoxia has been shown to cause both increased expression of VEGF and neovascularization in the retina (Pierce et al., 1995 *Proc. Natl. Acad. Sci. USA*. 92: 905–909; Shweiki et al., 1992 *J. Clin. Invest*. 91: 2235–2243).

In human glioblastomas, it has been shown that VEGF is at least partially responsible for tumor angiogenesis (Plate et al., 1992 *Nature* 359, 845). Animal models have been developed in which glioblastoma cells are implanted subcutaneously into nude mice and the progress of tumor growth and angiogenesism is studied (Kim et al., 1993 supra; Millauer et al., 1994 supra).

Another animal model that addresses neovascularization involves Matrigel, an extract of basement membrane that becomes a solid gel when injected subcutaneously (Passaniti et al., 1992 *Lab. Invest*. 67: 519–528). When the Matrigel is supplemented with angiogenesis factors such as VEGF, vessels grow into the Matrigel over a period of 3 to 5 days and angiogenesis can be assessed. Again, ribozymes directed against VEGF-R mRNAs would be delivered in the Matrigel.

Several animal models exist for screening of anti-angiogenic agents. These include corneal vessel formation following corneal injury (Burger et al., 1985 *Cornea* 4: 35–41; Lepri, et al., 1994 *J. Ocular Pharmacol*. 10: 273–280; Ormerod et al., 1990 *Am. J. Pathol*. 137: 1243–1252) or intracorneal growth factor implant (Grant et al., 1993 *Diabetologia* 36: 282–291; Pandey et al. 1995 supra; Zieche et al., 1992 *Lab. Invest*. 67: 711–715), vessel growth into Matrigel matrix containing growth factors (Passaniti et al., 1992 supra), female reproductive organ neovascularization following hormonal manipulation (Shweiki et al., 1993 *Clin. Invest*. 91: 2235–2243), several models involving inhibition of tumor growth in highly vascularized solid tumors (O'Reilly et al., 1994 *Cell* 79: 315–328; Senger et al., 1993 *Cancer and Metas. Rev*. 12: 303–324; Takahasi et al., 1994 *Cancer Res*. 54: 4233–4237; Kim et al., 1993 supra), and transient hypoxia-induced neovascularization in the mouse retina (Pierce et al., 1995 *Proc. Natl. Acad. Sci. USA*. 92: 905–909).

The cornea model, described in Pandey et al. supra, is the most common and well characterized anti-angiogenic agent efficacy screening model. This model involves an avascular tissue into which vessels are recruited by a stimulating agent (growth factor, thermal or alkalai burn, endotoxin). The corneal model would utilize the intrastromal corneal implantation of a Teflon pellet soaked in a VEGF-Hydron solution to recruit blood vessels toward the pellet which can be quantitated using standard microscopic and image analysis techniques. To evaluate their anti-angiogenic efficacy, ribozymes are applied topically to the eye or bound within Hydron on the Teflon pellet itself. This avascular cornea as well as the Matrigel (see below) provide for low background assays. While the corneal model has been performed extensively in the rabbit, studies in the rat have also been conducted.

The mouse model (Passaniti et al., supra) is a non-tissue model which utilizes Matrigel, an extract of basement membrane (Kleinman et al., 1986) or Millipore® filter disk, which can be impregnated with growth factors and anti-angiogenic agents in a liquid form prior to injection. Upon subcutaneous administration at body temperature, the Matrigel or Millipore® filter disk forms a solid implant. VEGF embedded in the Matrigel or Millipore® filter disk would be used to recruit vessels within the matrix of the Matrigel or Millipore® filter disk which can be processed histologically for endothelial cell specific vWF (factor VIII antigen) immunohistochemistry, Trichrome-Masson stain, or hemoglobin content. Like the cornea, the Matrigel or Millipore® filter disk are avascular; however, it is not tissue. In the Matrigel or Millipore® filter disk model, ribozymes are administered within the matrix of the Matrigel or Millipore® filter disk to test their anti-angiogenic efficacy. Thus, delivery issues in this model, as with delivery of ribozymes by Hydron- coated Teflon pellets in the rat cornea model, may be less problematic due to the homogeneous presence of the ribozyme within the respective matrix.

These models offer a distinct advantage over several other angiogenic models listed previously. The ability to use VEGF as a pro-angiogenic stimulus in both models is highly desirable since ribozymes will target only VEGFr mRNA. In other words, the involvement of other non-specific types of stimuli in the cornea and Matrigel models is not advantageous from the standpoint of understanding the pharmacologic mechanism by which the anti-VEGFr mRNA ribozymes produce their effects. In addition, the models will allow for testing the specificity of the anti-VEGFr mRNA ribozymes by using either a- or bFGF as a pro-angiogenic factor. Vessel recruitment using FGF should not be affected in either model by anti-VEGFr mRNA ribozymes. Other models of angiogenesis including vessel formation in the female reproductive system using hormonal manipulation (Shweiki et al., 1993 supra); a variety of vascular solid tumor models which involve indirect correltations with angiogenesis (O'Reilly et al., 1994 supra; Senger et al., 1993 supra; Takahasi et al., 1994 supra; Kim et al., 1993 supra); and retinal neovascularization following transient hypoxia (Pierce et al., 1995 supra) were not selected for efficacy screening due to their non-specific nature, although there is a correlation between VEGF and angiogenesis in these models.

Other model systems to study tumor angiogenesis is reviewed by Folkman, 1985 *Adv. Cancer. Res.* 43, 175.

Use of Murine Models

For a typical systemic study involving 10 mice (20 g each) per dose group, 5 doses (1, 3, 10, 30 and 100 mg/kg daily over 14 days continuous administration), approximately 400 mg of ribozyme, formulated in saline would be used. A similar study in young adult rats (200 g) would require over 4 g. Parallel pharmacokinetic studies may involve the use of similar quantities of ribozymes further justifying the use of murine models. Ribozymes and Lewis lung carcinoma and B-16 melanoma murine models Identifying a common animal model for systemic efficacy testing of ribozymes is an efficient way of screening ribozymes for systemic efficacy.

The Lewis lung carcinoma and B-16 murine melanoma models are well accepted models of primary and metastatic cancer and are used for initial screening of anti-cancer agents. These murine models are not dependent upon the use of immunodeficient mice, are relatively inexpensive, and minimize housing concerns. Both the Lewis lung and B-16 melanoma models involve subcutaneous implantation of approximately $10^6$ tumor cells from metastatically aggressive tumor cell lines (Lewis lung lines 3LL or D122, LLc-LN7; B-16-BL6 melanoma) in C57BL/6J mice. Alternatively, the Lewis lung model can be produced by the surgical implantation of tumor spheres (approximately 0.8 mm in diameter). Metastasis also may be modeled by injecting the tumor cells directly i.v. In the Lewis lung model, microscopic metastases can be observed approximately 14 days following implantation with quantifiable macroscopic metastatic tumors developing within 21–25 days. The B-16 melanoma exhibits a similar time course with tumor neovascularization beginning 4 days following implantation. Since both primary and metastatic tumors exist in these models after 21–25 days in the same animal, multiple measurements can be taken as indices of efficacy. Primary tumor volume and growth latency as well as the number of micro- and macroscopic metastatic lung foci or number of animals exhibiting metastases can be quantitated. The percent increase in lifespan can also be measured. Thus, these models would provide suitable primary efficacy assays for screening systemically administered ribozymes/ribozyme formulations.

In the Lewis lung and B-16 melanoma models, systemic pharmacotherapy with a wide variety of agents usually begins 1–7 days following tumor implantation/inoculation with either continuous or multiple administration regimens. Concurrent pharmacokinetic studies can be performed to determine whether sufficient tissue levels of ribozymes can be achieved for pharmacodynamic effect to be expected. Furthermore, primary tumors and secondary lung metastases can be removed and subjected to a variety of in vitro studies (i.e. target RNA reduction).

flt-1, KDR and/or flk-1 protein levels can be measured clinically or experimentally by FACS analysis. flt-1, KDR and/or flk-1 encoded mRNA levels will be assessed by Northern analysis, RNase-protection, primer extension analysis and/or quantitative RT-PCR. Ribozymes that block flt-1, KDR and/or flk-1 protein encoding mRNAs and therefore result in decreased levels of flt-1, KDR and/or flk-1 activity by more than 20% in vitro will be identified.

Ribozymes and/or genes encoding them are delivered by either free delivery, liposome delivery, cationic lipid delivery, adeno-associated virus vector delivery, adenovirus vector delivery, retrovirus vector delivery or plasmid vector delivery in these animal model experiments (see above).

Patients can be treated by locally administering nucleic acids targeted against VEGF-R by direct injection. Routes of administration may include, but are not limited to, intravascular, intramuscular, subcutaneous, intraarticular, aerosol inhalation, oral (tablet, capsule or pill form), topical, systemic, ocular, intraperitoneal and/or intrathecal delivery.

EXAMPLE 11

Ribozyme-mediated Inhibition of Angiogenesis in vivo

The purpose ot this study was to assess the anti-angiogenic activity of hammerhead ribozymes targeted against flt-1 4229 site in the rat cornea model of VEGF induced angiogenesis (see above). These ribozymes have either active or inactive catalytic core and either bind and cleave or just bind to VEGF-R mRNA of the flt-1 subtype. The active ribozymes, that are able to bind and cleave the target RNA, have been shown to inhibit ($^{125}$1-labeled) VEGF binding in cultured endothelial cells and produce a dose-dependent decrease in VEGF induced endothelial cell proliferation in these cells (see Examples 3–5 above). The catalytically inactive forms of these ribozymes, wherein the ribozymes can only bind to the RNA but cannot catalyze RNA cleavage, fail to show these characteristics. The ribozymes and VEGF were co-delivered using the filter disk method: Nitrocellulose filter disks (Millipore®) of 0.057 diameter were immersed in appropriate solutions and were surgically implanted in rat cornea as described by Pandey et al., supra. This delivery method has been shown to deliver rhodamine-labeled free ribozyme to scleral cells and, in all likelihood cells of the pericorneal vascular plexus. Since the active ribozymes show cell culture efficacy and can be delivered to the target site using the disk method, it is essential that these ribozymes be assessed for in vivo anti-angiogenic activity. The stimulus for angiogenesis in this study was the treatment of the filter disk with 30 $\mu$M VEGF which is implanted within the cornea's stroma. This dose yields reproducible neovascularization stemming from the pericorneal vascular plexus growing toward the disk in a dose-response study 5 days following implant. Filter disks treated only with the vehicle for VEGF show no angiogenic response. The ribozymes was co-adminstered with VEGF on a disk in two different ribozyme concentrations. One concern with the simultaneous administration is that the ribozymes will not be able to inhibit angiogenesis since VEGF receptors can be stimulated. However, we have observed that in low VEGF doses, the neovascular response reverts to normal suggesting that the VEGF stimulus is essential for maintaining the angiogenic response. Blocking the production of VEGF receptors using simultaneous administration of anti-VEGF-R mRNA ribozymes could attenuate the normal neovascularization induced by the filter disk treated with VEGF.

MATERIALS AND METHODS

1. Stock Hammerhead Ribozyme Solutions:
   a. flt-1 4229 (786 μM)—Active
   b. flt-1 4229 (736 μM)—Inactive
2. Experimantal solutions/groups:

| | | |
|---|---|---|
| Group 1 | Solution 1 | Control VEGF solution: 30 μM in 82 μM Tris base |
| Group 2 | Solution 2 | flt-1 4229 (1 μg/μL) in 30 μM VEGF/82 mM Tris base |
| Group 3 | Solution 3 | flt-1 4229 (10 μg/μL) in 30 μM VEGF/82 mM Tris base |
| Group 4 | Solution 4 | No VEGF, flt-1 4229 (10 μg/μL) in 82 mM Tris base |
| Group 5 | Solution 5 | No VEGF, No ribozyme in 82 mM Tris base |

10 eyes per group, 5 animals (Since they have similar molecular weights, the molar concentrations should be essentially similar). Each solution (VEGF and RIBOZYMES) were prepared as a 2× solution for 1:1 mixing for final concentrations above, with the exception of solution 1 in which VEGF was 2× and diluted with ribozyme diluent (sterile water).

3. VEGF Solutions

The 2× VEGF solution (60 μM) was prepared from a stock of 0.82 μg/μL in 50 mM Tris base. 200 μL of VEGF stock was concentrated by speed vac to a final volume of 60.8 μL, for a final concentration of 2.7 μg/μL or 60 μM. Six 10 μL aliquots was prepared for daily mixing. 2X solutions for VEGF and Ribozyme was stored at 4° C. until the day of the surgery. Solutions were mixed for each day of surgery. Original 2X solutions was prepared on the day before the first day of the surgery.

4. Surgical Solutions:

Anesthesia:

stock ketamine hydrochloride 100 mg/mL stock xylazine hydrochloride 20 mg/mL stock acepromazine 10 mg/mL Final anesthesia solution: 50 mg/mL ketamine, 10 mg/mL xylazine, and 0.5 mg/mL acepromazine 5% povidone iodine for opthalmic surgical wash 2% lidocaine (sterile) for opthalmic administration (2 drops per eye) sterile 0.9% NaCl for opthalmic irrigation 5. Surgical Methods:

Standard surgical procedure as described in Pandey et al., supra. Filter disks were incubated in 1 μL of each solution for approximately 30 minutes prior to implantation.

6. Experimental Protocol: The animal cornea were treated with the treatment groups as described above. Animals were allowed to recover for 5 days after treatment with daily observation (scoring 0–3). On the fifth day animals were euthanized and digital images of each eye was obtained for quantitaion using Image Pro Plus. Quantitated neovascular surface area were analyzed by ANOVA followed by two post-hoc tests including Dunnets and Tukey-Kramer tests for significance at the 95% confidence level. Dunnets provide information on the significance between the differences within the means of treatments vs. controls while Tukey-Kramer provide information on the significance of differences within the means of each group.

Results are graphically represented in FIG. 18. As shown in the figure, flt-1 4229 active hammerhead ribozyme at both concentrations was effective at inhibiting angiogenesis while the inactive ribozyme did not show any significant reduction in angiogenesis. A statistically signifiant reduction in neovascular surface area was observed only with active ribozymes. This result clearly shows that the ribozymes are capable of significantly inhibiting angiogenesis in vivo . Specifically, the mechanism of inhibition appears to be by the binding and cleavage of target RNA by ribozymes.

EXAMPLE 12

Bioactivity of Anti-angiogenesis Ribozymes Targeting flt-1 and kdr RNA

MATERIALS AND METHODS

Ribozymes: Hammerhead ribozymes and controls designed to have attenuated activity (attenuated controls) were synthesized and purified as previously described above. The attenuated ribozyme controls maintain the binding arm sequence of the parent ribozyme and thus are still capable of binding to the mRNA target. However, they have two nucleotide changes in the core sequence that substantially reduce their ability to carry out the cleavage reaction. Ribozymes were designed to target Flt-1 or KDR mRNA sites conserved in human, mouse, and rat. In general, ribozymes with binding arms of seven nucleotides were designed and tested. If, however, only six nucleotides surrounding the cleavage site were conserved in all three species, six nucleotide binding arms were used. A subset of ribozyme and attenuated control sequences and modifications are listed in Table XII. Data are presented herein for 2'-$NH_2$ uridine modified ribozymes in cell proliferation studies and for 2'-C-allyl uridine modified ribozymes in RNAse protection, in vitro cleavage and corneal studies.

In vitro ribozyme cleavage assays: In vitro RNA cleavage rates on a 15 nucleotide synthetic RNA substrate were measured as previously described above.

Cell culture: Human dermal microvascular endothelial cells (HMVEC-d, Clonetics Corp.) were maintained at 37° C. in flasks or plates coated with 1.5% porcine skin gelatin (300 bloom, Sigma) in Growth medium (Clonetics Corp.) supplemented with 10–20% fetal bovine serum (FBS, Hyclone). Cells were grown to confluency and used up to the seventh passage. Stimulation medium consisted of 50% Sigma 99 media and 50% RPMI 1640 with L-glutamine and additional supplementation with 10 μg/mL Insulin-Transferrin-Selenium (Gibco BRL) and 10% FBS. Cell growth was stimulated by incubation in Stimulation medium supplemented with 20 ng/mL of either $VEGF_{165}$ or bFGF. $VEGF_{165}$, (165 amino acids) was selected for cell culture and animal studies because it is the predominant form of the four native forms of VEGF generated by alternative mRNA splicing. Cell culture assays were carried out in triplicate.

Ribozyme and Ribozyme/LIPOFECTAMINE™ Formulations

Cell culture: Ribozymes or attenuated controls (50–200 nM) were formulated for cell culture studies and used immediately. Formulations were carried out with LIPOFECTAMINE™ (Gibco BRL) at a 3:1 lipid to phosphate charge ratio in serum-free medium (OPTI-MEM™, Gibco BRL) by mixing for 20 min at room temperature. For example, a 3:1 lipid to phosphate charge ratio was established by complexing 200 nM ribozyme with 10.8 μg/μL LIPOFECTAMINE™ (13.5 μM DOSPA).

In vivo: For corneal studies, lyophilized ribozyme or attenuated controls were resuspended in sterile water at a final stock concentration of 170 μg/μL (highest dose). Lower doses (1.7–50 μ/μL) were prepared by serial dilution in sterile water.

Proliferation assay: HMVEC-d were seeded ($5\times10^3$ cells/well) in 48-well plates (Costar) and incubated 24–30 h in Growth medium at 37° C. After removal of the Growth medium, cells were treated with 50–200 nM LIPOFECTAMINE™ complexes of ribozyme or attenuated controls for 2 h in OPTI-MEM™. The ribozyme/control-containing medium was removed and the cells were washed extensively in 1× PBS. The medium was then replaced with Stimulation medium or Stimulation medium supplemented with 20 ng/mL $VEGF_{165}$ or bFGF. After 48 h, the cell number was determined using a Coulter™ cell counter. Data are presented as cell number per well following 48 h of VEGF stimulation.

RNAse protection assay: HMVEC-d were seeded ($2\times10^5$ cells/well) in 6-well plates (Costar) and allowed to grow 32–36 h in Growth medium at 37° C. Cells were treated with LIPOFECTAMINE™ complexes containing 200 nM ribozyme or attenuated control for 2 h as described under "Proliferation Assay" and then incubated in Growth medium containing 20 ng/mL $VEGF_{165}$ for 24 h. Cells were harvested and an RNAse protection assay was carried out using the Ambion Direct Protect kit and protocol with the exception that 50 mM EDTA was added to the lysis buffer to eliminate the possibility of ribozyme cleavage during sample preparation. Antisense RNA probes targeting portions of Flt-1 and KDR were prepared by transcription in the presence of [$^{32}$P]-UTP. Samples were analyzed on polyacrylamide gels and the level of protected RNA fragments was quantified using a Molecular Dynamics PhosphorImager. The levels of Flt-1 and KDR were normalized to the level of cyclophilin (human cyclophilin probe template, Ambion) in each sample. The coefficient of variation for cyclophilin levels was 11% [265940 cpm±29386 (SD)] for all conditions tested here (i.e. in the presence of either active ribozymes or attenuated controls). Thus, cyclophilin is useful as an internal standard in these studies.

Rat Corneal Pocket Assay of VEGF-induced Angiogenesis

Animal guidelines and anesthesia. Animal housing and experimentation adhered to standards outlined in the 1996 Guide for the Care and Use of Laboratory Animals (National Research Council). Male Sprague Dawley rats (250–300 g) were anesthetized with ketamine (50 mg/kg), xylazine (10 mg/kg), and acepromazine (0.5 mg/kg) administered intramuscularly (im). The level of anesthesia was monitored every 2–3 min by applying hind limb paw pressure and examining for limb withdrawal. Atropine (0.4 mg/kg, im) was also administered to prevent potential corneal reflex-induced bradycardia.

Preparation of VEGF soaked disk. For corneal implantation, 0.57 mm diameter nitrocellulose disks, prepared from 0.45 μm pore diameter nitrocellulose filter membranes (Millipore Corporation), were soaked for 30 min in 1 μL of 30 μM $VEGF_{165}$ in 82 mM Tris-HCl (pH 6.9) in covered petri dishes on ice.

Corneal surgery. The rat corneal model used in this study was a modified from Koch et al. Supra and Pandey et al., supra. Briefly, corneas were irrigated with 0.5% povidone iodine solution followed by normal saline and two drops of 2% lidocaine. Under a dissecting microscope (Leica MZ-6), a stromal pocket was created and a presoaked filter disk (see above) was inserted into the pocket such that its edge was 1 mm from the corneal limbus.

Intraconjunctival injection of test solutions. Immediately after disk insertion, the tip of a 40–50 μm OD injector (constructed in our laboratory) was inserted within the conjunctival tissue 1 mm away from the edge of the corneal limbus that was directly adjacent to the VEGF-soaked filter disk. Six hundred nanoliters of test solution (ribozyme, attenuated control or sterile water vehicle) were dispensed at a rate of 1.2 μL/min using a syringe pump (Kd Scientific). The injector was then removed, serially rinsed in 70% ethanol and sterile water and immersed in sterile water between each injection. Once the test solution was injected, closure of the eyelid was maintained using microaneurism clips until the animal began to recover gross motor activity. Following treatment, animals were warmed on a heating pad at 37° C.

Animal treatment groups/experimental protocol. Ribozymes targeting Flt-1 site 4229 and KDR mRNA site 726 were tested in the corneal model along with their attenuated controls. Five treatment groups were assigned to examine the effects of five doses of each test substance over a dose range of 1–100 μg on VEGF-stimulated angiogenesis. Negative (30 μM VEGF soaked filter disk and intraconjunctival injection of 600 nL sterile water) and no stimulus (Tris-soaked filter disk and intraconjunctival injection of sterile water) control groups were also included. Each group consisted of five animals (10 eyes) receiving the same treatment.

Quantitation of angiogenic response. Five days after disk implantation, animals were euthanized following im administration of 0.4 mg/kg atropine and corneas were digitally imaged. The neovascular surface area (NSA, expressed in pixels) was measured postmortem from blood-filled corneal vessels using computerized morphometry (Image Pro Plus, Media Cybernetics, v2.0). The individual mean NSA was determined in triplicate from three regions of identical size in the area of maximal neovascularization between the filter disk and the limbus. The number of pixels corresponding to the blood-filled corneal vessels in these regions was summated to produce an index of NSA. A group mean NSA was then calculated. Data from each treatment group were normalized to VEGF/ribozyme vehicle-treated control NSA and finally expressed as percent inhibition of VEGF-induced angiogenesis.

Statistics. After determining the normality of treatment group means, group mean percent inhibition of VEGF-induced angiogenesis was subjected to a one-way analysis of variance. This was followed by two post-hoc tests for significance including Dunnett's (comparison to VEGF control) and Tukey-Kramer (all other group mean comparisons) at alpha=0.05. Statistical analyses were performed using JMP v.3.1.6 (SAS Institute).

RESULTS

Figure 19:
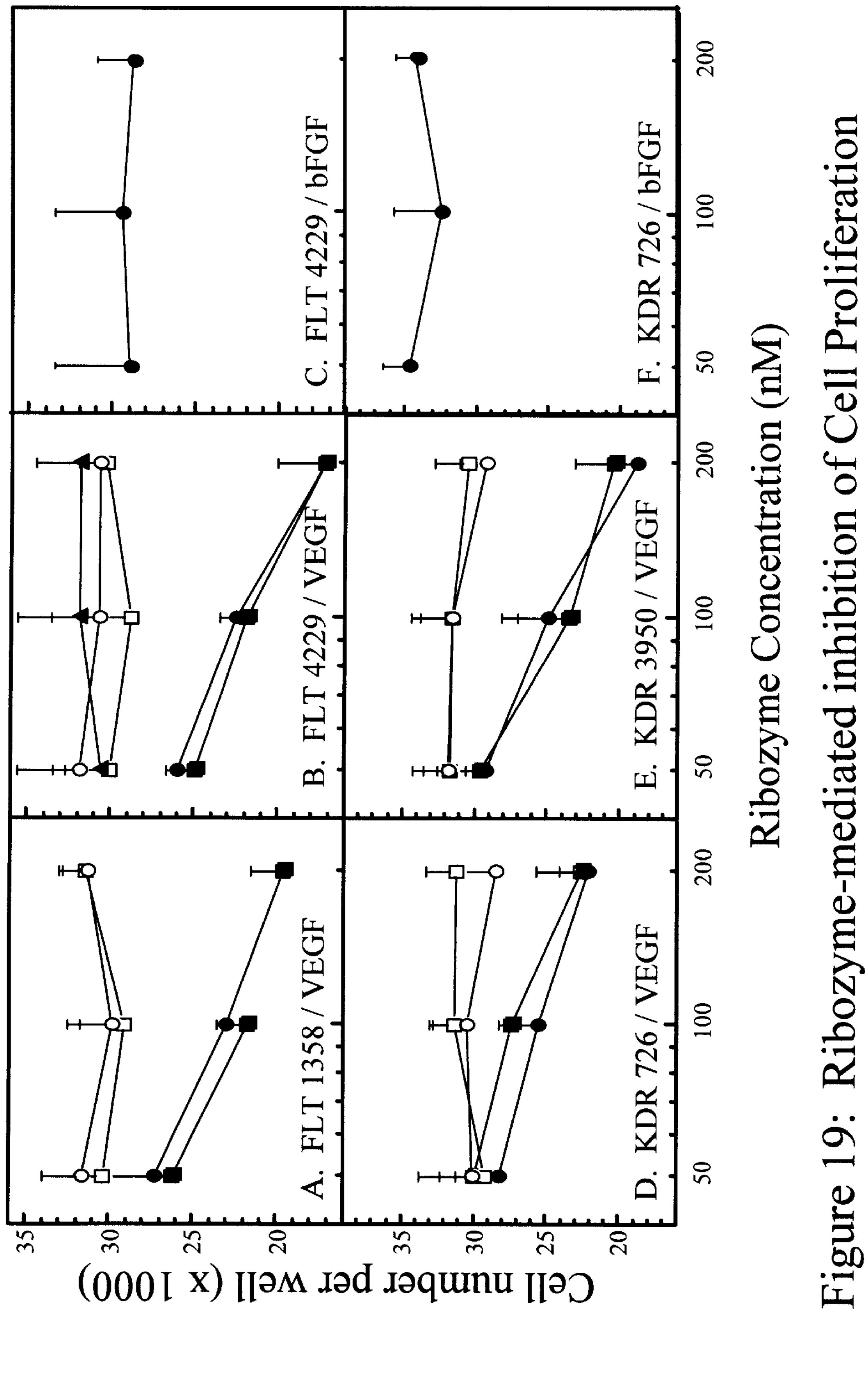

Ribozyme-mediated reduction of VEGF-induced cell proliferation: Ribozyme cleavage of Flt-1 or KDR mRNA should result in a decrease in the density of cell surface VEGF receptors. This decrease should limit VEGF binding and consequently interfere with the mitogenic signaling induced by VEGF. To determine if cell proliferation was impacted by anti-Flt-1 and/or anti-KDR ribozyme treatment, proliferation assays using cultured human microvascular cells were carried out. Ribozymes included in the proliferation assays were initially chosen by their ability to decrease the level of VEGF binding to treated cells (see FIG. 8). In these initial studies, ribozymes targeting 20 sites in the coding region of each mRNA were screened. The most effective ribozymes against two sites in each target (Table XII), Flt-1 sites 1358 and 4229 and KDR sites 726 and 3950, were included in the proliferation assays reported here (FIG. 19). In addition, attenuated analogs of each ribozyme were used as controls (Table XII ). These attenuated controls are still capable of binding to the mRNA target since the binding arm sequence is maintained. However, these controls have two nucleotide changes in the core sequence that substantially reduce their ability to carry out the cleavage reaction.

The antiproliferative effect of active ribozymes targeting two lead sites on each VEGF receptor mRNA is shown in FIG. 19. The active ribozymes tested decreased the relative proliferation of HMVEC-d after VEGF stimulation, an effect that increased with ribozyme concentration. This concentration dependency was not observed following treatment with the attenuated controls designed for these sites. In fact, little or no change in cell growth was noted following treatment with the attenuated controls, even though these controls can still bind to the specific target sequences. At 200 nM, there was a distinct "window" between the anti-proliferative effects of each ribozyme and its attenuated control; a trend also observed at lower doses. This window of inhibition of proliferation (56–77% based on total cells/well) reflects the contribution of ribozyme-mediated activity. In comparison, no effect of anti-Flt-1 or anti-KDR ribozymes was noted on bFGF-stimulated cell proliferation (FIGS. 19C, 19F). Moreover, an irrelevant, but active, ribozyme whose binding sequence is not found in either Flt-1 or KDR mRNA had no effect in this assay (FIG. 19B). These data are consistent with the basic ribozyme mechanism in which binding and cleavage are necessary components. Although the relative surface distribution of Flt-1 and KDR receptors in this cell type is not known, the antiproliferative effects of these ribozymes indicate that, at least in cell culture, both receptors are functionally coupled to proliferation.

Specific reduction of Flt-1 or KDR mRNA by ribozyme treatment: To confirm that anti-Flt-1 and anti-KDR ribozymes reduce their respective mRNA targets, cellular levels of Flt-1 or KDR were quantified using an RNAse protection assay with specific Flt-1 or KDR probes. For each target, one ribozyme/attenuated control pair was chosen for continued study. Data from a representative experiment are shown in FIG. 20. Exposure of HMVEC-d to active ribozyme targeting Flt-1 site 4229 decreased Flt-1 mRNA, but not KDR mRNA. Likewise, treatment with the active ribozyme targeting KDR site 726 decreased KDR, but not Flt-1 mRNA. Both ribozymes decreased the level of their respective target RNA by greater than 50%. The degree of reduction associated with the corresponding attenuated controls was not greater than 13%.

In vitro Activity of Anti-Flt and Anti-KDR Ribozymes.

To confirm further the necessity of an active ribozyme core, in vitro cleavage activities were determined for the Flt-1 site 4229 ribozyme and the KDR site 726 ribozyme as well as their paired attenuated controls. The first order rate constants calculated from the time-course of short substrate cleavage for the anti-Flt-1 ribozyme and its attenuated control were $0.081\pm0.0007$ $min^{-1}$ and $0.001\pm6\times10^{-5}$ $min^{-1}$, respectively. For the anti-KDR ribozyme and its paired control, the first order rate constants were $0.434\pm0.024$ $min^{-1}$ and $0.002\pm1\times10^{-4}$ $min^{-1}$, respectively. Although the attenuated controls retain a very slight level of cleavage activity under these optimized conditions, the decrease in in vitro cleavage activity between each active ribozyme and its paired attenuated control is about two orders of magnitude. Thus, an active core is essential for cleavage activity in vitro and is also necessary for ribozyme activity in cell culture.

Ribozyme-mediated reduction of VEGF-induced angiogenesis in vivo. To assess whether ribozymes targeting VEGF receptor mRNA could impact the complex process of angiogenesis, prototypic anti-Flt-1 and KDR ribozymes that were identified in cell culture studies were screened in a rat corneal pocket assay of VEGF-induced angiogenesis. In this assay, corneas implanted with VEGF-containing filter disks exhibited a robust neovascular response in the corneal region between the disk and the corneal limbus (from which the new vessels emerge). Disks containing a vehicle solution elicited no angiogenic response. In separate studies, intraconjunctival injections of sterile water vehicle did not affect the magnitude of the VEGF-induced angiogenic response. In addition, ribozyme. injections alone did not induce angiogenesis.

The dose-related effects of anti-Flt-1 or KDR ribozymes on the VEGF-induced angiogenic response were then examined. FIGS. 21 and 22 illustrates the quantified antiangiogenic effect of the anti-Flt-1 (site 4229) and KDR (site 726) ribozymes and their attenuated controls over a dose range from 1 to 100 μg, respectively. For both ribozymes, the maximal antiangiogenic response (48 and 36% for anti-Flt-1 and KDR ribozymes, respectively) was observed at a dose of 10 μg.

The anti-Flt-1 ribozyme produced a significantly greater antiangiogenic 30 response than its attenuated control at 3 and 10 μg ($p<0.05$; FIG. 21). Its attenuated control exhibited a small but significant antiangiogenic response at doses above 10 μg compared to vehicle treated VEGF controls ($p<0.05$; FIG. 21). At its maximum, this response was not significantly greater than that observed with the lowest dose of active anti-Flt-1 ribozyme. The anti-KDR ribozyme significantly inhibited angiogenesis from 3 to 30 μg ($p<0.05$; FIG. 22). The anti-KDR attenuated control had no significant effect at any dose tested.

EXAMPLE 13

In vivo Inhibition of Tumor Growth and Metastases by VEGF-R Ribozymes.

A. Lewis Lung Carcinoma Mouse Model: Ribozymes were chemically synthesized as described above. The sequence of ANGIOZYME™ bound to its target RNA is shown in FIG. 26.

The tumors in this study were derived from a cell line (LLC-HM) which gives rise to reproducible numbers of spontaneous lung metastases when propagated in vivo. The LLC-HM line was obtained from Dr. Michael O'Reilly, Harvard University. Tumor neovascularization in Lewis lung carcinoma has been shown to be VEGF-dependent. Tumors from mice bearing LLC-HM (selected for the highly metastatic phenotype by serial propagation) were harvested 20 days post-inoculation. A tumor brei suspension was prepared from these tumors according to standard protocols. On day 0 of the study, $0.5 \times 10^6$ viable LLC-HM tumor cells were injected subcutaneously (sc) into the dorsum or flank of previously untreated mice (100 $\mu$L injectate). Tumors were allowed to grow for a period of 3 days prior to initiating continuous intravenous administration of saline or 30 mg/kg/d ANGIOZYME™ via Alzet mini-pumps. One set of animals was dosed from days 3 to 17, inclusive. Tumor length and width measurements and volumes were calculated according to the formula: Volume=0.5(length)(width)$^2$. At post-inoculation day 25, animals were euthanized and lungs harvested. The number of lung macrometastatic nodules was counted. It should be noted that metastatic foci were quantified 8 days after the cessation of dosing. Ribozyme solutions were prepared to deliver to another set of animals 100, 10, 3, or 1 mg/kg/day of ANGIOZYME™ via Alzet mini-pumps. A total of 10 animals per dose or saline control group were surgically implanted on the left flank with osmotic mini-pumps pre-filled with the respective test solution three days following tumor inoculation. Pumps were attached to indwelling jugular vein catheters.

FIG. 27 shows the antitumor effects of ANGIOZYME™. There is a statistically significant inhibition ($p<0.05$) of primary LLC-HM tumor growth in tumors grown in the flank regions compared to saline control. ANGIOZYME™ significantly reduced ($p<0.05$) the number of lung metastatic foci in animals inoculated either in the flank regions. FIG. 28 illustrates the dose-dependent anti-metastatic effect of ANGIOZYME™ compared to saline control.

B. Mouse Colorectal Cancer Model. KM12L4a-16 is a human colorectal cancer cell line. On day 0 of the study, 0.5×106 KM12L4a-16 cells were implanted into the spleen of nude mice. Three days after tumor inoculation, Alzet minipumps were implanted and continuous subcutaneous delivery of either saline or 12, 36 or 100 mg/kg/day of ANGIOZYME™ was initiated. On day 5, the spleens containing the primary tumors were removed. On day 18, the Alzet minipumps were replaced with fresh pumps so that delivery of saline or ANGIOZYME™ was continuous over a 28 day period from day 3 to day 32. Animals were euthanized on day 41 and the liver tumor burden was evaluated.

Following treatment with 100 mg/kg/day of ANGIOZYME™, there was a significant reduction in the incidence and median number of liver metastasis (FIGS. 29 and 30). In saline-treated animals, the median number of metastases was 101. However, at the high dose of ANGIOZYME™ (100 mg/kg/day), the median number of metastases was zero.

EXAMPLE 14

Effect of ANGIOZYME™ Alone or in Combination with Chemotherapeutic Agents in the Mouse Lewis Lung Carcinoma Model Methods Tumor inoculations. Male C57BL6 mice, age 6 to 8 weeks, were inoculated subcutaneously in the flank with $5 \times 10^5$ LLC-HM cells from brei preparations made from tumors grown in mice.

Ribozymes and controls. The ribozyme and controls tested in this study are given in Table XIII. RPI.4610, also known as ANGIOZYME™, is an anti-Flt-1 ribozyme that targets site 4229 in the human Flt-1 receptor mRNA (EMBL accession no. X51602). The controls tested include RPI.13141, an attenuated version of RPI.4610 in which four nucleotides in the catalytic core are changed so that the cleavage activity is dramatically decreased. RPI.13141, however, maintains the base composition and binding arms of RPI.4610 and so is still capable of binding to the target site. The second control (RPI.13030) also has changes to the catalytic core (three) to inhibit cleavage activity, but in addition the sequence of the binding arms has been scrambled so that it can no longer bind to the target sequence. One nucleotide in the arm of RPI.13030 is also changed to maintain the same base composition as RPI.4610.

Ribozyme administrations. Ribozymes and controls were resuspended in normal saline. Administration was initiated seven days following tumor inoculation. Animals either received a daily subcutaneous injection (30 mg/kg test substance) from day 7 to day 20 or were instrumented with an Alzet osmotic minipump (12 $\mu$/day flow rate) containing a solution of ribozyme or control. Subcutaneous infusion pumps delivered the test substances (30 mg/kg/day) from day 7 to 20 (14-day pumps, 420 mg/kg total test substance) or days 7–34 (28-day pumps, 840 mg/kg total test substance). Where indicated, chemotherapeutic agents were given in combination with ribozyme treatment. Cyclophosphamide was given by ip administration on days 7, 9 and 11 (125 mg/kg). Gemcitabine was given by ip administration on days 8, 11 and 14 (125 mg/kg). Untreated, uninstrumented animals were used as comparison. Five animals were included in each group.

Results

The antiangiogenic ribozyme, ANGIOZYME™, was tested in a model of Lewis lung carcinoma alone and in combination with two chemotherapeutic agents. Previously (see above), 30 mg/kg/day ANGIOZYME™ alone was determined to inhibit both primary tumor growth and lung metastases in a highly metastatic variant of Lewis lung (continuous 14-day iv deliveryvia Alzet minipump, manuscript in preparation).

In this study, 30 mg/kg/day ANGIOZYME™ delivered either as a daily sc bolus injection or as a continuous infusion from an Alzet minipump resulted in a delay in tumor growth (FIG. 23). On average, tumor growth to 500 mm$^3$ was delayed by ~7 days in animals being treated with ANGIOZYME™ compared to an untreated group. Growth of tumors in animals being treated with either of two attenuated controls was delayed by only ~2 days. ANGIOZYME™ delivered by sc bolus was also tested in combination with either Gemcytabine or cyclophosphamide (Fig, 24). Tumor growth delay increased by about 3 days in the presence of combination therapy with ANGIOZYME™ and Gemcytabine over the effects of either treatment alone. The combination of ANGIOZYME™ and cyclophosphamide did not increase tumor growth delay over that of cyclophosphamide alone, however, suboptimal doses of cyclophosphamide were not included in this study. Neither of the attenuated controls increased the effect of the chemotherapeutic agents.

The effect of ANGIOZYME™ on metastases to the lung was also determined in the presence and absence of additional chemotherapeutic treatment. Macrometastases to the lungs were counted in two animals in each treatment group on day 20. Data for the daily sc administration of 30 mg/kg ANGIOZYME™ alone or with Gemcytabine or cyclophosphamide is given in FIG. 25. In the presence of ANGIOZYME™, with or without a chemotherapeutic agent, the lung metastases were reduced to zero. Treatment with either Gemcytabine or cyclophosphamide alone (mean number of metastases 4.5 and 4, respectively) were not as effective as ANGIOZYME™ alone or when used in combination with ANGIOZYME™. Neither of the attenuated controls increased the effect of the chemotherapeutic agents.

The effect on metastases to the lung was also determined following continuous treatment with ANGIOZYME™. At day 20, an average of ~8 macrometastases were noted in the treatment groups which had been instrumented with Alzet minipumps (either 14- or 28-day pumps). This is a decrease in metastases of ~50% from the untreated group. Since ANGIOZYME™ delivered by a daily sc bolus resulted in zero metastases (FIG. 4) in the two animals counted, it is possible that the additional burden of being instrumented with the minipump contributes to a slightly decreased response to ANGIOZYME™.

Gemcytabine and cyclophosphamide are non-limiting examples of chemotherapeutic agents that can be combined with or used in conjunction with the nucleic acid molecules (e.g. ribozymes and antisense molecules) of the instant invention. Those skilled in the art will recognize that other anti-angiogenic and/or anti-cancer compounds and therapies can be similarly be readily combined with the nucleic acid molecules of the instant invention (e.g. ribozymes and antisense molecules) are are hence within the scope of the instant invention. Such compounds and therapies are well known in the art (see for example *Cancer: Principles and Pranctice of Oncology*, Volumes 1 and 2, eds Devita, V. T., Hellman, S., and Rosenberg, S. A., J. B. Lippincott Company, Philadelphia, USA; incorporated herein by reference) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; I-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tomaxifen; radiation therapy; surgery; nutritional supplements; gene therapy; radiotherapy such as 3D-CRT; immunotoxin therapy such as ricin, monoclonal antibodies herceptin; and the like.

Indications

1) Tumor angiogenesis: Angiogenesis has been shown to be necessary for tumors to grow into pathological size (Folkman, 1971, *PNAS* 76, 5217–5221; Wellstein & Czubayko, 1996, *Breast Cancer Res and Treatment* 38, 109–119). In addition, it allows tumor cells to travel through the circulatory system during metastasis. Increased levels of gene expression of a number of angiogenic factors such as vascular endothelial growth factor (VEGF) have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362,841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576).

2) Ocular diseases: Neovascularization has been shown to cause or exacerbate ocular diseases including but not limited to, macular degeneration, neovascular glaucoma, diabetic retinopathy, myopic degeneration, and trachoma (Norrby, 1997, *APMIS* 105, 417437). Aiello et al., 1994 *New Engl. J. Med.* 331, 1480, showed that the ocular fluid, of a majority of patients suffering from diabetic retinopathy and other retinal disorders, contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases. Other factors including those that stimulate VEGF synthesis may also contribute to these indications.

3) Dermatological Disorders: Many indications have been identified which may by angiogenesis dependent including but not limited to psoriasis, verruca vulgaris, angiofibroma of tuberous sclerosis, pot-wine stains, Sturge Weber syndrome, Kippel-Trenaunay-Weber syndrome, and Osler-Weber-Rendu syndrome (Norrby, supra). Intradermal injection of the angiogenic factor b-FGF demonstrated angiogenesis in nude mice (Weckbecker et al., 1992, *Angiogenesis: Key principles-Science-Technology-Medicine*, ed R. Steiner) Detmar et al., 1994 *J. Exp. Med.* 180, 1141 reported that VEGF and its receptors were over-expressed in psoriatic skin and psoriatic dermal microvessels, suggesting that VEGF plays a significant role in psoriasis.

4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis. Other angiogenic factors including those of -the present invention may also be involved in arthritis.

Diagnostic Uses

The nucleic acid molecules of this invention (e.g., ribozymes) may be used as diagnostic tools to examine genetic drift and mutations within diseased cells or to detect the presence of flt-1, KDR and/or flk-1 RNA in a cell. The close relationship between ribozyme activity and the structure of the target RNA allows the detection of mutations in any region of the molecule which alters the base-pairing and three-dimensional structure of the target RNA. By using multiple ribozymes described in this invention, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These experiments will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes of this invention are well known in the art, and include detection of the presence of mRNAs associated with flt-1, KDR and/or flk-1 related condition. Such RNA is detected by determining the presence of a cleavage product after treatment with a ribozyme using standard methodology.

In a specific example, ribozymes which can cleave only wild-type or mutant forms of the target RNA are used for the assay. The first ribozyme is used to identify wild-type RNA present in the sample and the second ribozyme will be used to identify mutant RNA in the sample. As reaction controls, synthetic substrates of both wild-type and mutant RNA will be cleaved by both ribozymes to demonstrate the relative ribozyme efficiencies in the reactions and the absence of cleavage of the "non-targeted" RNA species. The cleavage products from the synthetic substrates will also serve to generate size markers for the analysis of wild-type and mutant RNAs in the sample population. Thus each analysis will require two ribozymes, two substrates and one unknown sample which will be combined into six reactions. The presence of cleavage products will be determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., flt-1, KDR and/or flk-1) is adequate to establish risk. If probes of comparable, specific activity are used for both transcripts, then a qualitative comparison of RNA levels will be adequate and will decrease the cost of the initial diagnosis. Higher mutant form to wild-type ratios will be correlated with higher risk whether RNA levels are compared qualitatively or quantitatively.

Additional Uses

Potential usefulness of sequence-specific enzymatic nucleic acid molecules of the instant invention might have many of the same applications for the study of RNA that DNA restriction endonucleases have for the study of DNA (Nathans et al., 1975 *Ann. Rev. Biochem.* 44:273). For example, the pattern of restriction fragments could be used to establish sequence relationships between two related RNAs, and large RNAs could be specifically cleaved to fragments of a size more useful for study. The ability to engineer sequence specificity of the enzymatic nucleic acid molecule is ideal for cleavage of RNAs of unknown sequence. Applicant describes the use of nucleic acid molecules to down-regulate gene expression of target genes in bacterial, microbial, fungal, viral, and eukaryotic systems including plant, or mammalian cells.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications may be made to the invention disclosed herein without departing from the scope and spirit of the invention. Thus, such additional embodiments are within the scope of the present invention and the following claims.

The invention illustratively described herein suitably may be practiced in the absence of any element or elements, limitation or limitations which is not specifically disclosed herein. Thus, for example, in each instance herein any of the terms "comprising", "consisting essentially of" and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

RECEIVED
AUG 23 2001
TECH CENTER 1600/2900

71

OIPE JC48
AUG 15 2001
PATENT & TRADEMARK OFFICE

RECEIVED
AUG 24 2001
TECH CENTER 1600/2900

TABLE I

Characteristics of Ribozymes

Group I Introns
Size: ~200 to >1000 nucleotides.
Requires a U in the target sequence immediately 5' of the cleavage site.
Binds 4-6 nucleotides at 5' side of cleavage site.
Over 75 known members of this class. Found in *Tetrahymena thermophila* rRNA, fungal mitochondria, chloroplasts, phage T4, blue-green algae, and others.

RNAseP RNA (M1 RNA)
Size: ~290 to 400 nucleotides.
RNA portion of a ribonucleoprotein enzyme. Cleaves tRNA precursors to form mature tRNA.
Roughly 10 known members of this group all are bacterial in origin.

Hammerhead Ribozyme
Size: ~13 to 40 nucleotides.
Requires the target sequence UH immediately 5' of the cleavage site.
Binds a variable number of nucleotides on both sides of the cleavage site.
14 known members of this class. Found in a number of plant pathogens (virusoids) that use RNA as the infectious agent (Figure 1 and 2)

Hairpin Ribozyme
Size: ~50 nucleotides.
Requires the target sequence GUC immediately 3' of the cleavage site.
Binds 4-6 nucleotides at 5' side of the cleavage site and a variable number to the 3' side of the cleavage site.
Only 3 known member of this class. Found in three plant pathogen (satellite RNAs of the tobacco ringspot virus, arabis mosaic virus and chicory yellow mottle virus) which uses RNA as the infectious agent (Figure 3).

Hepatitis Delta Virus (HDV) Ribozyme
Size: 50 - 60 nucleotides (at present).
Sequence requirements not fully determined.
Binding sites and structural requirements not fully determined, although no sequences 5' of cleavage site are required.
Only 1 known member of this class. Found in human HDV (Figure 4).

***Neurospora* VS RNA Ribozyme**

Size: ~144 nucleotides (at present)

72

72

Cleavage of target RNAs recently demonstrated.
Sequence requirements not fully determined.
Binding sites and structural requirements not fully determined. Only 1 known member of this class. Found in *Neurospora* VS RNA (Figure 5).

**Table II: Human *flt*1 VEGF Receptor-Hammerhead Ribozyme and Substrate Sequence** 237.198

| nt. Position | HH Ribozyme | Rz Seq ID No. | Substrate | Seq ID No. |
|---|---|---|---|---|
| 10 | GCCGAGAG CUGAUGA GCCGUUAGGC GAA AGUGUCCG | 7143 | CGGACACUC CUCUCGGC | 1 |
| 13 | GGAGCCGA CUGAUGA GCCGUUAGGC GAA AGGAGUGU | 7144 | ACACUCCUC UCGGCUCC | 2 |
| 15 | GAGGAGCC CUGAUGA GCCGUUAGGC GAA AGAGGAGU | 7145 | ACUCCUCUC GGCUCCUC | 3 |
| 20 | CCGGGGAG CUGAUGA GCCGUUAGGC GAA AGCCGAGA | 7146 | UCUCGGCUC CUCCCCGG | 4 |
| 23 | CUGCCGGG CUGAUGA GCCGUUAGGC GAA AGGAGCCG | 7147 | CGGCUCCUC CCCGGCAG | 5 |
| 43 | CCCGCUCC CUGAUGA GCCGUUAGGC GAA AGCCGCCG | 7148 | CGGCGGCUC GGAGCGGG | 6 |
| 54 | GAGCCCCG CUGAUGA GCCGUUAGGC GAA AGCCCGCU | 7149 | AGCGGGCUC CGGGGCUC | 7 |
| 62 | CUGCACCC CUGAUGA GCCGUUAGGC GAA AGCCCCGG | 7150 | CCGGGGCUC GGGUGCAG | 8 |
| 97 | CCCCGGGU CUGAUGA GCCGUUAGGC GAA AUCCUCGC | 7151 | GCGAGGAUU ACCCGGGG | 9 |
| 98 | UCCCCGGG CUGAUGA GCCGUUAGGC GAA AAUCCUCG | 7152 | CGAGGAUUA CCCGGGGA | 10 |
| 113 | CAGGAGAC CUGAUGA GCCGUUAGGC GAA ACCACUUC | 7153 | GAAGUGGUU GUCUCCUG | 11 |
| 116 | AGCCAGGA CUGAUGA GCCGUUAGGC GAA ACAACCAC | 7154 | GUGGUUGUC UCCUGGCU | 12 |
| 118 | CCAGCCAG CUGAUGA GCCGUUAGGC GAA AGACAACC | 7155 | GGUUGUCUC CUGGCUGG | 13 |
| 145 | CGCGCCCU CUGAUGA GCCGUUAGGC GAA AGCGCCCG | 7156 | CGGGCGCUC AGGGCGCG | 14 |
| 185 | GGCCGCCA CUGAUGA GCCGUUAGGC GAA AGUCCGUC | 7157 | GACGGACUC UGGCGGCC | 15 |
| 198 | CGGCCAAC CUGAUGA GCCGUUAGGC GAA ACCCGGCC | 7158 | GGCCGGGUC GUUGGCCG | 16 |
| 201 | CCCCGGCC CUGAUGA GCCGUUAGGC GAA ACGACCCG | 7159 | CGGGUCGUU GGCCGGGG | 17 |
| 240 | GUGAGCGC CUGAUGA GCCGUUAGGC GAA ACGCGGCC | 7160 | GGCCGCGUC GCGCUCAC | 18 |
| 246 | ACCAUGGU CUGAUGA GCCGUUAGGC GAA AGCGCGAC | 7161 | GUCGCGCUC ACCAUGGU | 19 |
| 255 | CAGUAGCU CUGAUGA GCCGUUAGGC GAA ACCAUGGU | 7162 | ACCAUGGUC AGCUACUG | 20 |
| 260 | UGUCCCAG CUGAUGA GCCGUUAGGC GAA AGCUGACC | 7163 | GGUCAGCUA CUGGGACA | 21 |
| 276 | CACAGCAG CUGAUGA GCCGUUAGGC GAA ACCCCGGU | 7164 | ACCGGGGUC CUGCUGUG | 22 |
| 294 | AGACAGCU CUGAUGA GCCGUUAGGC GAA AGCAGCGC | 7165 | GCGCUGCUC AGCUGUCU | 23 |
| 301 | GAGAAGCA CUGAUGA GCCGUUAGGC GAA ACAGCUGA | 7166 | UCAGCUGUC UGCUUCUC | 24 |
| 306 | CCUGUGAG CUGAUGA GCCGUUAGGC GAA AGCAGACA | 7167 | UGUCUGCUU CUCACAGG | 25 |
| 307 | UCCUGUGA CUGAUGA GCCGUUAGGC GAA AAGCAGAC | 7168 | GUCUGCUUC UCACAGGA | 26 |
| 309 | GAUCCUGU CUGAUGA GCCGUUAGGC GAA AGAAGCAG | 7169 | CUGCUUCUC ACAGGAUC | 27 |
| 317 | CUGAACUA CUGAUGA GCCGUUAGGC GAA AUCCUGUG | 7170 | CACAGGAUC UAGUUCAG | 28 |
| 319 | ACCUGAAC CUGAUGA GCCGUUAGGC GAA AGAUCCUG | 7171 | CAGGAUCUA GUUCAGGU | 29 |

| | | | | |
|---|---|---|---|---|
| 322 | UGAACCUG CUGAUGA GCCGUUAGGC GAA ACUAGAUC | 7172 | GAUCUAGUU CAGGUUCA | 30 |
| 323 | UUGAACCU CUGAUGA GCCGUUAGGC GAA AACUAGAU | 7173 | AUCUAGUUC AGGUUCAA | 31 |
| 328 | UAAUUUUG CUGAUGA GCCGUUAGGC GAA ACCUGAAC | 7174 | GUUCAGGUU CAAAAUUA | 32 |
| 329 | UUAAUUUU CUGAUGA GCCGUUAGGC GAA AACCUGAA | 7175 | UUCAGGUUC AAAAUUAA | 33 |
| 335 | GAUCUUUU CUGAUGA GCCGUUAGGC GAA AUUUUGAA | 7176 | UUCAAAAUU AAAAGAUC | 34 |
| 336 | GGAUCUUU CUGAUGA GCCGUUAGGC GAA AAUUUUGA | 7177 | UCAAAAUUA AAAGAUCC | 35 |
| 343 | CAGUUCAG CUGAUGA GCCGUUAGGC GAA AUCUUUUA | 7178 | UAAAAGAUC CUGAACUG | 36 |
| 355 | GCCUUUUA CUGAUGA GCCGUUAGGC GAA ACUCAGUU | 7179 | AACUGAGUU UAAAAGGC | 37 |
| 356 | UGCCUUUU CUGAUGA GCCGUUAGGC GAA AACUCAGU | 7180 | ACUGAGUUU AAAAGGCA | 38 |
| 357 | GUGCCUUU CUGAUGA GCCGUUAGGC GAA AAACUCAG | 7181 | CUGAGUUUA AAAGGCAC | 39 |
| 375 | GCUUGCAU CUGAUGA GCCGUUAGGC GAA AUGUGCUG | 7182 | CAGCACAUC AUGCAAGC | 40 |
| 400 | GCAUUGGA CUGAUGA GCCGUUAGGC GAA AUGCAGUG | 7183 | CACUGCAUC UCCAAUGC | 41 |
| 402 | CUGCAUUG CUGAUGA GCCGUUAGGC GAA AGAUGCAG | 7184 | CUGCAUCUC CAAUGCAG | 42 |
| 427 | AGACCAUU CUGAUGA GCCGUUAGGC GAA AUGGGCUG | 7185 | CAGCCCAUA AAUGGUCU | 43 |
| 434 | CAGGCAAA CUGAUGA GCCGUUAGGC GAA ACCAUUUA | 7186 | UAAAUGGUC UUUGCCUG | 44 |
| 436 | UUCAGGCA CUGAUGA GCCGUUAGGC GAA AGACCAUU | 7187 | AAUGGUCUU UGCCUGAA | 45 |
| 437 | UUUCAGGC CUGAUGA GCCGUUAGGC GAA AAGACCAU | 7188 | AUGGUCUUU GCCUGAAA | 46 |
| 454 | GCUUUCCU CUGAUGA GCCGUUAGGC GAA ACUCACCA | 7189 | UGGUGAGUA AGGAAAGC | 47 |
| 477 | GAUUUAGU CUGAUGA GCCGUUAGGC GAA AUGCUCAG | 7190 | CUGAGCAUA ACUAAAUC | 48 |
| 481 | GGCAGAUU CUGAUGA GCCGUUAGGC GAA AGUUAUGC | 7191 | GCAUAACUA AAUCUGCC | 49 |
| 485 | CACAGGCA CUGAUGA GCCGUUAGGC GAA AUUUAGUU | 7192 | AACUAAAUC UGCCUGUG | 50 |
| 512 | UACUGCAG CUGAUGA GCCGUUAGGC GAA AUUGUUUG | 7193 | CAAACAAUU CUGCAGUA | 51 |
| 513 | GUACUGCA CUGAUGA GCCGUUAGGC GAA AAUUGUUU | 7194 | AAACAAUUC UGCAGUAC | 52 |
| 520 | GGUUAAAG CUGAUGA GCCGUUAGGC GAA ACUGCAGA | 7195 | UCUGCAGUA CUUUAACC | 53 |
| 523 | CAAGGUUA CUGAUGA GCCGUUAGGC GAA AGUACUGC | 7196 | GCAGUACUU UAACCUUG | 54 |
| 524 | UCAAGGUU CUGAUGA GCCGUUAGGC GAA AAGUACUG | 7197 | CAGUACUUU AACCUUGA | 55 |
| 525 | UUCAAGGU CUGAUGA GCCGUUAGGC GAA AAAGUACU | 7198 | AGUACUUUA ACCUUGAA | 56 |
| 530 | CUGUGUUC CUGAUGA GCCGUUAGGC GAA AGGUUAAA | 7199 | UUUAACCUU GAACACAG | 57 |
| 541 | GUUUGCUU CUGAUGA GCCGUUAGGC GAA AGCUGUGU | 7200 | ACACAGCUC AAGCAAAC | 58 |
| 560 | AGCUGUAG CUGAUGA GCCGUUAGGC GAA AGCCAGUG | 7201 | CACUGGCUU CUACAGCU | 59 |
| 561 | CAGCUGUA CUGAUGA GCCGUUAGGC GAA AAGCCAGU | 7202 | ACUGGCUUC UACAGCUG | 60 |
| 563 | UGCAGCUG CUGAUGA GCCGUUAGGC GAA AGAAGCCA | 7203 | UGGCUUCUA CAGCUGCA | 61 |
| 575 | CAGCUAGA CUGAUGA GCCGUUAGGC GAA AUUUGCAG | 7204 | CUGCAAAUA UCUAGCUG | 62 |

| | | | | |
|---|---|---|---|---|
| 577 | UACAGCUA CUGAUGA GCCGUUAGGC GAA AUAUUUGC | 7205 | GCAAAUAUC UAGCUGUA | 63 |
| 579 | GGUACAGC CUGAUGA GCCGUUAGGC GAA AGAUAUUU | 7206 | AAAUAUCUA GCUGUACC | 64 |
| 585 | GAAGUAGG CUGAUGA GCCGUUAGGC GAA ACAGCUAG | 7207 | CUAGCUGUA CCUACUUC | 65 |
| 589 | CUUUGAAG CUGAUGA GCCGUUAGGC GAA AGGUACAG | 7208 | CUGUACCUA CUUCAAAG | 66 |
| 592 | CUUCUUUG CUGAUGA GCCGUUAGGC GAA AGUAGGUA | 7209 | UACCUACUU CAAAGAAG | 67 |
| 593 | UCUUCUUU CUGAUGA GCCGUUAGGC GAA AAGUAGGU | 7210 | ACCUACUUC AAAGAAGA | 68 |
| 614 | AGAUUGCA CUGAUGA GCCGUUAGGC GAA AUUCUGUU | 7211 | AACAGAAUC UGCAAUCU | 69 |
| 621 | AAUAUAUA CUGAUGA GCCGUUAGGC GAA AUUGCAGA | 7212 | UCUGCAAUC UAUAUAUU | 70 |
| 623 | UAAAUAUA CUGAUGA GCCGUUAGGC GAA AGAUUGCA | 7213 | UGCAAUCUA UAUAUUUA | 71 |
| 625 | AAUAAAUA CUGAUGA GCCGUUAGGC GAA AUAGAUUG | 7214 | CAAUCUAUA UAUUUAUU | 72 |
| 627 | CUAAUAAA CUGAUGA GCCGUUAGGC GAA AUAUAGAU | 7215 | AUCUAUAUA UUUAUUAG | 73 |
| 629 | CACUAAUA CUGAUGA GCCGUUAGGC GAA AUAUAUAG | 7216 | CUAUAUAUU UAUUAGUG | 74 |
| 630 | UCACUAAU CUGAUGA GCCGUUAGGC GAA AAUAUAUA | 7217 | UAUAUAUUU AUUAGUGA | 75 |
| 631 | AUCACUAA CUGAUGA GCCGUUAGGC GAA AAAUAUAU | 7218 | AUAUAUUUA UUAGUGAU | 76 |
| 633 | GUAUCACU CUGAUGA GCCGUUAGGC GAA AUAAAUAU | 7219 | AUAUUUAUU AGUGAUAC | 77 |
| 634 | UGUAUCAC CUGAUGA GCCGUUAGGC GAA AAUAAAUA | 7220 | UAUUUAUUA GUGAUACA | 78 |
| 640 | UCUACCUG CUGAUGA GCCGUUAGGC GAA AUCACUAA | 7221 | UUAGUGAUA CAGGUAGA | 79 |
| 646 | GAAAGGUC CUGAUGA GCCGUUAGGC GAA ACCUGUAU | 7222 | AUACAGGUA GACCUUUC | 80 |
| 652 | CUCUACGA CUGAUGA GCCGUUAGGC GAA AGGUCUAC | 7223 | GUAGACCUU UCGUAGAG | 81 |
| 653 | UCUCUACG CUGAUGA GCCGUUAGGC GAA AAGGUCUA | 7224 | UAGACCUUU CGUAGAGA | 82 |
| 654 | AUCUCUAC CUGAUGA GCCGUUAGGC GAA AAAGGUCU | 7225 | AGACCUUUC GUAGAGAU | 83 |
| 657 | UACAUCUC CUGAUGA GCCGUUAGGC GAA ACGAAAGG | 7226 | CCUUUCGUA GAGAUGUA | 84 |
| 665 | UUUCACUG CUGAUGA GCCGUUAGGC GAA ACAUCUCU | 7227 | AGAGAUGUA CAGUGAAA | 85 |
| 675 | AUUUCGGG CUGAUGA GCCGUUAGGC GAA AUUUCACU | 7228 | AGUGAAAUC CCCGAAAU | 86 |
| 684 | AUGUGUAU CUGAUGA GCCGUUAGGC GAA AUUUCGGG | 7229 | CCCGAAAUU AUACACAU | 87 |
| 685 | CAUGUGUA CUGAUGA GCCGUUAGGC GAA AAUUUCGG | 7230 | CCGAAAUUA UACACAUG | 88 |
| 687 | GUCAUGUG CUGAUGA GCCGUUAGGC GAA AUAAUUUC | 7231 | GAAAUUAUA CACAUGAC | 89 |
| 711 | GGAAUGAC CUGAUGA GCCGUUAGGC GAA AGCUCCCU | 7232 | AGGGAGCUC GUCAUUCC | 90 |
| 714 | CAGGGAAU CUGAUGA GCCGUUAGGC GAA ACGAGCUC | 7233 | GAGCUCGUC AUUCCCUG | 91 |
| 717 | CGGCAGGG CUGAUGA GCCGUUAGGC GAA AUGACGAG | 7234 | CUCGUCAUU CCCUGCCG | 92 |
| 718 | CCGGCAGG CUGAUGA GCCGUUAGGC GAA AAUGACGA | 7235 | UCGUCAUUC CCUGCCGG | 93 |
| 729 | GGUGACGU CUGAUGA GCCGUUAGGC GAA ACCCGGCA | 7236 | UGCCGGGUU ACGUCACC | 94 |
| 730 | AGGUGACG CUGAUGA GCCGUUAGGC GAA AACCCGGC | 7237 | GCCGGGUUA CGUCACCU | 95 |

| | | | | |
|---|---|---|---|---|
| 734 | UGUUAGGU CUGAUGA GCCGUUAGGC GAA ACGUAACC | 7238 | GGUUACGUC ACCUAACA | 96 |
| 739 | AGUGAUGU CUGAUGA GCCGUUAGGC GAA AGGUGACG | 7239 | CGUCACCUA ACAUCACU | 97 |
| 744 | GUAACAGU CUGAUGA GCCGUUAGGC GAA AUGUUAGG | 7240 | CCUAACAUC ACUGUUAC | 98 |
| 750 | UUUAAAGU CUGAUGA GCCGUUAGGC GAA ACAGUGAU | 7241 | AUCACUGUU ACUUUAAA | 99 |
| 751 | UUUUAAAG CUGAUGA GCCGUUAGGC GAA AACAGUGA | 7242 | UCACUGUUA CUUUAAAA | 100 |
| 754 | CUUUUUUA CUGAUGA GCCGUUAGGC GAA AGUAACAG | 7243 | CUGUUACUU UAAAAAAG | 101 |
| 755 | ACUUUUUU CUGAUGA GCCGUUAGGC GAA AAGUAACA | 7244 | UGUUACUUU AAAAAAGU | 102 |
| 756 | AACUUUUU CUGAUGA GCCGUUAGGC GAA AAAGUAAC | 7245 | GUUACUUUA AAAAAGUU | 103 |
| 764 | CAAGUGGA CUGAUGA GCCGUUAGGC GAA ACUUUUUU | 7246 | AAAAAAGUU UCCACUUG | 104 |
| 765 | UCAAGUGG CUGAUGA GCCGUUAGGC GAA AACUUUUU | 7247 | AAAAAGUUU CCACUUGA | 105 |
| 766 | GUCAAGUG CUGAUGA GCCGUUAGGC GAA AAACUUUU | 7248 | AAAAGUUUC CACUUGAC | 106 |
| 771 | AAAGUGUC CUGAUGA GCCGUUAGGC GAA AGUGGAAA | 7249 | UUUCCACUU GACACUUU | 107 |
| 778 | AGGGAUCA CUGAUGA GCCGUUAGGC GAA AGUGUCAA | 7250 | UUGACACUU UGAUCCCU | 108 |
| 779 | CAGGGAUC CUGAUGA GCCGUUAGGC GAA AAGUGUCA | 7251 | UGACACUUU GAUCCCUG | 109 |
| 783 | CCAUCAGG CUGAUGA GCCGUUAGGC GAA AUCAAAGU | 7252 | ACUUUGAUC CCUGAUGG | 110 |
| 801 | UCCCAGAU CUGAUGA GCCGUUAGGC GAA AUGCGUUU | 7253 | AAACGCAUA AUCUGGGA | 111 |
| 804 | CUGUCCCA CUGAUGA GCCGUUAGGC GAA AUUAUGCG | 7254 | CGCAUAAUC UGGGACAG | 112 |
| 814 | GCCCUUUC CUGAUGA GCCGUUAGGC GAA ACUGUCCC | 7255 | GGGACAGUA GAAAGGGC | 113 |
| 824 | AUAUGAUG CUGAUGA GCCGUUAGGC GAA AGCCCUUU | 7256 | AAAGGGCUU CAUCAUAU | 114 |
| 825 | GAUAUGAU CUGAUGA GCCGUUAGGC GAA AAGCCCUU | 7257 | AAGGGCUUC AUCAUAUC | 115 |
| 828 | UUUGAUAU CUGAUGA GCCGUUAGGC GAA AUGAAGCC | 7258 | GGCUUCAUC AUAUCAAA | 116 |
| 831 | GCAUUUGA CUGAUGA GCCGUUAGGC GAA AUGAUGAA | 7259 | UUCAUCAUA UCAAAUGC | 117 |
| 833 | UUGCAUUU CUGAUGA GCCGUUAGGC GAA AUAUGAUG | 7260 | CAUCAUAUC AAAUGCAA | 118 |
| 845 | UUUCUUUG CUGAUGA GCCGUUAGGC GAA ACGUUGCA | 7261 | UGCAACGUA CAAAGAAA | 119 |
| 855 | AGAAGCCC CUGAUGA GCCGUUAGGC GAA AUUUCUUU | 7262 | AAAGAAAUA GGGCUUCU | 120 |
| 861 | CAGGUCAG CUGAUGA GCCGUUAGGC GAA AGCCCUAU | 7263 | AUAGGGCUU CUGACCUG | 121 |
| 862 | ACAGGUCA CUGAUGA GCCGUUAGGC GAA AAGCCCUA | 7264 | UAGGGCUUC UGACCUGU | 122 |
| 882 | UGCCCAUU CUGAUGA GCCGUUAGGC GAA ACUGUUGC | 7265 | GCAACAGUC AAUGGGCA | 123 |
| 892 | CUUAUACA CUGAUGA GCCGUUAGGC GAA AUGCCCAU | 7266 | AUGGGCAUU UGUAUAAG | 124 |
| 893 | UCUUAUAC CUGAUGA GCCGUUAGGC GAA AAUGCCCA | 7267 | UGGGCAUUU GUAUAAGA | 125 |
| 896 | UUGUCUUA CUGAUGA GCCGUUAGGC GAA ACAAAUGC | 7268 | GCAUUUGUA UAAGACAA | 126 |
| 898 | GUUUGUCU CUGAUGA GCCGUUAGGC GAA AUACAAAU | 7269 | AUUUGUAUA AGACAAAC | 127 |
| 908 | GUGUGAGA CUGAUGA GCCGUUAGGC GAA AGUUUGUC | 7270 | GACAAACUA UCUCACAC | 128 |

| | | | | |
|---|---|---|---|---|
| 910 | AUGUGUGA CUGAUGA GCCGUUAGGC GAA AUAGUUUG | 7271 | CAAACUAUC UCACACAU | 129 |
| 912 | CGAUGUGU CUGAUGA GCCGUUAGGC GAA AGAUAGUU | 7272 | AACUAUCUC ACACAUCG | 130 |
| 919 | GGUUUGUC CUGAUGA GCCGUUAGGC GAA AUGUGUGA | 7273 | UCACACAUC GACAAACC | 131 |
| 931 | UAUGAUUG CUGAUGA GCCGUUAGGC GAA AUUGGUUU | 7274 | AAACCAAUA CAAUCAUA | 132 |
| 936 | ACAUCUAU CUGAUGA GCCGUUAGGC GAA AUUGUAUU | 7275 | AAUACAAUC AUAGAUGU | 133 |
| 939 | UGGACAUC CUGAUGA GCCGUUAGGC GAA AUGAUUGU | 7276 | ACAAUCAUA GAUGUCCA | 134 |
| 945 | CUUAUUUG CUGAUGA GCCGUUAGGC GAA ACAUCUAU | 7277 | AUAGAUGUC CAAAUAAG | 135 |
| 951 | GGUGUGCU CUGAUGA GCCGUUAGGC GAA AUUUGGAC | 7278 | GUCCAAAUA AGCACACC | 136 |
| 969 | AGUAAUUU CUGAUGA GCCGUUAGGC GAA ACUGGGCG | 7279 | CGCCCAGUC AAAUUACU | 137 |
| 974 | CUCUAAGU CUGAUGA GCCGUUAGGC GAA AUUUGACU | 7280 | AGUCAAAUU ACUUAGAG | 138 |
| 975 | CCUCUAAG CUGAUGA GCCGUUAGGC GAA AAUUUGAC | 7281 | GUCAAAUUA CUUAGAGG | 139 |
| 978 | UGGCCUCU CUGAUGA GCCGUUAGGC GAA AGUAAUUU | 7282 | AAAUUACUU AGAGGCCA | 140 |
| 979 | AUGGCCUC CUGAUGA GCCGUUAGGC GAA AAGUAAUU | 7283 | AAUUACUUA GAGGCCAU | 141 |
| 988 | GACAAGAG CUGAUGA GCCGUUAGGC GAA AUGGCCUC | 7284 | GAGGCCAUA CUCUUGUC | 142 |
| 991 | GAGGACAA CUGAUGA GCCGUUAGGC GAA AGUAUGGC | 7285 | GCCAUACUC UUGUCCUC | 143 |
| 993 | UUGAGGAC CUGAUGA GCCGUUAGGC GAA AGAGUAUG | 7286 | CAUACUCUU GUCCUCAA | 144 |
| 996 | CAAUUGAG CUGAUGA GCCGUUAGGC GAA ACAAGAGU | 7287 | ACUCUUGUC CUCAAUUG | 145 |
| 999 | GUACAAUU CUGAUGA GCCGUUAGGC GAA AGGACAAG | 7288 | CUUGUCCUC AAUUGUAC | 146 |
| 1003 | AGCAGUAC CUGAUGA GCCGUUAGGC GAA AUUGAGGA | 7289 | UCCUCAAUU GUACUGCU | 147 |
| 1006 | GGUAGCAG CUGAUGA GCCGUUAGGC GAA ACAAUUGA | 7290 | UCAAUUGUA CUGCUACC | 148 |
| 1012 | GGGAGUGG CUGAUGA GCCGUUAGGC GAA AGCAGUAC | 7291 | GUACUGCUA CCACUCCC | 149 |
| 1018 | GUUCAAGG CUGAUGA GCCGUUAGGC GAA AGUGGUAG | 7292 | CUACCACUC CCUUGAAC | 150 |
| 1022 | UCGUGUUC CUGAUGA GCCGUUAGGC GAA AGGGAGUG | 7293 | CACUCCCUU GAACACGA | 151 |
| 1035 | GUCAUUUG CUGAUGA GCCGUUAGGC GAA ACUCUCGU | 7294 | ACGAGAGUU CAAAUGAC | 152 |
| 1036 | GGUCAUUU CUGAUGA GCCGUUAGGC GAA AACUCUCG | 7295 | CGAGAGUUC AAAUGACC | 153 |
| 1051 | AUCAGGGU CUGAUGA GCCGUUAGGC GAA ACUCCAGG | 7296 | CCUGGAGUU ACCCUGAU | 154 |
| 1052 | CAUCAGGG CUGAUGA GCCGUUAGGC GAA AACUCCAG | 7297 | CUGGAGUUA CCCUGAUG | 155 |
| 1069 | AGCUCUCU CUGAUGA GCCGUUAGGC GAA AUUUUUUU | 7298 | AAAAAAAUA AGAGAGCU | 156 |
| 1078 | CCUUACGG CUGAUGA GCCGUUAGGC GAA AGCUCUCU | 7299 | AGAGAGCUU CCGUAAGG | 157 |
| 1079 | GCCUUACG CUGAUGA GCCGUUAGGC GAA AAGCUCUC | 7300 | GAGAGCUUC CGUAAGGC | 158 |
| 1083 | CGUCGCCU CUGAUGA GCCGUUAGGC GAA ACGGAAGC | 7301 | GCUUCCGUA AGGCGACG | 159 |
| 1095 | CUUUGGUC CUGAUGA GCCGUUAGGC GAA AUUCGUCG | 7302 | CGACGAAUU GACCAAAG | 160 |
| 1108 | GGCAUGGG CUGAUGA GCCGUUAGGC GAA AUUGCUUU | 7303 | AAAGCAAUU CCCAUGCC | 161 |

78

| | | | | |
|---|---|---|---|---|
| 1109 | UGGCAUGG CUGAUGA GCCGUUAGGC GAA AAUUGCUU | 7304 | AAGCAAUUC CCAUGCCA | 162 |
| 1122 | CUGUAGAA CUGAUGA GCCGUUAGGC GAA AUGUUGGC | 7305 | GCCAACAUA UUCUACAG | 163 |
| 1124 | CACUGUAG CUGAUGA GCCGUUAGGC GAA AUAUGUUG | 7306 | CAACAUAUU CUACAGUG | 164 |
| 1125 | ACACUGUA CUGAUGA GCCGUUAGGC GAA AAUAUGUU | 7307 | AACAUAUUC UACAGUGU | 165 |
| 1127 | GAACACUG CUGAUGA GCCGUUAGGC GAA AGAAUAUG | 7308 | CAUAUUCUA CAGUGUUC | 166 |
| 1134 | AUAGUAAG CUGAUGA GCCGUUAGGC GAA ACACUGUA | 7309 | UACAGUGUU CUUACUAU | 167 |
| 1135 | AAUAGUAA CUGAUGA GCCGUUAGGC GAA AACACUGU | 7310 | ACAGUGUUC UUACUAUU | 168 |
| 1137 | UCAAUAGU CUGAUGA GCCGUUAGGC GAA AGAACACU | 7311 | AGUGUUCUU ACUAUUGA | 169 |
| 1138 | GUCAAUAG CUGAUGA GCCGUUAGGC GAA AAGAACAC | 7312 | GUGUUCUUA CUAUUGAC | 170 |
| 1141 | UUUGUCAA CUGAUGA GCCGUUAGGC GAA AGUAAGAA | 7313 | UUCUUACUA UUGACAAA | 171 |
| 1143 | AUUUUGUC CUGAUGA GCCGUUAGGC GAA AUAGUAAG | 7314 | CUUACUAUU GACAAAAU | 172 |
| 1173 | CAAGUAUA CUGAUGA GCCGUUAGGC GAA AGUCCUUU | 7315 | AAAGGACUU UAUACUUG | 173 |
| 1174 | ACAAGUAU CUGAUGA GCCGUUAGGC GAA AAGUCCUU | 7316 | AAGGACUUU AUACUUGU | 174 |
| 1175 | GACAAGUA CUGAUGA GCCGUUAGGC GAA AAAGUCCU | 7317 | AGGACUUUA UACUUGUC | 175 |
| 1177 | ACGACAAG CUGAUGA GCCGUUAGGC GAA AUAAAGUC | 7318 | GACUUUAUA CUUGUCGU | 176 |
| 1180 | UACACGAC CUGAUGA GCCGUUAGGC GAA AGUAUAAA | 7319 | UUUAUACUU GUCGUGUA | 177 |
| 1183 | CCUUACAC CUGAUGA GCCGUUAGGC GAA ACAAGUAU | 7320 | AUACUUGUC GUGUAAGG | 178 |
| 1188 | CCACUCCU CUGAUGA GCCGUUAGGC GAA ACACGACA | 7321 | UGUCGUGUA AGGAGUGG | 179 |
| 1202 | AUUUGAAU CUGAUGA GCCGUUAGGC GAA AUGGUCCA | 7322 | UGGACCAUC AUUCAAAU | 180 |
| 1205 | CAGAUUUG CUGAUGA GCCGUUAGGC GAA AUGAUGGU | 7323 | ACCAUCAUU CAAAUCUG | 181 |
| 1206 | ACAGAUUU CUGAUGA GCCGUUAGGC GAA AAUGAUGG | 7324 | CCAUCAUUC AAAUCUGU | 182 |
| 1211 | UGUUAACA CUGAUGA GCCGUUAGGC GAA AUUUGAAU | 7325 | AUUCAAAUC UGUUAACA | 183 |
| 1215 | GAGGUGUU CUGAUGA GCCGUUAGGC GAA ACAGAUUU | 7326 | AAAUCUGUU AACACCUC | 184 |
| 1216 | UGAGGUGU CUGAUGA GCCGUUAGGC GAA AACAGAUU | 7327 | AAUCUGUUA ACACCUCA | 185 |
| 1223 | UAUGCACU CUGAUGA GCCGUUAGGC GAA AGGUGUUA | 7328 | UAACACCUC AGUGCAUA | 186 |
| 1231 | AUCAUAUA CUGAUGA GCCGUUAGGC GAA AUGCACUG | 7329 | CAGUGCAUA UAUAUGAU | 187 |
| 1233 | UUAUCAUA CUGAUGA GCCGUUAGGC GAA AUAUGCAC | 7330 | GUGCAUAUA UAUGAUAA | 188 |
| 1235 | CUUUAUCA CUGAUGA GCCGUUAGGC GAA AUAUAUGC | 7331 | GCAUAUAUA UGAUAAAG | 189 |
| 1240 | GAAUGCUU CUGAUGA GCCGUUAGGC GAA AUCAUAUA | 7332 | UAUAUGAUA AAGCAUUC | 190 |
| 1247 | CAGUGAUG CUGAUGA GCCGUUAGGC GAA AUGCUUUA | 7333 | UAAAGCAUU CAUCACUG | 191 |
| 1248 | ACAGUGAU CUGAUGA GCCGUUAGGC GAA AAUGCUUU | 7334 | AAAGCAUUC AUCACUGU | 192 |
| 1251 | UUCACAGU CUGAUGA GCCGUUAGGC GAA AUGAAUGC | 7335 | GCAUUCAUC ACUGUGAA | 193 |
| 1264 | CUGUUUUC CUGAUGA GCCGUUAGGC GAA AUGUUUCA | 7336 | UGAAACAUC GAAAACAG | 194 |

79

| | | | | |
|---|---|---|---|---|
| 1281 | ACGGUUUC CUGAUGA GCCGUUAGGC GAA AGCACCUG | 7337 | CAGGUGCUU GAAACCGU | 195 |
| 1290 | UUGCCAGC CUGAUGA GCCGUUAGGC GAA ACGGUUUC | 7338 | GAAACCGUA GCUGGCAA | 196 |
| 1304 | GCCGGUAA CUGAUGA GCCGUUAGGC GAA ACCGCUUG | 7339 | CAAGCGGUC UUACCGGC | 197 |
| 1306 | GAGCCGGU CUGAUGA GCCGUUAGGC GAA AGACCGCU | 7340 | AGCGGUCUU ACCGGCUC | 198 |
| 1307 | AGAGCCGG CUGAUGA GCCGUUAGGC GAA AAGACCGC | 7341 | GCGGUCUUA CCGGCUCU | 199 |
| 1314 | UUCAUAGA CUGAUGA GCCGUUAGGC GAA AGCCGGUA | 7342 | UACCGGCUC UCUAUGAA | 200 |
| 1316 | CUUUCAUA CUGAUGA GCCGUUAGGC GAA AGAGCCGG | 7343 | CCGGCUCUC UAUGAAAG | 201 |
| 1318 | CACUUUCA CUGAUGA GCCGUUAGGC GAA AGAGAGCC | 7344 | GGCUCUCUA UGAAAGUG | 202 |
| 1334 | GCGAGGGA CUGAUGA GCCGUUAGGC GAA AUGCCUUC | 7345 | GAAGGCAUU UCCCUCGC | 203 |
| 1335 | GGCGAGGG CUGAUGA GCCGUUAGGC GAA AAUGCCUU | 7346 | AAGGCAUUU CCCUCGCC | 204 |
| 1336 | CGGCGAGG CUGAUGA GCCGUUAGGC GAA AAAUGCCU | 7347 | AGGCAUUUC CCUCGCCG | 205 |
| 1340 | CUUCCGGC CUGAUGA GCCGUUAGGC GAA AGGGAAAU | 7348 | AUUUCCCUC GCCGGAAG | 206 |
| 1350 | AACCAUAC CUGAUGA GCCGUUAGGC GAA ACUUCCGG | 7349 | CCGGAAGUU GUAUGGUU | 207 |
| 1353 | UUUAACCA CUGAUGA GCCGUUAGGC GAA ACAACUUC | 7350 | GAAGUUGUA UGGUUAAA | 208 |
| 1358 | CAUCUUUU CUGAUGA GCCGUUAGGC GAA ACCAUACA | 7351 | UGUAUGGUU AAAAGAUG | 209 |
| 1359 | CCAUCUUU CUGAUGA GCCGUUAGGC GAA AACCAUAC | 7352 | GUAUGGUUA AAAGAUGG | 210 |
| 1370 | UCGCAGGU CUGAUGA GCCGUUAGGC GAA ACCCAUCU | 7353 | AGAUGGGUU ACCUGCGA | 211 |
| 1371 | GUCGCAGG CUGAUGA GCCGUUAGGC GAA AACCCAUC | 7354 | GAUGGGUUA CCUGCGAC | 212 |
| 1388 | AGCGAGCA CUGAUGA GCCGUUAGGC GAA AUUUCUCA | 7355 | UGAGAAAUC UGCUCGCU | 213 |
| 1393 | CAAAUAGC CUGAUGA GCCGUUAGGC GAA AGCAGAUU | 7356 | AAUCUGCUC GCUAUUUG | 214 |
| 1397 | GAGUCAAA CUGAUGA GCCGUUAGGC GAA AGCGAGCA | 7357 | UGCUCGCUA UUUGACUC | 215 |
| 1399 | ACGAGUCA CUGAUGA GCCGUUAGGC GAA AUAGCGAG | 7358 | CUCGCUAUU UGACUCGU | 216 |
| 1400 | CACGAGUC CUGAUGA GCCGUUAGGC GAA AAUAGCGA | 7359 | UCGCUAUUU GACUCGUG | 217 |
| 1405 | GUAGCCAC CUGAUGA GCCGUUAGGC GAA AGUCAAAU | 7360 | AUUUGACUC GUGGCUAC | 218 |
| 1412 | UUAACGAG CUGAUGA GCCGUUAGGC GAA AGCCACGA | 7361 | UCGUGGCUA CUCGUUAA | 219 |
| 1415 | UAAUUAAC CUGAUGA GCCGUUAGGC GAA AGUAGCCA | 7362 | UGGCUACUC GUUAAUUA | 220 |
| 1418 | UGAUAAUU CUGAUGA GCCGUUAGGC GAA ACGAGUAG | 7363 | CUACUCGUU AAUUAUCA | 221 |
| 1419 | UUGAUAAU CUGAUGA GCCGUUAGGC GAA AACGAGUA | 7364 | UACUCGUUA AUUAUCAA | 222 |
| 1422 | UCCUUGAU CUGAUGA GCCGUUAGGC GAA AUUAACGA | 7365 | UCGUUAAUU AUCAAGGA | 223 |
| 1423 | GUCCUUGA CUGAUGA GCCGUUAGGC GAA AAUUAACG | 7366 | CGUUAAUUA UCAAGGAC | 224 |
| 1425 | ACGUCCUU CUGAUGA GCCGUUAGGC GAA AUAAUUAA | 7367 | UUAAUUAUC AAGGACGU | 225 |
| 1434 | UCUUCAGU CUGAUGA GCCGUUAGGC GAA ACGUCCUU | 7368 | AAGGACGUA ACUGAAGA | 226 |
| 1456 | GAUUGUAU CUGAUGA GCCGUUAGGC GAA AUUCCCUG | 7369 | CAGGGAAUU AUACAAUC | 227 |

80

| | | | | |
|---|---|---|---|---|
| 1457 | AGAUUGUA CUGAUGA GCCGUUAGGC GAA AAUUCCCU | 7370 | AGGGAAUUA UACAAUCU | 228 |
| 1459 | CAAGAUUG CUGAUGA GCCGUUAGGC GAA AUAAUUCC | 7371 | GGAAUUAUA CAAUCUUG | 229 |
| 1464 | CUCAGCAA CUGAUGA GCCGUUAGGC GAA AUUGUAUA | 7372 | UAUACAAUC UUGCUGAG | 230 |
| 1466 | UGCUCAGC CUGAUGA GCCGUUAGGC GAA AGAUUGUA | 7373 | UACAAUCUU GCUGAGCA | 231 |
| 1476 | GACUGUUU CUGAUGA GCCGUUAGGC GAA AUGCUCAG | 7374 | CUGAGCAUA AAACAGUC | 232 |
| 1484 | ACACAUUU CUGAUGA GCCGUUAGGC GAA ACUGUUUU | 7375 | AAAACAGUC AAAUGUGU | 233 |
| 1493 | GGUUUUUA CUGAUGA GCCGUUAGGC GAA ACACAUUU | 7376 | AAAUGUGUU UAAAAACC | 234 |
| 1494 | AGGUUUUU CUGAUGA GCCGUUAGGC GAA AACACAUU | 7377 | AAUGUGUUU AAAAACCU | 235 |
| 1495 | GAGGUUUU CUGAUGA GCCGUUAGGC GAA AAACACAU | 7378 | AUGUGUUUA AAAACCUC | 236 |
| 1503 | GUGGCAGU CUGAUGA GCCGUUAGGC GAA AGGUUUUU | 7379 | AAAAACCUC ACUGCCAC | 237 |
| 1513 | GACAAUUA CUGAUGA GCCGUUAGGC GAA AGUGGCAG | 7380 | CUGCCACUC UAAUUGUC | 238 |
| 1515 | UUGACAAU CUGAUGA GCCGUUAGGC GAA AGAGUGGC | 7381 | GCCACUCUA AUUGUCAA | 239 |
| 1518 | ACAUUGAC CUGAUGA GCCGUUAGGC GAA AUUAGAGU | 7382 | ACUCUAAUU GUCAAUGU | 240 |
| 1521 | UUCACAUU CUGAUGA GCCGUUAGGC GAA ACAAUUAG | 7383 | CUAAUUGUC AAUGUGAA | 241 |
| 1539 | UUUUCGUA CUGAUGA GCCGUUAGGC GAA AUCUGGGG | 7384 | CCCCAGAUU UACGAAAA | 242 |
| 1540 | CUUUUCGU CUGAUGA GCCGUUAGGC GAA AAUCUGGG | 7385 | CCCAGAUUU ACGAAAAG | 243 |
| 1541 | CCUUUUCG CUGAUGA GCCGUUAGGC GAA AAAUCUGG | 7386 | CCAGAUUUA CGAAAAGG | 244 |
| 1556 | GAAACGAU CUGAUGA GCCGUUAGGC GAA ACACGGCC | 7387 | GGCCGUGUC AUCGUUUC | 245 |
| 1559 | CUGGAAAC CUGAUGA GCCGUUAGGC GAA AUGACACG | 7388 | CGUGUCAUC GUUUCCAG | 246 |
| 1562 | GGUCUGGA CUGAUGA GCCGUUAGGC GAA ACGAUGAC | 7389 | GUCAUCGUU UCCAGACC | 247 |
| 1563 | GGGUCUGG CUGAUGA GCCGUUAGGC GAA AACGAUGA | 7390 | UCAUCGUUU CCAGACCC | 248 |
| 1564 | CGGGUCUG CUGAUGA GCCGUUAGGC GAA AAACGAUG | 7391 | CAUCGUUUC CAGACCCG | 249 |
| 1576 | UGGGUAGA CUGAUGA GCCGUUAGGC GAA AGCCGGGU | 7392 | ACCCGGCUC UCUACCCA | 250 |
| 1578 | AGUGGGUA CUGAUGA GCCGUUAGGC GAA AGAGCCGG | 7393 | CCGGCUCUC UACCCACU | 251 |
| 1580 | CCAGUGGG CUGAUGA GCCGUUAGGC GAA AGAGAGCC | 7394 | GGCUCUCUA CCCACUGG | 252 |
| 1602 | CAAGUCAG CUGAUGA GCCGUUAGGC GAA AUUUGUCU | 7395 | AGACAAAUC CUGACUUG | 253 |
| 1609 | UGCGGUAC CUGAUGA GCCGUUAGGC GAA AGUCAGGA | 7396 | UCCUGACUU GUACCGCA | 254 |
| 1612 | AUAUGCGG CUGAUGA GCCGUUAGGC GAA ACAAGUCA | 7397 | UGACUUGUA CCGCAUAU | 255 |
| 1619 | GGAUACCA CUGAUGA GCCGUUAGGC GAA AUGCGGUA | 7398 | UACCGCAUA UGGUAUCC | 256 |
| 1624 | UUGAGGGA CUGAUGA GCCGUUAGGC GAA ACCAUAUG | 7399 | CAUAUGGUA UCCCUCAA | 257 |
| 1626 | GGUUGAGG CUGAUGA GCCGUUAGGC GAA AUACCAUA | 7400 | UAUGGUAUC CCUCAACC | 258 |
| 1630 | UGUAGGUU CUGAUGA GCCGUUAGGC GAA AGGGAUAC | 7401 | GUAUCCCUC AACCUACA | 259 |
| 1636 | CUUGAUUG CUGAUGA GCCGUUAGGC GAA AGGUUGAG | 7402 | CUCAACCUA CAAUCAAG | 260 |

81

| | | | | |
|---|---|---|---|---|
| 1641 | AACCACUU CUGAUGA GCCGUUAGGC GAA AUUGUAGG | 7403 | CCUACAAUC AAGUGGUU | 261 |
| 1649 | GGUGCCAG CUGAUGA GCCGUUAGGC GAA ACCACUUG | 7404 | CAAGUGGUU CUGGCACC | 262 |
| 1650 | GGGUGCCA CUGAUGA GCCGUUAGGC GAA AACCACUU | 7405 | AAGUGGUUC UGGCACCC | 263 |
| 1663 | AUUAUGGU CUGAUGA GCCGUUAGGC GAA ACAGGGGU | 7406 | ACCCCUGUA ACCAUAAU | 264 |
| 1669 | GGAAUGAU CUGAUGA GCCGUUAGGC GAA AUGGUUAC | 7407 | GUAACCAUA AUCAUUCC | 265 |
| 1672 | UUCGGAAU CUGAUGA GCCGUUAGGC GAA AUUAUGGU | 7408 | ACCAUAAUC AUUCCGAA | 266 |
| 1675 | UGCUUCGG CUGAUGA GCCGUUAGGC GAA AUGAUUAU | 7409 | AUAAUCAUU CCGAAGCA | 267 |
| 1676 | UUGCUUCG CUGAUGA GCCGUUAGGC GAA AAUGAUUA | 7410 | UAAUCAUUC CGAAGCAA | 268 |
| 1694 | UGGAACAA CUGAUGA GCCGUUAGGC GAA AGUCACAC | 7411 | GUGUGACUU UUGUUCCA | 269 |
| 1695 | UUGGAACA CUGAUGA GCCGUUAGGC GAA AAGUCACA | 7412 | UGUGACUUU UGUUCCAA | 270 |
| 1696 | AUUGGAAC CUGAUGA GCCGUUAGGC GAA AAAGUCAC | 7413 | GUGACUUUU GUUCCAAU | 271 |
| 1699 | AUUAUUGG CUGAUGA GCCGUUAGGC GAA ACAAAAGU | 7414 | ACUUUUGUU CCAAUAAU | 272 |
| 1700 | CAUUAUUG CUGAUGA GCCGUUAGGC GAA AACAAAAG | 7415 | CUUUUGUUC CAAUAAUG | 273 |
| 1705 | CUCUUCAU CUGAUGA GCCGUUAGGC GAA AUUGGAAC | 7416 | GUUCCAAUA AUGAAGAG | 274 |
| 1715 | GGAUAAAG CUGAUGA GCCGUUAGGC GAA ACUCUUCA | 7417 | UGAAGAGUC CUUUAUCC | 275 |
| 1718 | CCAGGAUA CUGAUGA GCCGUUAGGC GAA AGGACUCU | 7418 | AGAGUCCUU UAUCCUGG | 276 |
| 1719 | UCCAGGAU CUGAUGA GCCGUUAGGC GAA AAGGACUC | 7419 | GAGUCCUUU AUCCUGGA | 277 |
| 1720 | AUCCAGGA CUGAUGA GCCGUUAGGC GAA AAAGGACU | 7420 | AGUCCUUUA UCCUGGAU | 278 |
| 1722 | GCAUCCAG CUGAUGA GCCGUUAGGC GAA AUAAAGGA | 7421 | UCCUUUAUC CUGGAUGC | 279 |
| 1755 | AUGCUCUC CUGAUGA GCCGUUAGGC GAA AUUCUGUU | 7422 | AACAGAAUU GAGAGCAU | 280 |
| 1764 | CGCUGAGU CUGAUGA GCCGUUAGGC GAA AUGCUCUC | 7423 | GAGAGCAUC ACUCAGCG | 281 |
| 1768 | CAUGCGCU CUGAUGA GCCGUUAGGC GAA AGUGAUGC | 7424 | GCAUCACUC AGCGCAUG | 282 |
| 1782 | CCUUCUAU CUGAUGA GCCGUUAGGC GAA AUUGCCAU | 7425 | AUGGCAAUA AUAGAAGG | 283 |
| 1785 | UUUCCUUC CUGAUGA GCCGUUAGGC GAA AUUAUUGC | 7426 | GCAAUAAUA GAAGGAAA | 284 |
| 1798 | AGCCAUCU CUGAUGA GCCGUUAGGC GAA AUUCUUUC | 7427 | GAAAGAAUA AGAUGGCU | 285 |
| 1807 | CAAGGUGC CUGAUGA GCCGUUAGGC GAA AGCCAUCU | 7428 | AGAUGGCUA GCACCUUG | 286 |
| 1814 | CCACAACC CUGAUGA GCCGUUAGGC GAA AGGUGCUA | 7429 | UAGCACCUU GGUUGUGG | 287 |
| 1818 | UCAGCCAC CUGAUGA GCCGUUAGGC GAA ACCAAGGU | 7430 | ACCUUGGUU GUGGCUGA | 288 |
| 1829 | AAAUUCUA CUGAUGA GCCGUUAGGC GAA AGUCAGCC | 7431 | GGCUGACUC UAGAAUUU | 289 |
| 1831 | AGAAAUUC CUGAUGA GCCGUUAGGC GAA AGAGUCAG | 7432 | CUGACUCUA GAAUUUCU | 290 |
| 1836 | AUUCCAGA CUGAUGA GCCGUUAGGC GAA AUUCUAGA | 7433 | UCUAGAAUU UCUGGAAU | 291 |
| 1837 | GAUUCCAG CUGAUGA GCCGUUAGGC GAA AAUUCUAG | 7434 | CUAGAAUUU CUGGAAUC | 292 |
| 1838 | AGAUUCCA CUGAUGA GCCGUUAGGC GAA AAAUUCUA | 7435 | UAGAAUUUC UGGAAUCU | 293 |

82

| | | | | |
|---|---|---|---|---|
| 1845 | CAAAUGUA CUGAUGA GCCGUUAGGC GAA AUUCCAGA | 7436 | UCUGGAAUC UACAUUUG | 294 |
| 1847 | UGCAAAUG CUGAUGA GCCGUUAGGC GAA AGAUUCCA | 7437 | UGGAAUCUA CAUUUGCA | 295 |
| 1851 | GCUAUGCA CUGAUGA GCCGUUAGGC GAA AUGUAGAU | 7438 | AUCUACAUU UGCAUAGC | 296 |
| 1852 | AGCUAUGC CUGAUGA GCCGUUAGGC GAA AAUGUAGA | 7439 | UCUACAUUU GCAUAGCU | 297 |
| 1857 | UUGGAAGC CUGAUGA GCCGUUAGGC GAA AUGCAAAU | 7440 | AUUUGCAUA GCUUCCAA | 298 |
| 1861 | UUUAUUGG CUGAUGA GCCGUUAGGC GAA AGCUAUGC | 7441 | GCAUAGCUU CCAAUAAA | 299 |
| 1862 | CUUUAUUG CUGAUGA GCCGUUAGGC GAA AAGCUAUG | 7442 | CAUAGCUUC CAAUAAAG | 300 |
| 1867 | CCCAACUU CUGAUGA GCCGUUAGGC GAA AUUGGAAG | 7443 | CUUCCAAUA AAGUUGGG | 301 |
| 1872 | ACAGUCCC CUGAUGA GCCGUUAGGC GAA ACUUUAUU | 7444 | AAUAAAGUU GGGACUGU | 302 |
| 1893 | UAAAAGCU CUGAUGA GCCGUUAGGC GAA AUGUUUCU | 7445 | AGAAACAUA AGCUUUUA | 303 |
| 1898 | UGAUAUAA CUGAUGA GCCGUUAGGC GAA AGCUUAUG | 7446 | CAUAAGCUU UUAUAUCA | 304 |
| 1899 | GUGAUAUA CUGAUGA GCCGUUAGGC GAA AAGCUUAU | 7447 | AUAAGCUUU UAUAUCAC | 305 |
| 1900 | UGUGAUAU CUGAUGA GCCGUUAGGC GAA AAAGCUUA | 7448 | UAAGCUUUU AUAUCACA | 306 |
| 1901 | CUGUGAUA CUGAUGA GCCGUUAGGC GAA AAAAGCUU | 7449 | AAGCUUUUA UAUCACAG | 307 |
| 1903 | AUCUGUGA CUGAUGA GCCGUUAGGC GAA AUAAAAGC | 7450 | GCUUUUAUA UCACAGAU | 308 |
| 1905 | ACAUCUGU CUGAUGA GCCGUUAGGC GAA AUAUAAAA | 7451 | UUUUAUAUC ACAGAUGU | 309 |
| 1925 | UAACAUGA CUGAUGA GCCGUUAGGC GAA ACCCAUUU | 7452 | AAAUGGGUU UCAUGUUA | 310 |
| 1926 | UUAACAUG CUGAUGA GCCGUUAGGC GAA AACCCAUU | 7453 | AAUGGGUUU CAUGUUAA | 311 |
| 1927 | GUUAACAU CUGAUGA GCCGUUAGGC GAA AAACCCAU | 7454 | AUGGGUUUC AUGUUAAC | 312 |
| 1932 | UCCAAGUU CUGAUGA GCCGUUAGGC GAA ACAUGAAA | 7455 | UUUCAUGUU AACUUGGA | 313 |
| 1933 | UUCCAAGU CUGAUGA GCCGUUAGGC GAA AACAUGAA | 7456 | UUCAUGUUA ACUUGGAA | 314 |
| 1937 | UUUUUUCC CUGAUGA GCCGUUAGGC GAA AGUUAACA | 7457 | UGUUAACUU GGAAAAAA | 315 |
| 1976 | CUGUGCAA CUGAUGA GCCGUUAGGC GAA ACAGUUUC | 7458 | GAAACUGUC UUGCACAG | 316 |
| 1978 | AACUGUGC CUGAUGA GCCGUUAGGC GAA AGACAGUU | 7459 | AACUGUCUU GCACAGUU | 317 |
| 1986 | AACUUGUU CUGAUGA GCCGUUAGGC GAA ACUGUGCA | 7460 | UGCACAGUU AACAAGUU | 318 |
| 1987 | GAACUUGU CUGAUGA GCCGUUAGGC GAA AACUGUGC | 7461 | GCACAGUUA ACAAGUUC | 319 |
| 1994 | UGUAUAAG CUGAUGA GCCGUUAGGC GAA ACUUGUUA | 7462 | UAACAAGUU CUUAUACA | 320 |
| 1995 | CUGUAUAA CUGAUGA GCCGUUAGGC GAA AACUUGUU | 7463 | AACAAGUUC UUAUACAG | 321 |
| 1997 | CUCUGUAU CUGAUGA GCCGUUAGGC GAA AGAACUUG | 7464 | CAAGUUCUU AUACAGAG | 322 |
| 1998 | UCUCUGUA CUGAUGA GCCGUUAGGC GAA AAGAACUU | 7465 | AAGUUCUUA UACAGAGA | 323 |
| 2000 | CGUCUCUG CUGAUGA GCCGUUAGGC GAA AUAAGAAC | 7466 | GUUCUUAUA CAGAGACG | 324 |
| 2010 | AUCCAAGU CUGAUGA GCCGUUAGGC GAA ACGUCUCU | 7467 | AGAGACGUU ACUUGGAU | 325 |
| 2011 | AAUCCAAG CUGAUGA GCCGUUAGGC GAA AACGUCUC | 7468 | GAGACGUUA CUUGGAUU | 326 |

83

| | | | | |
|---|---|---|---|---|
| 2014 | UAAAAUCC CUGAUGA GCCGUUAGGC GAA AGUAACGU | 7469 | ACGUUACUU GGAUUUUA | 327 |
| 2019 | CGCAGUAA CUGAUGA GCCGUUAGGC GAA AUCCAAGU | 7470 | ACUUGGAUU UUACUGCG | 328 |
| 2020 | CCGCAGUA CUGAUGA GCCGUUAGGC GAA AAUCCAAG | 7471 | CUUGGAUUU UACUGCGG | 329 |
| 2021 | UCCGCAGU CUGAUGA GCCGUUAGGC GAA AAAUCCAA | 7472 | UUGGAUUUU ACUGCGGA | 330 |
| 2022 | GUCCGCAG CUGAUGA GCCGUUAGGC GAA AAAAUCCA | 7473 | UGGAUUUUA CUGCGGAC | 331 |
| 2034 | CUGUUAUU CUGAUGA GCCGUUAGGC GAA ACUGUCCG | 7474 | CGGACAGUU AAUAACAG | 332 |
| 2035 | UCUGUUAU CUGAUGA GCCGUUAGGC GAA AACUGUCC | 7475 | GGACAGUUA AUAACAGA | 333 |
| 2038 | UGUUCUGU CUGAUGA GCCGUUAGGC GAA AUUAACUG | 7476 | CAGUUAAUA ACAGAACA | 334 |
| 2054 | UAAUACUG CUGAUGA GCCGUUAGGC GAA AGUGCAUU | 7477 | AAUGCACUA CAGUAUUA | 335 |
| 2059 | CUUGCUAA CUGAUGA GCCGUUAGGC GAA ACUGUAGU | 7478 | ACUACAGUA UUAGCAAG | 336 |
| 2061 | UGCUUGCU CUGAUGA GCCGUUAGGC GAA AUACUGUA | 7479 | UACAGUAUU AGCAAGCA | 337 |
| 2062 | UUGCUUGC CUGAUGA GCCGUUAGGC GAA AAUACUGU | 7480 | ACAGUAUUA GCAAGCAA | 338 |
| 2082 | UCCUUAGU CUGAUGA GCCGUUAGGC GAA AUGGCCAU | 7481 | AUGGCCAUC ACUAAGGA | 339 |
| 2086 | GUGCUCCU CUGAUGA GCCGUUAGGC GAA AGUGAUGG | 7482 | CCAUCACUA AGGAGCAC | 340 |
| 2096 | GAGUGAUG CUGAUGA GCCGUUAGGC GAA AGUGCUCC | 7483 | GGAGCACUC CAUCACUC | 341 |
| 2100 | UUAAGAGU CUGAUGA GCCGUUAGGC GAA AUGGAGUG | 7484 | CACUCCAUC ACUCUUAA | 342 |
| 2104 | AAGAUUAA CUGAUGA GCCGUUAGGC GAA AGUGAUGG | 7485 | CCAUCACUC UUAAUCUU | 343 |
| 2106 | GUAAGAUU CUGAUGA GCCGUUAGGC GAA AGAGUGAU | 7486 | AUCACUCUU AAUCUUAC | 344 |
| 2107 | GGUAAGAU CUGAUGA GCCGUUAGGC GAA AAGAGUGA | 7487 | UCACUCUUA AUCUUACC | 345 |
| 2110 | GAUGGUAA CUGAUGA GCCGUUAGGC GAA AUUAAGAG | 7488 | CUCUUAAUC UUACCAUC | 346 |
| 2112 | AUGAUGGU CUGAUGA GCCGUUAGGC GAA AGAUUAAG | 7489 | CUUAAUCUU ACCAUCAU | 347 |
| 2113 | CAUGAUGG CUGAUGA GCCGUUAGGC GAA AAGAUUAA | 7490 | UUAAUCUUA CCAUCAUG | 348 |
| 2118 | ACAUUCAU CUGAUGA GCCGUUAGGC GAA AUGGUAAG | 7491 | CUUACCAUC AUGAAUGU | 349 |
| 2127 | UGCAGGGA CUGAUGA GCCGUUAGGC GAA ACAUUCAU | 7492 | AUGAAUGUU UCCCUGCA | 350 |
| 2128 | UUGCAGGG CUGAUGA GCCGUUAGGC GAA AACAUUCA | 7493 | UGAAUGUUU CCCUGCAA | 351 |
| 2129 | CUUGCAGG CUGAUGA GCCGUUAGGC GAA AAACAUUC | 7494 | GAAUGUUUC CCUGCAAG | 352 |
| 2140 | GGUGCCUG CUGAUGA GCCGUUAGGC GAA AUCUUGCA | 7495 | UGCAAGAUU CAGGCACC | 353 |
| 2141 | AGGUGCCU CUGAUGA GCCGUUAGGC GAA AAUCUUGC | 7496 | GCAAGAUUC AGGCACCU | 354 |
| 2150 | UGCAGGCA CUGAUGA GCCGUUAGGC GAA AGGUGCCU | 7497 | AGGCACCUA UGCCUGCA | 355 |
| 2172 | CCUGUGUA CUGAUGA GCCGUUAGGC GAA ACAUUCCU | 7498 | AGGAAUGUA UACACAGG | 356 |
| 2174 | CCCCUGUG CUGAUGA GCCGUUAGGC GAA AUACAUUC | 7499 | GAAUGUAUA CACAGGGG | 357 |
| 2190 | UUCUGGAG CUGAUGA GCCGUUAGGC GAA AUUUCUUC | 7500 | GAAGAAAUC CUCCAGAA | 358 |
| 2193 | UUCUUCUG CUGAUGA GCCGUUAGGC GAA AGGAUUUC | 7501 | GAAAUCCUC CAGAAGAA | 359 |

84

| | | | | |
|---|---|---|---|---|
| 2208 | CUGAUUGU CUGAUGA GCCGUUAGGC GAA AUUUCUUU | 7502 | AAAGAAAUU ACAAUCAG | 360 |
| 2209 | UCUGAUUG CUGAUGA GCCGUUAGGC GAA AAUUUCUU | 7503 | AAGAAAUUA CAAUCAGA | 361 |
| 2214 | UGAUCUCU CUGAUGA GCCGUUAGGC GAA AUUGUAAU | 7504 | AUUACAAUC AGAGAUCA | 362 |
| 2221 | UGCUUCCU CUGAUGA GCCGUUAGGC GAA AUCUCUGA | 7505 | UCAGAGAUC AGGAAGCA | 363 |
| 2234 | GCAGGAGG CUGAUGA GCCGUUAGGC GAA AUGGUGCU | 7506 | AGCACCAUA CCUCCUGC | 364 |
| 2238 | UUUCGCAG CUGAUGA GCCGUUAGGC GAA AGGUAUGG | 7507 | CCAUACCUC CUGCGAAA | 365 |
| 2250 | UGAUCACU CUGAUGA GCCGUUAGGC GAA AGGUUUCG | 7508 | CGAAACCUC AGUGAUCA | 366 |
| 2257 | CACUGUGU CUGAUGA GCCGUUAGGC GAA AUCACUGA | 7509 | UCAGUGAUC ACACAGUG | 367 |
| 2271 | GAACUGCU CUGAUGA GCCGUUAGGC GAA AUGGCCAC | 7510 | GUGGCCAUC AGCAGUUC | 368 |
| 2278 | AGUGGUGG CUGAUGA GCCGUUAGGC GAA ACUGCUGA | 7511 | UCAGCAGUU CCACCACU | 369 |
| 2279 | AAGUGGUG CUGAUGA GCCGUUAGGC GAA AACUGCUG | 7512 | CAGCAGUUC CACCACUU | 370 |
| 2287 | ACAGUCUA CUGAUGA GCCGUUAGGC GAA AGUGGUGG | 7513 | CCACCACUU UAGACUGU | 371 |
| 2288 | GACAGUCU CUGAUGA GCCGUUAGGC GAA AAGUGGUG | 7514 | CACCACUUU AGACUGUC | 372 |
| 2289 | UGACAGUC CUGAUGA GCCGUUAGGC GAA AAAGUGGU | 7515 | ACCACUUUA GACUGUCA | 373 |
| 2296 | AUUAGCAU CUGAUGA GCCGUUAGGC GAA ACAGUCUA | 7516 | UAGACUGUC AUGCUAAU | 374 |
| 2302 | GACACCAU CUGAUGA GCCGUUAGGC GAA AGCAUGAC | 7517 | GUCAUGCUA AUGGUGUC | 375 |
| 2310 | GGCUCGGG CUGAUGA GCCGUUAGGC GAA ACACCAUU | 7518 | AAUGGUGUC CCCGAGCC | 376 |
| 2320 | AGUGAUCU CUGAUGA GCCGUUAGGC GAA AGGCUCGG | 7519 | CCGAGCCUC AGAUCACU | 377 |
| 2325 | AACCAAGU CUGAUGA GCCGUUAGGC GAA AUCUGAGG | 7520 | CCUCAGAUC ACUUGGUU | 378 |
| 2329 | UUUAAACC CUGAUGA GCCGUUAGGC GAA AGUGAUCU | 7521 | AGAUCACUU GGUUUAAA | 379 |
| 2333 | UGUUUUUA CUGAUGA GCCGUUAGGC GAA ACCAAGUG | 7522 | CACUUGGUU UAAAAACA | 380 |
| 2334 | UUGUUUUU CUGAUGA GCCGUUAGGC GAA AACCAAGU | 7523 | ACUUGGUUU AAAAACAA | 381 |
| 2335 | GUUGUUUU CUGAUGA GCCGUUAGGC GAA AAACCAAG | 7524 | CUUGGUUUA AAAACAAC | 382 |
| 2352 | UCUUGUUG CUGAUGA GCCGUUAGGC GAA AUUUUGUG | 7525 | CACAAAAUA CAACAAGA | 383 |
| 2370 | CCUAAAAU CUGAUGA GCCGUUAGGC GAA AUUCCAGG | 7526 | CCUGGAAUU AUUUUAGG | 384 |
| 2371 | UCCUAAAA CUGAUGA GCCGUUAGGC GAA AAUUCCAG | 7527 | CUGGAAUUA UUUUAGGA | 385 |
| 2373 | GGUCCUAA CUGAUGA GCCGUUAGGC GAA AUAAUUCC | 7528 | GGAAUUAUU UUAGGACC | 386 |
| 2374 | UGGUCCUA CUGAUGA GCCGUUAGGC GAA AAUAAUUC | 7529 | GAAUUAUUU UAGGACCA | 387 |
| 2375 | CUGGUCCU CUGAUGA GCCGUUAGGC GAA AAAUAAUU | 7530 | AAUUAUUUU AGGACCAG | 388 |
| 2376 | CCUGGUCC CUGAUGA GCCGUUAGGC GAA AAAAUAAU | 7531 | AUUAUUUUA GGACCAGG | 389 |
| 2399 | UUUCAAUA CUGAUGA GCCGUUAGGC GAA ACAGCGUG | 7532 | CACGCUGUU UAUUGAAA | 390 |
| 2400 | CUUUCAAU CUGAUGA GCCGUUAGGC GAA AACAGCGU | 7533 | ACGCUGUUU AUUGAAAG | 391 |
| 2401 | UCUUUCAA CUGAUGA GCCGUUAGGC GAA AAACAGCG | 7534 | CGCUGUUUA UUGAAAGA | 392 |

| | | | | |
|---|---|---|---|---|
| 2403 | ACUCUUUC CUGAUGA GCCGUUAGGC GAA AUAAACAG | 7535 | CUGUUUAUU GAAAGAGU | 393 |
| 2412 | UCUUCUGU CUGAUGA GCCGUUAGGC GAA ACUCUUUC | 7536 | GAAAGAGUC ACAGAAGA | 394 |
| 2433 | CAGUGAUA CUGAUGA GCCGUUAGGC GAA ACACCUUC | 7537 | GAAGGUGUC UAUCACUG | 395 |
| 2435 | UGCAGUGA CUGAUGA GCCGUUAGGC GAA AGACACCU | 7538 | AGGUGUCUA UCACUGCA | 396 |
| 2437 | UUUGCAGU CUGAUGA GCCGUUAGGC GAA AUAGACAC | 7539 | GUGUCUAUC ACUGCAAA | 397 |
| 2465 | UUUCCACA CUGAUGA GCCGUUAGGC GAA AGCCCUUC | 7540 | GAAGGGCUC UGUGGAAA | 398 |
| 2476 | GUAUGCUG CUGAUGA GCCGUUAGGC GAA ACUUUCCA | 7541 | UGGAAAGUU CAGCAUAC | 399 |
| 2477 | GGUAUGCU CUGAUGA GCCGUUAGGC GAA AACUUUCC | 7542 | GGAAAGUUC AGCAUACC | 400 |
| 2483 | CAGUGAGG CUGAUGA GCCGUUAGGC GAA AUGCUGAA | 7543 | UUCAGCAUA CCUCACUG | 401 |
| 2487 | UGAACAGU CUGAUGA GCCGUUAGGC GAA AGGUAUGC | 7544 | GCAUACCUC ACUGUUCA | 402 |
| 2493 | GUUCCUUG CUGAUGA GCCGUUAGGC GAA ACAGUGAG | 7545 | CUCACUGUU CAAGGAAC | 403 |
| 2494 | GGUUCCUU CUGAUGA GCCGUUAGGC GAA AACAGUGA | 7546 | UCACUGUUC AAGGAACC | 404 |
| 2504 | ACUUGUCC CUGAUGA GCCGUUAGGC GAA AGGUUCCU | 7547 | AGGAACCUC GGACAAGU | 405 |
| 2513 | CCAGAUUA CUGAUGA GCCGUUAGGC GAA ACUUGUCC | 7548 | GGACAAGUC UAAUCUGG | 406 |
| 2515 | CUCCAGAU CUGAUGA GCCGUUAGGC GAA AGACUUGU | 7549 | ACAAGUCUA AUCUGGAG | 407 |
| 2518 | CAGCUCCA CUGAUGA GCCGUUAGGC GAA AUUAGACU | 7550 | AGUCUAAUC UGGAGCUG | 408 |
| 2529 | GUUAGAGU CUGAUGA GCCGUUAGGC GAA AUCAGCUC | 7551 | GAGCUGAUC ACUCUAAC | 409 |
| 2533 | GCAUGUUA CUGAUGA GCCGUUAGGC GAA AGUGAUCA | 7552 | UGAUCACUC UAACAUGC | 410 |
| 2535 | GUGCAUGU CUGAUGA GCCGUUAGGC GAA AGAGUGAU | 7553 | AUCACUCUA ACAUGCAC | 411 |
| 2560 | CCAGAAGA CUGAUGA GCCGUUAGGC GAA AGUCGCAG | 7554 | CUGCGACUC UCUUCUGG | 412 |
| 2562 | AGCCAGAA CUGAUGA GCCGUUAGGC GAA AGAGUCGC | 7555 | GCGACUCUC UUCUGGCU | 413 |
| 2564 | GGAGCCAG CUGAUGA GCCGUUAGGC GAA AGAGAGUC | 7556 | GACUCUCUU CUGGCUCC | 414 |
| 2565 | AGGAGCCA CUGAUGA GCCGUUAGGC GAA AAGAGAGU | 7557 | ACUCUCUUC UGGCUCCU | 415 |
| 2571 | GUUAAUAG CUGAUGA GCCGUUAGGC GAA AGCCAGAA | 7558 | UUCUGGCUC CUAUUAAC | 416 |
| 2574 | AGGGUUAA CUGAUGA GCCGUUAGGC GAA AGGAGCCA | 7559 | UGGCUCCUA UUAACCCU | 417 |
| 2576 | GGAGGGUU CUGAUGA GCCGUUAGGC GAA AUAGGAGC | 7560 | GCUCCUAUU AACCCUCC | 418 |
| 2577 | AGGAGGGU CUGAUGA GCCGUUAGGC GAA AAUAGGAG | 7561 | CUCCUAUUA ACCCUCCU | 419 |
| 2583 | CGGAUAAG CUGAUGA GCCGUUAGGC GAA AGGGUUAA | 7562 | UUAACCCUC CUUAUCCG | 420 |
| 2586 | UUUCGGAU CUGAUGA GCCGUUAGGC GAA AGGAGGGU | 7563 | ACCCUCCUU AUCCGAAA | 421 |
| 2587 | UUUUCGGA CUGAUGA GCCGUUAGGC GAA AAGGAGGG | 7564 | CCCUCCUUA UCCGAAAA | 422 |
| 2589 | AUUUUUCG CUGAUGA GCCGUUAGGC GAA AUAAGGAG | 7565 | CUCCUUAUC CGAAAAAU | 423 |
| 2606 | CAGAAGAA CUGAUGA GCCGUUAGGC GAA ACCUUUUC | 7566 | GAAAAGGUC UUCUUCUG | 424 |
| 2608 | UUCAGAAG CUGAUGA GCCGUUAGGC GAA AGACCUUU | 7567 | AAAGGUCUU CUUCUGAA | 425 |

86

| | | | | |
|---|---|---|---|---|
| 2609 | UUUCAGAA CUGAUGA GCCGUUAGGC GAA AAGACCUU | 7568 | AAGGUCUUC UUCUGAAA | 426 |
| 2611 | UAUUUCAG CUGAUGA GCCGUUAGGC GAA AGAAGACC | 7569 | GGUCUUCUU CUGAAAUA | 427 |
| 2612 | UUAUUUCA CUGAUGA GCCGUUAGGC GAA AAGAAGAC | 7570 | GUCUUCUUC UGAAAUAA | 428 |
| 2619 | UCAGUCUU CUGAUGA GCCGUUAGGC GAA AUUUCAGA | 7571 | UCUGAAAUA AAGACUGA | 429 |
| 2630 | UUGAUAGG CUGAUGA GCCGUUAGGC GAA AGUCAGUC | 7572 | GACUGACUA CCUAUCAA | 430 |
| 2634 | AUAAUUGA CUGAUGA GCCGUUAGGC GAA AGGUAGUC | 7573 | GACUACCUA UCAAUUAU | 431 |
| 2636 | UUAUAAUU CUGAUGA GCCGUUAGGC GAA AUAGGUAG | 7574 | CUACCUAUC AAUUAUAA | 432 |
| 2640 | UCCAUUAU CUGAUGA GCCGUUAGGC GAA AUUGAUAG | 7575 | CUAUCAAUU AUAAUGGA | 433 |
| 2641 | GUCCAUUA CUGAUGA GCCGUUAGGC GAA AAUUGAUA | 7576 | UAUCAAUUA UAAUGGAC | 434 |
| 2643 | GGGUCCAU CUGAUGA GCCGUUAGGC GAA AUAAUUGA | 7577 | UCAAUUAUA AUGGACCC | 435 |
| 2661 | UCCAAAGG CUGAUGA GCCGUUAGGC GAA ACUUCAUC | 7578 | GAUGAAGUU CCUUUGGA | 436 |
| 2662 | AUCCAAAG CUGAUGA GCCGUUAGGC GAA AACUUCAU | 7579 | AUGAAGUUC CUUUGGAU | 437 |
| 2665 | CUCAUCCA CUGAUGA GCCGUUAGGC GAA AGGAACUU | 7580 | AAGUUCCUU UGGAUGAG | 438 |
| 2666 | GCUCAUCC CUGAUGA GCCGUUAGGC GAA AAGGAACU | 7581 | AGUUCCUUU GGAUGAGC | 439 |
| 2688 | UCAUAAGG CUGAUGA GCCGUUAGGC GAA AGCCGCUC | 7582 | GAGCGGCUC CCUUAUGA | 440 |
| 2692 | GGCAUCAU CUGAUGA GCCGUUAGGC GAA AGGGAGCC | 7583 | GGCUCCCUU AUGAUGCC | 441 |
| 2693 | UGGCAUCA CUGAUGA GCCGUUAGGC GAA AAGGGAGC | 7584 | GCUCCCUUA UGAUGCCA | 442 |
| 2714 | CCCGGGCA CUGAUGA GCCGUUAGGC GAA ACUCCCAC | 7585 | GUGGGAGUU UGCCCGGG | 443 |
| 2715 | UCCCGGGC CUGAUGA GCCGUUAGGC GAA AACUCCCA | 7586 | UGGGAGUUU GCCCGGGA | 444 |
| 2730 | CCCAGUUU CUGAUGA GCCGUUAGGC GAA AGUCUCUC | 7587 | GAGAGACUU AAACUGGG | 445 |
| 2731 | GCCCAGUU CUGAUGA GCCGUUAGGC GAA AAGUCUCU | 7588 | AGAGACUUA AACUGGGC | 446 |
| 2744 | UUCCAAGU CUGAUGA GCCGUUAGGC GAA AUUUGCCC | 7589 | GGGCAAAUC ACUUGGAA | 447 |
| 2748 | CCUCUUCC CUGAUGA GCCGUUAGGC GAA AGUGAUUU | 7590 | AAAUCACUU GGAAGAGG | 448 |
| 2761 | UUUUCCAA CUGAUGA GCCGUUAGGC GAA AGCCCCUC | 7591 | GAGGGGCUU UUGGAAAA | 449 |
| 2762 | CUUUUCCA CUGAUGA GCCGUUAGGC GAA AAGCCCCU | 7592 | AGGGGCUUU UGGAAAAG | 450 |
| 2763 | ACUUUUCC CUGAUGA GCCGUUAGGC GAA AAAGCCCC | 7593 | GGGGCUUUU GGAAAAGU | 451 |
| 2775 | GAUGCUUG CUGAUGA GCCGUUAGGC GAA ACCACUUU | 7594 | AAAGUGGUU CAAGCAUC | 452 |
| 2776 | UGAUGCUU CUGAUGA GCCGUUAGGC GAA AACCACUU | 7595 | AAGUGGUUC AAGCAUCA | 453 |
| 2783 | CAAAUGCU CUGAUGA GCCGUUAGGC GAA AUGCUUGA | 7596 | UCAAGCAUC AGCAUUUG | 454 |
| 2789 | UAAUGCCA CUGAUGA GCCGUUAGGC GAA AUGCUGAU | 7597 | AUCAGCAUU UGGCAUUA | 455 |
| 2790 | UUAAUGCC CUGAUGA GCCGUUAGGC GAA AAUGCUGA | 7598 | UCAGCAUUU GGCAUUAA | 456 |
| 2796 | GAUUUCUU CUGAUGA GCCGUUAGGC GAA AUGCCAAA | 7599 | UUUGGCAUU AAGAAAUC | 457 |
| 2797 | UGAUUUCU CUGAUGA GCCGUUAGGC GAA AAUGCCAA | 7600 | UUGGCAUUA AGAAAUCA | 458 |

87

| | | | | |
|---|---|---|---|---|
| 2804 | ACGUAGGU CUGAUGA GCCGUUAGGC GAA AUUUCUUA | 7601 | UAAGAAAUC ACCUACGU | 459 |
| 2809 | CCGGCACG CUGAUGA GCCGUUAGGC GAA AGGUGAUU | 7602 | AAUCACCUA CGUGCCGG | 460 |
| 2864 | GAGCUUUG CUGAUGA GCCGUUAGGC GAA ACUCGCUG | 7603 | CAGCGAGUA CAAAGCUC | 461 |
| 2872 | AGUCAUCA CUGAUGA GCCGUUAGGC GAA AGCUUUGU | 7604 | ACAAAGCUC UGAUGACU | 462 |
| 2886 | AAGAUUUU CUGAUGA GCCGUUAGGC GAA AGCUCAGU | 7605 | ACUGAGCUA AAAAUCUU | 463 |
| 2892 | UGGGUCAA CUGAUGA GCCGUUAGGC GAA AUUUUUAG | 7606 | CUAAAAAUC UUGACCCA | 464 |
| 2894 | UGUGGGUC CUGAUGA GCCGUUAGGC GAA AGAUUUUU | 7607 | AAAAAUCUU GACCCACA | 465 |
| 2904 | UGGUGGCC CUGAUGA GCCGUUAGGC GAA AUGUGGGU | 7608 | ACCCACAUU GGCCACCA | 466 |
| 2914 | CACGUUCA CUGAUGA GCCGUUAGGC GAA AUGGUGGC | 7609 | GCCACCAUC UGAACGUG | 467 |
| 2925 | AGCAGGUU CUGAUGA GCCGUUAGGC GAA ACCACGUU | 7610 | AACGUGGUU AACCUGCU | 468 |
| 2926 | CAGCAGGU CUGAUGA GCCGUUAGGC GAA AACCACGU | 7611 | ACGUGGUUA ACCUGCUG | 469 |
| 2962 | CACCAUCA CUGAUGA GCCGUUAGGC GAA AGGCCCUC | 7612 | GAGGGCCUC UGAUGGUG | 470 |
| 2973 | UAUUCAAC CUGAUGA GCCGUUAGGC GAA AUCACCAU | 7613 | AUGGUGAUU GUUGAAUA | 471 |
| 2976 | CAGUAUUC CUGAUGA GCCGUUAGGC GAA ACAAUCAC | 7614 | GUGAUUGUU GAAUACUG | 472 |
| 2981 | AUUUGCAG CUGAUGA GCCGUUAGGC GAA AUUCAACA | 7615 | UGUUGAAUA CUGCAAAU | 473 |
| 2990 | GAUUUCCA CUGAUGA GCCGUUAGGC GAA AUUUGCAG | 7616 | CUGCAAAUA UGGAAAUC | 474 |
| 2998 | GUUGGAGA CUGAUGA GCCGUUAGGC GAA AUUUCCAU | 7617 | AUGGAAAUC UCUCCAAC | 475 |
| 3000 | UAGUUGGA CUGAUGA GCCGUUAGGC GAA AGAUUUCC | 7618 | GGAAAUCUC UCCAACUA | 476 |
| 3002 | GGUAGUUG CUGAUGA GCCGUUAGGC GAA AGAGAUUU | 7619 | AAAUCUCUC CAACUACC | 477 |
| 3008 | UCUUGAGG CUGAUGA GCCGUUAGGC GAA AGUUGGAG | 7620 | CUCCAACUA CCUCAAGA | 478 |
| 3012 | UUGCUCUU CUGAUGA GCCGUUAGGC GAA AGGUAGUU | 7621 | AACUACCUC AAGAGCAA | 479 |
| 3029 | GAAAAAAU CUGAUGA GCCGUUAGGC GAA AGUCACGU | 7622 | ACGUGACUU AUUUUUUC | 480 |
| 3030 | AGAAAAAA CUGAUGA GCCGUUAGGC GAA AAGUCACG | 7623 | CGUGACUUA UUUUUUCU | 481 |
| 3032 | UGAGAAAA CUGAUGA GCCGUUAGGC GAA AUAAGUCA | 7624 | UGACUUAUU UUUUCUCA | 482 |
| 3033 | UUGAGAAA CUGAUGA GCCGUUAGGC GAA AAUAAGUC | 7625 | GACUUAUUU UUUCUCAA | 483 |
| 3034 | GUUGAGAA CUGAUGA GCCGUUAGGC GAA AAAUAAGU | 7626 | ACUUAUUUU UUCUCAAC | 484 |
| 3035 | UGUUGAGA CUGAUGA GCCGUUAGGC GAA AAAAUAAG | 7627 | CUUAUUUUU UCUCAACA | 485 |
| 3036 | UUGUUGAG CUGAUGA GCCGUUAGGC GAA AAAAAUAA | 7628 | UUAUUUUUU CUCAACAA | 486 |
| 3037 | CUUGUUGA CUGAUGA GCCGUUAGGC GAA AAAAAAUA | 7629 | UAUUUUUUC UCAACAAG | 487 |
| 3039 | UCCUUGUU CUGAUGA GCCGUUAGGC GAA AGAAAAAA | 7630 | UUUUUUCUC AACAAGGA | 488 |
| 3057 | UCCAUGUG CUGAUGA GCCGUUAGGC GAA AGUGCUGC | 7631 | GCAGCACUA CACAUGGA | 489 |
| 3070 | UUCUUUCU CUGAUGA GCCGUUAGGC GAA AGGCUCCA | 7632 | UGGAGCCUA AGAAAGAA | 490 |
| 3120 | ACGCUAUC CUGAUGA GCCGUUAGGC GAA AGUCUUGG | 7633 | CCAAGACUA GAUAGCGU | 491 |

| | | | | |
|---|---|---|---|---|
| 3124 | GGUGACGC CUGAUGA GCCGUUAGGC GAA AUCUAGUC | 7634 | GACUAGAUA GCGUCACC | 492 |
| 3129 | CUGCUGGU CUGAUGA GCCGUUAGGC GAA ACGCUAUC | 7635 | GAUAGCGUC ACCAGCAG | 493 |
| 3146 | AGCUCGCA CUGAUGA GCCGUUAGGC GAA AGCUUUCG | 7636 | CGAAAGCUU UGCGAGCU | 494 |
| 3147 | GAGCUCGC CUGAUGA GCCGUUAGGC GAA AAGCUUUC | 7637 | GAAAGCUUU GCGAGCUC | 495 |
| 3155 | GAAAGCCG CUGAUGA GCCGUUAGGC GAA AGCUCGCA | 7638 | UGCGAGCUC CGGCUUUC | 496 |
| 3161 | CUUCCUGA CUGAUGA GCCGUUAGGC GAA AGCCGGAG | 7639 | CUCCGGCUU UCAGGAAG | 497 |
| 3162 | UCUUCCUG CUGAUGA GCCGUUAGGC GAA AAGCCGGA | 7640 | UCCGGCUUU CAGGAAGA | 498 |
| 3163 | AUCUUCCU CUGAUGA GCCGUUAGGC GAA AAAGCCGG | 7641 | CCGGCUUUC AGGAAGAU | 499 |
| 3172 | CAGACUUU CUGAUGA GCCGUUAGGC GAA AUCUUCCU | 7642 | AGGAAGAUA AAAGUCUG | 500 |
| 3178 | AUCACUCA CUGAUGA GCCGUUAGGC GAA ACUUUUAU | 7643 | AUAAAAGUC UGAGUGAU | 501 |
| 3189 | UCUUCCUC CUGAUGA GCCGUUAGGC GAA ACAUCACU | 7644 | AGUGAUGUU GAGGAAGA | 502 |
| 3205 | ACCGUCAG CUGAUGA GCCGUUAGGC GAA AUCCUCCU | 7645 | AGGAGGAUU CUGACGGU | 503 |
| 3206 | AACCGUCA CUGAUGA GCCGUUAGGC GAA AAUCCUCC | 7646 | GGAGGAUUC UGACGGUU | 504 |
| 3214 | CUUGUAGA CUGAUGA GCCGUUAGGC GAA ACCGUCAG | 7647 | CUGACGGUU UCUACAAG | 505 |
| 3215 | CCUUGUAG CUGAUGA GCCGUUAGGC GAA AACCGUCA | 7648 | UGACGGUUU CUACAAGG | 506 |
| 3216 | UCCUUGUA CUGAUGA GCCGUUAGGC GAA AAACCGUC | 7649 | GACGGUUUC UACAAGGA | 507 |
| 3218 | GCUCCUUG CUGAUGA GCCGUUAGGC GAA AGAAACCG | 7650 | CGGUUUCUA CAAGGAGC | 508 |
| 3231 | UCCAUAGU CUGAUGA GCCGUUAGGC GAA AUGGGCUC | 7651 | GAGCCCAUC ACUAUGGA | 509 |
| 3235 | AUCUUCCA CUGAUGA GCCGUUAGGC GAA AGUGAUGG | 7652 | CCAUCACUA UGGAAGAU | 510 |
| 3244 | AGAAAUCA CUGAUGA GCCGUUAGGC GAA AUCUUCCA | 7653 | UGGAAGAUC UGAUUUCU | 511 |
| 3249 | CUGUAAGA CUGAUGA GCCGUUAGGC GAA AUCAGAUC | 7654 | GAUCUGAUU UCUUACAG | 512 |
| 3250 | ACUGUAAG CUGAUGA GCCGUUAGGC GAA AAUCAGAU | 7655 | AUCUGAUUU CUUACAGU | 513 |
| 3251 | AACUGUAA CUGAUGA GCCGUUAGGC GAA AAAUCAGA | 7656 | UCUGAUUUC UUACAGUU | 514 |
| 3253 | AAAACUGU CUGAUGA GCCGUUAGGC GAA AGAAAUCA | 7657 | UGAUUUCUU ACAGUUUU | 515 |
| 3254 | GAAAACUG CUGAUGA GCCGUUAGGC GAA AAGAAAUC | 7658 | GAUUUCUUA CAGUUUUC | 516 |
| 3259 | CACUUGAA CUGAUGA GCCGUUAGGC GAA ACUGUAAG | 7659 | CUUACAGUU UUCAAGUG | 517 |
| 3260 | CCACUUGA CUGAUGA GCCGUUAGGC GAA AACUGUAA | 7660 | UUACAGUUU UCAAGUGG | 518 |
| 3261 | GCCACUUG CUGAUGA GCCGUUAGGC GAA AAACUGUA | 7661 | UACAGUUUU CAAGUGGC | 519 |
| 3262 | GGCCACUU CUGAUGA GCCGUUAGGC GAA AAAACUGU | 7662 | ACAGUUUUC AAGUGGCC | 520 |
| 3284 | AAGACAGG CUGAUGA GCCGUUAGGC GAA ACUCCAUG | 7663 | CAUGGAGUU CCUGUCUU | 521 |
| 3285 | GAAGACAG CUGAUGA GCCGUUAGGC GAA AACUCCAU | 7664 | AUGGAGUUC CUGUCUUC | 522 |
| 3290 | UUCUGGAA CUGAUGA GCCGUUAGGC GAA ACAGGAAC | 7665 | GUUCCUGUC UUCCAGAA | 523 |
| 3292 | CUUUCUGG CUGAUGA GCCGUUAGGC GAA AGACAGGA | 7666 | UCCUGUCUU CCAGAAAG | 524 |

| | | | | |
|---|---|---|---|---|
| 3293 | ACUUUCUG CUGAUGA GCCGUUAGGC GAA AAGACAGG | 7667 | CCUGUCUUC CAGAAAGU | 525 |
| 3306 | UCCCGAUG CUGAUGA GCCGUUAGGC GAA AUGCACUU | 7668 | AAGUGCAUU CAUCGGGA | 526 |
| 3307 | GUCCCGAU CUGAUGA GCCGUUAGGC GAA AAUGCACU | 7669 | AGUGCAUUC AUCGGGAC | 527 |
| 3310 | CAGGUCCC CUGAUGA GCCGUUAGGC GAA AUGAAUGC | 7670 | GCAUUCAUC GGGACCUG | 528 |
| 3333 | GAUAAAAG CUGAUGA GCCGUUAGGC GAA AUGUUUCU | 7671 | AGAAACAUU CUUUUAUC | 529 |
| 3334 | AGAUAAAA CUGAUGA GCCGUUAGGC GAA AAUGUUUC | 7672 | GAAACAUUC UUUUAUCU | 530 |
| 3336 | UCAGAUAA CUGAUGA GCCGUUAGGC GAA AGAAUGUU | 7673 | AACAUUCUU UUAUCUGA | 531 |
| 3337 | CUCAGAUA CUGAUGA GCCGUUAGGC GAA AAGAAUGU | 7674 | ACAUUCUUU UAUCUGAG | 532 |
| 3338 | UCUCAGAU CUGAUGA GCCGUUAGGC GAA AAAGAAUG | 7675 | CAUUCUUUU AUCUGAGA | 533 |
| 3339 | UUCUCAGA CUGAUGA GCCGUUAGGC GAA AAAAGAAU | 7676 | AUUCUUUUA UCUGAGAA | 534 |
| 3341 | UGUUCUCA CUGAUGA GCCGUUAGGC GAA AUAAAAGA | 7677 | UCUUUUAUC UGAGAACA | 535 |
| 3363 | AAAUCACA CUGAUGA GCCGUUAGGC GAA AUCUUCAC | 7678 | GUGAAGAUU UGUGAUUU | 536 |
| 3364 | AAAAUCAC CUGAUGA GCCGUUAGGC GAA AAUCUUCA | 7679 | UGAAGAUUU GUGAUUUU | 537 |
| 3370 | AAGGCCAA CUGAUGA GCCGUUAGGC GAA AUCACAAA | 7680 | UUUGUGAUU UUGGCCUU | 538 |
| 3371 | CAAGGCCA CUGAUGA GCCGUUAGGC GAA AAUCACAA | 7681 | UUGUGAUUU UGGCCUUG | 539 |
| 3372 | GCAAGGCC CUGAUGA GCCGUUAGGC GAA AAAUCACA | 7682 | UGUGAUUUU GGCCUUGC | 540 |
| 3378 | UCCCGGGC CUGAUGA GCCGUUAGGC GAA AGGCCAAA | 7683 | UUUGGCCUU GCCCGGGA | 541 |
| 3388 | CUUAUAAA CUGAUGA GCCGUUAGGC GAA AUCCCGGG | 7684 | CCCGGGAUA UUUAUAAG | 542 |
| 3390 | UUCUUAUA CUGAUGA GCCGUUAGGC GAA AUAUCCCG | 7685 | CGGGAUAUU UAUAAGAA | 543 |
| 3391 | GUUCUUAU CUGAUGA GCCGUUAGGC GAA AAUAUCCC | 7686 | GGGAUAUUU AUAAGAAC | 544 |
| 3392 | GGUUCUUA CUGAUGA GCCGUUAGGC GAA AAAUAUCC | 7687 | GGAUAUUUA UAAGAACC | 545 |
| 3394 | GGGGUUCU CUGAUGA GCCGUUAGGC GAA AUAAAUAU | 7688 | AUAUUUAUA AGAACCCC | 546 |
| 3406 | UCUCACAU CUGAUGA GCCGUUAGGC GAA AUCGGGGU | 7689 | ACCCCGAUU AUGUGAGA | 547 |
| 3407 | UUCUCACA CUGAUGA GCCGUUAGGC GAA AAUCGGGG | 7690 | CCCCGAUUA UGUGAGAA | 548 |
| 3424 | AAGUCGAG CUGAUGA GCCGUUAGGC GAA AUCUCCUU | 7691 | AAGGAGAUA CUCGACUU | 549 |
| 3427 | AGGAAGUC CUGAUGA GCCGUUAGGC GAA AGUAUCUC | 7692 | GAGAUACUC GACUUCCU | 550 |
| 3432 | UUCAGAGG CUGAUGA GCCGUUAGGC GAA AGUCGAGU | 7693 | ACUCGACUU CCUCUGAA | 551 |
| 3433 | UUUCAGAG CUGAUGA GCCGUUAGGC GAA AAGUCGAG | 7694 | CUCGACUUC CUCUGAAA | 552 |
| 3436 | CCAUUUCA CUGAUGA GCCGUUAGGC GAA AGGAAGUC | 7695 | GACUUCCUC UGAAAUGG | 553 |
| 3451 | AGAUUCGG CUGAUGA GCCGUUAGGC GAA AGCCAUCC | 7696 | GGAUGGCUC CCGAAUCU | 554 |
| 3458 | CAAAGAUA CUGAUGA GCCGUUAGGC GAA AUUCGGGA | 7697 | UCCCGAAUC UAUCUUUG | 555 |
| 3460 | GUCAAAGA CUGAUGA GCCGUUAGGC GAA AGAUUCGG | 7698 | CCGAAUCUA UCUUUGAC | 556 |
| 3462 | UUGUCAAA CUGAUGA GCCGUUAGGC GAA AUAGAUUC | 7699 | GAAUCUAUC UUUGACAA | 557 |

| | | | | |
|---|---|---|---|---|
| 3464 | UUUUGUCA CUGAUGA GCCGUUAGGC GAA AGAUAGAU | 7700 | AUCUAUCUU UGACAAAA | 558 |
| 3465 | AUUUUGUC CUGAUGA GCCGUUAGGC GAA AAGAUAGA | 7701 | UCUAUCUUU GACAAAAU | 559 |
| 3474 | GUGCUGUA CUGAUGA GCCGUUAGGC GAA AUUUUGUC | 7702 | GACAAAAUC UACAGCAC | 560 |
| 3476 | UGGUGCUG CUGAUGA GCCGUUAGGC GAA AGAUUUUG | 7703 | CAAAAUCUA CAGCACCA | 561 |
| 3500 | CUCCGUAA CUGAUGA GCCGUUAGGC GAA ACCACACG | 7704 | CGUGUGGUC UUACGGAG | 562 |
| 3502 | UACUCCGU CUGAUGA GCCGUUAGGC GAA AGACCACA | 7705 | UGUGGUCUU ACGGAGUA | 563 |
| 3503 | AUACUCCG CUGAUGA GCCGUUAGGC GAA AAGACCAC | 7706 | GUGGUCUUA CGGAGUAU | 564 |
| 3510 | CACAGCAA CUGAUGA GCCGUUAGGC GAA ACUCCGUA | 7707 | UACGGAGUA UUGCUGUG | 565 |
| 3512 | CCCACAGC CUGAUGA GCCGUUAGGC GAA AUACUCCG | 7708 | CGGAGUAUU GCUGUGGG | 566 |
| 3525 | AAGGAGAA CUGAUGA GCCGUUAGGC GAA AUUUCCCA | 7709 | UGGGAAAUC UUCUCCUU | 567 |
| 3527 | CUAAGGAG CUGAUGA GCCGUUAGGC GAA AGAUUUCC | 7710 | GGAAAUCUU CUCCUUAG | 568 |
| 3528 | CCUAAGGA CUGAUGA GCCGUUAGGC GAA AAGAUUUC | 7711 | GAAAUCUUC UCCUUAGG | 569 |
| 3530 | CACCUAAG CUGAUGA GCCGUUAGGC GAA AGAAGAUU | 7712 | AAUCUUCUC CUUAGGUG | 570 |
| 3533 | ACCCACCU CUGAUGA GCCGUUAGGC GAA AGGAGAAG | 7713 | CUUCUCCUU AGGUGGGU | 571 |
| 3534 | GACCCACC CUGAUGA GCCGUUAGGC GAA AAGGAGAA | 7714 | UUCUCCUUA GGUGGGUC | 572 |
| 3542 | GGUAUGGA CUGAUGA GCCGUUAGGC GAA ACCCACCU | 7715 | AGGUGGGUC UCCAUACC | 573 |
| 3544 | UGGGUAUG CUGAUGA GCCGUUAGGC GAA AGACCCAC | 7716 | GUGGGUCUC CAUACCCA | 574 |
| 3548 | CUCCUGGG CUGAUGA GCCGUUAGGC GAA AUGGAGAC | 7717 | GUCUCCAUA CCCAGGAG | 575 |
| 3558 | UCCAUUUG CUGAUGA GCCGUUAGGC GAA ACUCCUGG | 7718 | CCAGGAGUA CAAAUGGA | 576 |
| 3575 | GACUGCAA CUGAUGA GCCGUUAGGC GAA AGUCCUCA | 7719 | UGAGGACUU UUGCAGUC | 577 |
| 3576 | CGACUGCA CUGAUGA GCCGUUAGGC GAA AAGUCCUC | 7720 | GAGGACUUU UGCAGUCG | 578 |
| 3577 | GCGACUGC CUGAUGA GCCGUUAGGC GAA AAAGUCCU | 7721 | AGGACUUUU GCAGUCGC | 579 |
| 3583 | CCUCAGGC CUGAUGA GCCGUUAGGC GAA ACUGCAAA | 7722 | UUUGCAGUC GCCUGAGG | 580 |
| 3613 | GUACUCAG CUGAUGA GCCGUUAGGC GAA AGCUCUCA | 7723 | UGAGAGCUC CUGAGUAC | 581 |
| 3620 | GAGUAGAG CUGAUGA GCCGUUAGGC GAA ACUCAGGA | 7724 | UCCUGAGUA CUCUACUC | 582 |
| 3623 | CAGGAGUA CUGAUGA GCCGUUAGGC GAA AGUACUCA | 7725 | UGAGUACUC UACUCCUG | 583 |
| 3625 | UUCAGGAG CUGAUGA GCCGUUAGGC GAA AGAGUACU | 7726 | AGUACUCUA CUCCUGAA | 584 |
| 3628 | GAUUUCAG CUGAUGA GCCGUUAGGC GAA AGUAGAGU | 7727 | ACUCUACUC CUGAAAUC | 585 |
| 3636 | AUCUGAUA CUGAUGA GCCGUUAGGC GAA AUUUCAGG | 7728 | CCUGAAAUC UAUCAGAU | 586 |
| 3638 | UGAUCUGA CUGAUGA GCCGUUAGGC GAA AGAUUUCA | 7729 | UGAAAUCUA UCAGAUCA | 587 |
| 3640 | CAUGAUCU CUGAUGA GCCGUUAGGC GAA AUAGAUUU | 7730 | AAAUCUAUC AGAUCAUG | 588 |
| 3645 | UCCAGCAU CUGAUGA GCCGUUAGGC GAA AUCUGAUA | 7731 | UAUCAGAUC AUGCUGGA | 589 |
| 3689 | GUUCUGCA CUGAUGA GCCGUUAGGC GAA AUCUUGGC | 7732 | GCCAAGAUU UGCAGAAC | 590 |

91

| | | | | |
|---|---|---|---|---|
| 3690 | AGUUCUGC CUGAUGA GCCGUUAGGC GAA AAUCUUGG | 7733 | CCAAGAUUU GCAGAACU | 591 |
| 3699 | UUUUCCAC CUGAUGA GCCGUUAGGC GAA AGUUCUGC | 7734 | GCAGAACUU GUGGAAAA | 592 |
| 3711 | AAAUCACC CUGAUGA GCCGUUAGGC GAA AGUUUUUC | 7735 | GAAAAACUA GGUGAUUU | 593 |
| 3718 | UUGAAGCA CUGAUGA GCCGUUAGGC GAA AUCACCUA | 7736 | UAGGUGAUU UGCUUCAA | 594 |
| 3719 | CUUGAAGC CUGAUGA GCCGUUAGGC GAA AAUCACCU | 7737 | AGGUGAUUU GCUUCAAG | 595 |
| 3723 | UUUGCUUG CUGAUGA GCCGUUAGGC GAA AGCAAAUC | 7738 | GAUUUGCUU CAAGCAAA | 596 |
| 3724 | AUUUGCUU CUGAUGA GCCGUUAGGC GAA AAGCAAAU | 7739 | AUUUGCUUC AAGCAAAU | 597 |
| 3735 | UCCUGUUG CUGAUGA GCCGUUAGGC GAA ACAUUUGC | 7740 | GCAAAUGUA CAACAGGA | 598 |
| 3748 | GUAGUCUU CUGAUGA GCCGUUAGGC GAA ACCAUCCU | 7741 | AGGAUGGUA AAGACUAC | 599 |
| 3755 | UUGGGAUG CUGAUGA GCCGUUAGGC GAA AGUCUUUA | 7742 | UAAAGACUA CAUCCCAA | 600 |
| 3759 | UUGAUUGG CUGAUGA GCCGUUAGGC GAA AUGUAGUC | 7743 | GACUACAUC CCAAUCAA | 601 |
| 3765 | AUGGCAUU CUGAUGA GCCGUUAGGC GAA AUUGGGAU | 7744 | AUCCCAAUC AAUGCCAU | 602 |
| 3774 | CCUGUCAG CUGAUGA GCCGUUAGGC GAA AUGGCAUU | 7745 | AAUGCCAUA CUGACAGG | 603 |
| 3787 | AAACCCAC CUGAUGA GCCGUUAGGC GAA AUUUCCUG | 7746 | CAGGAAAUA GUGGGUUU | 604 |
| 3794 | AGUAUGUA CUGAUGA GCCGUUAGGC GAA ACCCACUA | 7747 | UAGUGGGUU UACAUACU | 605 |
| 3795 | GAGUAUGU CUGAUGA GCCGUUAGGC GAA AACCCACU | 7748 | AGUGGGUUU ACAUACUC | 606 |
| 3796 | UGAGUAUG CUGAUGA GCCGUUAGGC GAA AAACCCAC | 7749 | GUGGGUUUA CAUACUCA | 607 |
| 3800 | GAGUUGAG CUGAUGA GCCGUUAGGC GAA AUGUAAAC | 7750 | GUUUACAUA CUCAACUC | 608 |
| 3803 | CAGGAGUU CUGAUGA GCCGUUAGGC GAA AGUAUGUA | 7751 | UACAUACUC AACUCCUG | 609 |
| 3808 | GAAGGCAG CUGAUGA GCCGUUAGGC GAA AGUUGAGU | 7752 | ACUCAACUC CUGCCUUC | 610 |
| 3815 | CCUCAGAG CUGAUGA GCCGUUAGGC GAA AGGCAGGA | 7753 | UCCUGCCUU CUCUGAGG | 611 |
| 3816 | UCCUCAGA CUGAUGA GCCGUUAGGC GAA AAGGCAGG | 7754 | CCUGCCUUC UCUGAGGA | 612 |
| 3818 | AGUCCUCA CUGAUGA GCCGUUAGGC GAA AGAAGGCA | 7755 | UGCCUUCUC UGAGGACU | 613 |
| 3827 | CCUUGAAG CUGAUGA GCCGUUAGGC GAA AGUCCUCA | 7756 | UGAGGACUU CUUCAAGG | 614 |
| 3828 | UCCUUGAA CUGAUGA GCCGUUAGGC GAA AAGUCCUC | 7757 | GAGGACUUC UUCAAGGA | 615 |
| 3830 | UUUCCUUG CUGAUGA GCCGUUAGGC GAA AGAAGUCC | 7758 | GGACUUCUU CAAGGAAA | 616 |
| 3831 | CUUUCCUU CUGAUGA GCCGUUAGGC GAA AAGAAGUC | 7759 | GACUUCUUC AAGGAAAG | 617 |
| 3841 | AGCUGAAA CUGAUGA GCCGUUAGGC GAA ACUUUCCU | 7760 | AGGAAAGUA UUUCAGCU | 618 |
| 3843 | GGAGCUGA CUGAUGA GCCGUUAGGC GAA AUACUUUC | 7761 | GAAAGUAUU UCAGCUCC | 619 |
| 3844 | CGGAGCUG CUGAUGA GCCGUUAGGC GAA AAUACUUU | 7762 | AAAGUAUUU CAGCUCCG | 620 |
| 3845 | UCGGAGCU CUGAUGA GCCGUUAGGC GAA AAAUACUU | 7763 | AAGUAUUUC AGCUCCGA | 621 |
| 3850 | AAACUUCG CUGAUGA GCCGUUAGGC GAA AGCUGAAA | 7764 | UUUCAGCUC CGAAGUUU | 622 |
| 3857 | CUGAAUUA CUGAUGA GCCGUUAGGC GAA ACUUCGGA | 7765 | UCCGAAGUU UAAUUCAG | 623 |

| | | | | |
|---|---|---|---|---|
| 3858 | CCUGAAUU CUGAUGA GCCGUUAGGC GAA AACUUCGG | 7766 | CCGAAGUUU AAUUCAGG | 624 |
| 3859 | UCCUGAAU CUGAUGA GCCGUUAGGC GAA AAACUUCG | 7767 | CGAAGUUUA AUUCAGGA | 625 |
| 3862 | GCUUCCUG CUGAUGA GCCGUUAGGC GAA AUUAAACU | 7768 | AGUUUAAUU CAGGAAGC | 626 |
| 3863 | AGCUUCCU CUGAUGA GCCGUUAGGC GAA AAUUAAAC | 7769 | GUUUAAUUC AGGAAGCU | 627 |
| 3872 | CAUCAUCA CUGAUGA GCCGUUAGGC GAA AGCUUCCU | 7770 | AGGAAGCUC UGAUGAUG | 628 |
| 3882 | ACAUAUCU CUGAUGA GCCGUUAGGC GAA ACAUCAUC | 7771 | GAUGAUGUC AGAUAUGU | 629 |
| 3887 | CAUUUACA CUGAUGA GCCGUUAGGC GAA AUCUGACA | 7772 | UGUCAGAUA UGUAAAUG | 630 |
| 3891 | AAAGCAUU CUGAUGA GCCGUUAGGC GAA ACAUAUCU | 7773 | AGAUAUGUA AAUGCUUU | 631 |
| 3898 | GAACUUGA CUGAUGA GCCGUUAGGC GAA AGCAUUUA | 7774 | UAAAUGCUU UCAAGUUC | 632 |
| 3899 | UGAACUUG CUGAUGA GCCGUUAGGC GAA AAGCAUUU | 7775 | AAAUGCUUU CAAGUUCA | 633 |
| 3900 | AUGAACUU CUGAUGA GCCGUUAGGC GAA AAAGCAUU | 7776 | AAUGCUUUC AAGUUCAU | 634 |
| 3905 | GGCUCAUG CUGAUGA GCCGUUAGGC GAA ACUUGAAA | 7777 | UUUCAAGUU CAUGAGCC | 635 |
| 3906 | AGGCUCAU CUGAUGA GCCGUUAGGC GAA AACUUGAA | 7778 | UUCAAGUUC AUGAGCCU | 636 |
| 3924 | AAGGUUUU CUGAUGA GCCGUUAGGC GAA AUUCUUUC | 7779 | GAAAGAAUC AAAACCUU | 637 |
| 3932 | GUUCUUCA CUGAUGA GCCGUUAGGC GAA AGGUUUUG | 7780 | CAAAACCUU UGAAGAAC | 638 |
| 3933 | AGUUCUUC CUGAUGA GCCGUUAGGC GAA AAGGUUUU | 7781 | AAAACCUUU GAAGAACU | 639 |
| 3942 | UUCGGUAA CUGAUGA GCCGUUAGGC GAA AGUUCUUC | 7782 | GAAGAACUU UUACCGAA | 640 |
| 3943 | AUUCGGUA CUGAUGA GCCGUUAGGC GAA AAGUUCUU | 7783 | AAGAACUUU UACCGAAU | 641 |
| 3944 | CAUUCGGU CUGAUGA GCCGUUAGGC GAA AAAGUUCU | 7784 | AGAACUUUU ACCGAAUG | 642 |
| 3945 | GCAUUCGG CUGAUGA GCCGUUAGGC GAA AAAAGUUC | 7785 | GAACUUUUA CCGAAUGC | 643 |
| 3959 | CAAACAUG CUGAUGA GCCGUUAGGC GAA AGGUGGCA | 7786 | UGCCACCUC CAUGUUUG | 644 |
| 3965 | AGUCAUCA CUGAUGA GCCGUUAGGC GAA ACAUGGAG | 7787 | CUCCAUGUU UGAUGACU | 645 |
| 3966 | UAGUCAUC CUGAUGA GCCGUUAGGC GAA AACAUGGA | 7788 | UCCAUGUUU GAUGACUA | 646 |
| 3974 | CGCCCUGG CUGAUGA GCCGUUAGGC GAA AGUCAUCA | 7789 | UGAUGACUA CCAGGGCG | 647 |
| 3994 | GGCCAACA CUGAUGA GCCGUUAGGC GAA AGUGCUGC | 7790 | GCAGCACUC UGUUGGCC | 648 |
| 3998 | GAGAGGCC CUGAUGA GCCGUUAGGC GAA ACAGAGUG | 7791 | CACUCUGUU GGCCUCUC | 649 |
| 4004 | GCAUGGGA CUGAUGA GCCGUUAGGC GAA AGGCCAAC | 7792 | GUUGGCCUC UCCCAUGC | 650 |
| 4006 | CAGCAUGG CUGAUGA GCCGUUAGGC GAA AGAGGCCA | 7793 | UGGCCUCUC CCAUGCUG | 651 |
| 4022 | UCCAGGUG CUGAUGA GCCGUUAGGC GAA AGCGCUUC | 7794 | GAAGCGCUU CACCUGGA | 652 |
| 4023 | GUCCAGGU CUGAUGA GCCGUUAGGC GAA AAGCGCUU | 7795 | AAGCGCUUC ACCUGGAC | 653 |
| 4052 | UCUUGAGC CUGAUGA GCCGUUAGGC GAA AGGCCUUG | 7796 | CAAGGCCUC GCUCAAGA | 654 |
| 4056 | UCAAUCUU CUGAUGA GCCGUUAGGC GAA AGCGAGGC | 7797 | GCCUCGCUC AAGAUUGA | 655 |
| 4062 | CUCAAGUC CUGAUGA GCCGUUAGGC GAA AUCUUGAG | 7798 | CUCAAGAUU GACUUGAG | 656 |

93

| | | | | |
|---|---|---|---|---|
| 4067 | UUACUCUC CUGAUGA GCCGUUAGGC GAA AGUCAAUC | 7799 | GAUUGACUU GAGAGUAA | 657 |
| 4074 | UUACUGGU CUGAUGA GCCGUUAGGC GAA ACUCUCAA | 7800 | UUGAGAGUA ACCAGUAA | 658 |
| 4081 | CUUACUUU CUGAUGA GCCGUUAGGC GAA ACUGGUUA | 7801 | UAACCAGUA AAAGUAAG | 659 |
| 4087 | CGACUCCU CUGAUGA GCCGUUAGGC GAA ACUUUUAC | 7802 | GUAAAAGUA AGGAGUCG | 660 |
| 4094 | ACAGCCCC CUGAUGA GCCGUUAGGC GAA ACUCCUUA | 7803 | UAAGGAGUC GGGGCUGU | 661 |
| 4103 | UGACAUCA CUGAUGA GCCGUUAGGC GAA ACAGCCCC | 7804 | GGGGCUGUC UGAUGUCA | 662 |
| 4110 | GGCCUGCU CUGAUGA GCCGUUAGGC GAA ACAUCAGA | 7805 | UCUGAUGUC AGCAGGCC | 663 |
| 4123 | AUGGCAGA CUGAUGA GCCGUUAGGC GAA ACUGGGCC | 7806 | GGCCCAGUU UCUGCCAU | 664 |
| 4124 | AAUGGCAG CUGAUGA GCCGUUAGGC GAA AACUGGGC | 7807 | GCCCAGUUU CUGCCAUU | 665 |
| 4125 | GAAUGGCA CUGAUGA GCCGUUAGGC GAA AAACUGGG | 7808 | CCCAGUUUC UGCCAUUC | 666 |
| 4132 | ACAGCUGG CUGAUGA GCCGUUAGGC GAA AUGGCAGA | 7809 | UCUGCCAUU CCAGCUGU | 667 |
| 4133 | CACAGCUG CUGAUGA GCCGUUAGGC GAA AAUGGCAG | 7810 | CUGCCAUUC CAGCUGUG | 668 |
| 4149 | CCUUCGCU CUGAUGA GCCGUUAGGC GAA ACGUGCCC | 7811 | GGGCACGUC AGCGAAGG | 669 |
| 4169 | CGUAGGUG CUGAUGA GCCGUUAGGC GAA ACCUGCGC | 7812 | GCGCAGGUU CACCUACG | 670 |
| 4170 | UCGUAGGU CUGAUGA GCCGUUAGGC GAA AACCUGCG | 7813 | CGCAGGUUC ACCUACGA | 671 |
| 4175 | CGUGGUCG CUGAUGA GCCGUUAGGC GAA AGGUGAAC | 7814 | GUUCACCUA CGACCACG | 672 |
| 4203 | CAGCACGC CUGAUGA GCCGUUAGGC GAA AUUUUCCU | 7815 | AGGAAAAUC GCGUGCUG | 673 |
| 4214 | GGGGCGGG CUGAUGA GCCGUUAGGC GAA AGCAGCAC | 7816 | GUGCUGCUC CCCGCCCC | 674 |
| 4229 | CCGAGUUG CUGAUGA GCCGUUAGGC GAA AGUCUGGG | 7817 | CCCAGACUA CAACUCGG | 675 |
| 4235 | GGACCACC CUGAUGA GCCGUUAGGC GAA AGUUGUAG | 7818 | CUACAACUC GGUGGUCC | 676 |
| 4242 | GAGUACAG CUGAUGA GCCGUUAGGC GAA ACCACCGA | 7819 | UCGGUGGUC CUGUACUC | 677 |
| 4247 | GGGUGGAG CUGAUGA GCCGUUAGGC GAA ACAGGACC | 7820 | GGUCCUGUA CUCCACCC | 678 |
| 4250 | GUGGGGUG CUGAUGA GCCGUUAGGC GAA AGUACAGG | 7821 | CCUGUACUC CACCCCAC | 679 |
| 4263 | AAACUCUA CUGAUGA GCCGUUAGGC GAA AUGGGUGG | 7822 | CCACCCAUC UAGAGUUU | 680 |
| 4265 | UCAAACUC CUGAUGA GCCGUUAGGC GAA AGAUGGGU | 7823 | ACCCAUCUA GAGUUUGA | 681 |
| 4270 | UCGUGUCA CUGAUGA GCCGUUAGGC GAA ACUCUAGA | 7824 | UCUAGAGUU UGACACGA | 682 |
| 4271 | UUCGUGUC CUGAUGA GCCGUUAGGC GAA AACUCUAG | 7825 | CUAGAGUUU GACACGAA | 683 |
| 4284 | CUAGAAAU CUGAUGA GCCGUUAGGC GAA AGGCUUCG | 7826 | CGAAGCCUU AUUUCUAG | 684 |
| 4285 | UCUAGAAA CUGAUGA GCCGUUAGGC GAA AAGGCUUC | 7827 | GAAGCCUUA UUUCUAGA | 685 |
| 4287 | CUUCUAGA CUGAUGA GCCGUUAGGC GAA AUAAGGCU | 7828 | AGCCUUAUU UCUAGAAG | 686 |
| 4288 | GCUUCUAG CUGAUGA GCCGUUAGGC GAA AAUAAGGC | 7829 | GCCUUAUUU CUAGAAGC | 687 |
| 4289 | UGCUUCUA CUGAUGA GCCGUUAGGC GAA AAAUAAGG | 7830 | CCUUAUUUC UAGAAGCA | 688 |
| 4291 | UGUGCUUC CUGAUGA GCCGUUAGGC GAA AGAAAUAA | 7831 | UUAUUUCUA GAAGCACA | 689 |

| | | | | |
|---|---|---|---|---|
| 4305 | GGUAUAAA CUGAUGA GCCGUUAGGC GAA ACACAUGU | 7832 | ACAUGUGUA UUUAUACC | 690 |
| 4307 | GGGGUAUA CUGAUGA GCCGUUAGGC GAA AUACACAU | 7833 | AUGUGUAUU UAUACCCC | 691 |
| 4308 | GGGGGUAU CUGAUGA GCCGUUAGGC GAA AAUACACA | 7834 | UGUGUAUUU AUACCCCC | 692 |
| 4309 | UGGGGGUA CUGAUGA GCCGUUAGGC GAA AAAUACAC | 7835 | GUGUAUUUA UACCCCCA | 693 |
| 4311 | CCUGGGGG CUGAUGA GCCGUUAGGC GAA AUAAAUAC | 7836 | GUAUUUAUA CCCCCAGG | 694 |
| 4325 | GCAAAAGC CUGAUGA GCCGUUAGGC GAA AGUUUCCU | 7837 | AGGAAACUA GCUUUUGC | 695 |
| 4329 | ACUGGCAA CUGAUGA GCCGUUAGGC GAA AGCUAGUU | 7838 | AACUAGCUU UUGCCAGU | 696 |
| 4330 | UACUGGCA CUGAUGA GCCGUUAGGC GAA AAGCUAGU | 7839 | ACUAGCUUU UGCCAGUA | 697 |
| 4331 | AUACUGGC CUGAUGA GCCGUUAGGC GAA AAAGCUAG | 7840 | CUAGCUUUU GCCAGUAU | 698 |
| 4338 | AUGCAUAA CUGAUGA GCCGUUAGGC GAA ACUGGCAA | 7841 | UUGCCAGUA UUAUGCAU | 699 |
| 4340 | AUAUGCAU CUGAUGA GCCGUUAGGC GAA AUACUGGC | 7842 | GCCAGUAUU AUGCAUAU | 700 |
| 4341 | UAUAUGCA CUGAUGA GCCGUUAGGC GAA AAUACUGG | 7843 | CCAGUAUUA UGCAUAUA | 701 |
| 4347 | AACUUAUA CUGAUGA GCCGUUAGGC GAA AUGCAUAA | 7844 | UUAUGCAUA UAUAAGUU | 702 |
| 4349 | UAAACUUA CUGAUGA GCCGUUAGGC GAA AUAUGCAU | 7845 | AUGCAUAUA UAAGUUUA | 703 |
| 4351 | UGUAAACU CUGAUGA GCCGUUAGGC GAA AUAUAUGC | 7846 | GCAUAUAUA AGUUUACA | 704 |
| 4355 | AAGGUGUA CUGAUGA GCCGUUAGGC GAA ACUUAUAU | 7847 | AUAUAAGUU UACACCUU | 705 |
| 4356 | AAAGGUGU CUGAUGA GCCGUUAGGC GAA AACUUAUA | 7848 | UAUAAGUUU ACACCUUU | 706 |
| 4357 | UAAAGGUG CUGAUGA GCCGUUAGGC GAA AAACUUAU | 7849 | AUAAGUUUA CACCUUUA | 707 |
| 4363 | GAAAGAUA CUGAUGA GCCGUUAGGC GAA AGGUGUAA | 7850 | UUACACCUU UAUCUUUC | 708 |
| 4364 | GGAAAGAU CUGAUGA GCCGUUAGGC GAA AAGGUGUA | 7851 | UACACCUUU AUCUUUCC | 709 |
| 4365 | UGGAAAGA CUGAUGA GCCGUUAGGC GAA AAAGGUGU | 7852 | ACACCUUUA UCUUUCCA | 710 |
| 4367 | CAUGGAAA CUGAUGA GCCGUUAGGC GAA AUAAAGGU | 7853 | ACCUUUAUC UUUCCAUG | 711 |
| 4369 | CCCAUGGA CUGAUGA GCCGUUAGGC GAA AGAUAAAG | 7854 | CUUUAUCUU UCCAUGGG | 712 |
| 4370 | UCCCAUGG CUGAUGA GCCGUUAGGC GAA AAGAUAAA | 7855 | UUUAUCUUU CCAUGGGA | 713 |
| 4371 | CUCCCAUG CUGAUGA GCCGUUAGGC GAA AAAGAUAA | 7856 | UUAUCUUUC CAUGGGAG | 714 |
| 4389 | AUCACAAA CUGAUGA GCCGUUAGGC GAA AGCAGCUG | 7857 | CAGCUGCUU UUUGUGAU | 715 |
| 4390 | AAUCACAA CUGAUGA GCCGUUAGGC GAA AAGCAGCU | 7858 | AGCUGCUUU UUGUGAUU | 716 |
| 4391 | AAAUCACA CUGAUGA GCCGUUAGGC GAA AAAGCAGC | 7859 | GCUGCUUUU UGUGAUUU | 717 |
| 4392 | AAAAUCAC CUGAUGA GCCGUUAGGC GAA AAAAGCAG | 7860 | CUGCUUUUU GUGAUUUU | 718 |
| 4398 | AUUAAAAA CUGAUGA GCCGUUAGGC GAA AUCACAAA | 7861 | UUUGUGAUU UUUUUAAU | 719 |
| 4399 | UAUUAAAA CUGAUGA GCCGUUAGGC GAA AAUCACAA | 7862 | UUGUGAUUU UUUUAAUA | 720 |
| 4400 | CUAUUAAA CUGAUGA GCCGUUAGGC GAA AAAUCACA | 7863 | UGUGAUUUU UUUAAUAG | 721 |
| 4401 | ACUAUUAA CUGAUGA GCCGUUAGGC GAA AAAAUCAC | 7864 | GUGAUUUUU UUAAUAGU | 722 |

| | | | | |
|---|---|---|---|---|
| 4402 | CACUAUUA CUGAUGA GCCGUUAGGC GAA AAAAAUCA | 7865 | UGAUUUUUU UAAUAGUG | 723 |
| 4403 | GCACUAUU CUGAUGA GCCGUUAGGC GAA AAAAAAUC | 7866 | GAUUUUUUU AAUAGUGC | 724 |
| 4404 | AGCACUAU CUGAUGA GCCGUUAGGC GAA AAAAAAAU | 7867 | AUUUUUUUA AUAGUGCU | 725 |
| 4407 | AAAAGCAC CUGAUGA GCCGUUAGGC GAA AUUAAAAA | 7868 | UUUUUAAUA GUGCUUUU | 726 |
| 4413 | AAAAAAAA CUGAUGA GCCGUUAGGC GAA AGCACUAU | 7869 | AUAGUGCUU UUUUUUUU | 727 |
| 4414 | AAAAAAAA CUGAUGA GCCGUUAGGC GAA AAGCACUA | 7870 | UAGUGCUUU UUUUUUUU | 728 |
| 4415 | CAAAAAAA CUGAUGA GCCGUUAGGC GAA AAAGCACU | 7871 | AGUGCUUUU UUUUUUUG | 729 |
| 4416 | UCAAAAAA CUGAUGA GCCGUUAGGC GAA AAAAGCAC | 7872 | GUGCUUUUU UUUUUUGA | 730 |
| 4417 | GUCAAAAA CUGAUGA GCCGUUAGGC GAA AAAAAGCA | 7873 | UGCUUUUUU UUUUUGAC | 731 |
| 4418 | AGUCAAAA CUGAUGA GCCGUUAGGC GAA AAAAAAGC | 7874 | GCUUUUUUU UUUUGACU | 732 |
| 4419 | UAGUCAAA CUGAUGA GCCGUUAGGC GAA AAAAAAAG | 7875 | CUUUUUUUU UUUGACUA | 733 |
| 4420 | UUAGUCAA CUGAUGA GCCGUUAGGC GAA AAAAAAAA | 7876 | UUUUUUUUU UUGACUAA | 734 |
| 4421 | GUUAGUCA CUGAUGA GCCGUUAGGC GAA AAAAAAAA | 7877 | UUUUUUUUU UGACUAAC | 735 |
| 4422 | UGUUAGUC CUGAUGA GCCGUUAGGC GAA AAAAAAAA | 7878 | UUUUUUUUU GACUAACA | 736 |
| 4427 | AUUCUUGU CUGAUGA GCCGUUAGGC GAA AGUCAAAA | 7879 | UUUUGACUA ACAAGAAU | 737 |
| 4438 | UCUGGAGU CUGAUGA GCCGUUAGGC GAA ACAUUCUU | 7880 | AAGAAUGUA ACUCCAGA | 738 |
| 4442 | UCUAUCUG CUGAUGA GCCGUUAGGC GAA AGUUACAU | 7881 | AUGUAACUC CAGAUAGA | 739 |
| 4448 | UAUUUCUC CUGAUGA GCCGUUAGGC GAA AUCUGGAG | 7882 | CUCCAGAUA GAGAAAUA | 740 |
| 4456 | CUUGUCAC CUGAUGA GCCGUUAGGC GAA AUUUCUCU | 7883 | AGAGAAAUA GUGACAAG | 741 |
| 4476 | UUUAGCAG CUGAUGA GCCGUUAGGC GAA AGUGUUCU | 7884 | AGAACACUA CUGCUAAA | 742 |
| 4482 | UGAGGAUU CUGAUGA GCCGUUAGGC GAA AGCAGUAG | 7885 | CUACUGCUA AAUCCUCA | 743 |
| 4486 | AACAUGAG CUGAUGA GCCGUUAGGC GAA AUUUAGCA | 7886 | UGCUAAAUC CUCAUGUU | 744 |
| 4489 | AGUAACAU CUGAUGA GCCGUUAGGC GAA AGGAUUUA | 7887 | UAAAUCCUC AUGUUACU | 745 |
| 4494 | CACUGAGU CUGAUGA GCCGUUAGGC GAA ACAUGAGG | 7888 | CCUCAUGUU ACUCAGUG | 746 |
| 4495 | ACACUGAG CUGAUGA GCCGUUAGGC GAA AACAUGAG | 7889 | CUCAUGUUA CUCAGUGU | 747 |
| 4498 | CUAACACU CUGAUGA GCCGUUAGGC GAA AGUAACAU | 7890 | AUGUUACUC AGUGUUAG | 748 |
| 4504 | AUUUCUCU CUGAUGA GCCGUUAGGC GAA ACACUGAG | 7891 | CUCAGUGUU AGAGAAAU | 749 |
| 4505 | GAUUUCUC CUGAUGA GCCGUUAGGC GAA AACACUGA | 7892 | UCAGUGUUA GAGAAAUC | 750 |
| 4513 | UUAGGAAG CUGAUGA GCCGUUAGGC GAA AUUUCUCU | 7893 | AGAGAAAUC CUUCCUAA | 751 |
| 4516 | GGUUUAGG CUGAUGA GCCGUUAGGC GAA AGGAUUUC | 7894 | GAAAUCCUU CCUAAACC | 752 |
| 4517 | GGGUUUAG CUGAUGA GCCGUUAGGC GAA AAGGAUUU | 7895 | AAAUCCUUC CUAAACCC | 753 |
| 4520 | AUUGGGUU CUGAUGA GCCGUUAGGC GAA AGGAAGGA | 7896 | UCCUUCCUA AACCCAAU | 754 |
| 4533 | GAGCAGGG CUGAUGA GCCGUUAGGC GAA AGUCAUUG | 7897 | CAAUGACUU CCCUGCUC | 755 |

| | | | | |
|---|---|---|---|---|
| 4534 | GGAGCAGG CUGAUGA GCCGUUAGGC GAA AAGUCAUU | 7898 | AAUGACUUC CCUGCUCC | 756 |
| 4541 | GGGGGUUG CUGAUGA GCCGUUAGGC GAA AGCAGGGA | 7899 | UCCCUGCUC CAACCCCC | 757 |
| 4557 | CGUGCCCU CUGAUGA GCCGUUAGGC GAA AGGUGGCG | 7900 | CGCCACCUC AGGGCACG | 758 |
| 4576 | CUCAAUCA CUGAUGA GCCGUUAGGC GAA ACUGGUCC | 7901 | GGACCAGUU UGAUUGAG | 759 |
| 4577 | CCUCAAUC CUGAUGA GCCGUUAGGC GAA AACUGGUC | 7902 | GACCAGUUU GAUUGAGG | 760 |
| 4581 | AGCUCCUC CUGAUGA GCCGUUAGGC GAA AUCAAACU | 7903 | AGUUUGAUU GAGGAGCU | 761 |
| 4598 | CAUUGGGU CUGAUGA GCCGUUAGGC GAA AUCAGUGC | 7904 | GCACUGAUC ACCCAAUG | 762 |
| 4610 | GGGUACGU CUGAUGA GCCGUUAGGC GAA AUGCAUUG | 7905 | CAAUGCAUC ACGUACCC | 763 |
| 4615 | CAGUGGGG CUGAUGA GCCGUUAGGC GAA ACGUGAUG | 7906 | CAUCACGUA CCCCACUG | 764 |
| 4664 | CUGGGGCU CUGAUGA GCCGUUAGGC GAA ACGGGCUU | 7907 | AAGCCCGUU AGCCCCAG | 765 |
| 4665 | CCUGGGGC CUGAUGA GCCGUUAGGC GAA AACGGGCU | 7908 | AGCCCGUUA GCCCCAGG | 766 |
| 4678 | CAGCCAGU CUGAUGA GCCGUUAGGC GAA AUCCCCUG | 7909 | CAGGGGAUC ACUGGCUG | 767 |
| 4700 | ACUCCCGA CUGAUGA GCCGUUAGGC GAA AUGUUGCU | 7910 | AGCAACAUC UCGGGAGU | 768 |
| 4702 | GGACUCCC CUGAUGA GCCGUUAGGC GAA AGAUGUUG | 7911 | CAACAUCUC GGGAGUCC | 769 |
| 4709 | UGCUAGAG CUGAUGA GCCGUUAGGC GAA ACUCCCGA | 7912 | UCGGGAGUC CUCUAGCA | 770 |
| 4712 | GCCUGCUA CUGAUGA GCCGUUAGGC GAA AGGACUCC | 7913 | GGAGUCCUC UAGCAGGC | 771 |
| 4714 | AGGCCUGC CUGAUGA GCCGUUAGGC GAA AGAGGACU | 7914 | AGUCCUCUA GCAGGCCU | 772 |
| 4723 | ACAUGUCU CUGAUGA GCCGUUAGGC GAA AGGCCUGC | 7915 | GCAGGCCUA AGACAUGU | 773 |
| 4802 | GCGUCUCA CUGAUGA GCCGUUAGGC GAA AUUCUUUC | 7916 | GAAAGAAUU UGAGACGC | 774 |
| 4803 | UGCGUCUC CUGAUGA GCCGUUAGGC GAA AAUUCUUU | 7917 | AAAGAAUUU GAGACGCA | 775 |
| 4840 | GCAUUGCU CUGAUGA GCCGUUAGGC GAA AGCCCCGU | 7918 | ACGGGGCUC AGCAAUGC | 776 |
| 4852 | GCCACUGA CUGAUGA GCCGUUAGGC GAA AUGGCAUU | 7919 | AAUGCCAUU UCAGUGGC | 777 |
| 4853 | AGCCACUG CUGAUGA GCCGUUAGGC GAA AAUGGCAU | 7920 | AUGCCAUUU CAGUGGCU | 778 |
| 4854 | AAGCCACU CUGAUGA GCCGUUAGGC GAA AAAUGGCA | 7921 | UGCCAUUUC AGUGGCUU | 779 |
| 4862 | GAGCUGGG CUGAUGA GCCGUUAGGC GAA AGCCACUG | 7922 | CAGUGGCUU CCCAGCUC | 780 |
| 4863 | AGAGCUGG CUGAUGA GCCGUUAGGC GAA AAGCCACU | 7923 | AGUGGCUUC CCAGCUCU | 781 |
| 4870 | AAGGGUCA CUGAUGA GCCGUUAGGC GAA AGCUGGGA | 7924 | UCCCAGCUC UGACCCUU | 782 |
| 4878 | AAAUGUAG CUGAUGA GCCGUUAGGC GAA AGGGUCAG | 7925 | CUGACCCUU CUACAUUU | 783 |
| 4879 | CAAAUGUA CUGAUGA GCCGUUAGGC GAA AAGGGUCA | 7926 | UGACCCUUC UACAUUUG | 784 |
| 4881 | CUCAAAUG CUGAUGA GCCGUUAGGC GAA AGAAGGGU | 7927 | ACCCUUCUA CAUUUGAG | 785 |
| 4885 | GGCCCUCA CUGAUGA GCCGUUAGGC GAA AUGUAGAA | 7928 | UUCUACAUU UGAGGGCC | 786 |
| 4886 | GGGCCCUC CUGAUGA GCCGUUAGGC GAA AAUGUAGA | 7929 | UCUACAUUU GAGGGCCC | 787 |
| 4929 | AUCCAGAA CUGAUGA GCCGUUAGGC GAA AUGUCCCC | 7930 | GGGGACAUU UUCUGGAU | 788 |

| | | | | |
|---|---|---|---|---|
| 4930 | AAUCCAGA CUGAUGA GCCGUUAGGC GAA AAUGUCCC | 7931 | GGGACAUUU UCUGGAUU | 789 |
| 4931 | GAAUCCAG CUGAUGA GCCGUUAGGC GAA AAAUGUCC | 7932 | GGACAUUUU CUGGAUUC | 790 |
| 4932 | AGAAUCCA CUGAUGA GCCGUUAGGC GAA AAAAUGUC | 7933 | GACAUUUUC UGGAUUCU | 791 |
| 4938 | CCUCCCAG CUGAUGA GCCGUUAGGC GAA AUCCAGAA | 7934 | UUCUGGAUU CUGGGAGG | 792 |
| 4939 | GCCUCCCA CUGAUGA GCCGUUAGGC GAA AAUCCAGA | 7935 | UCUGGAUUC UGGGAGGC | 793 |
| 4963 | AAAAAAGA CUGAUGA GCCGUUAGGC GAA AUUUGUCC | 7936 | GGACAAAUA UCUUUUUU | 794 |
| 4965 | CCAAAAAA CUGAUGA GCCGUUAGGC GAA AUAUUUGU | 7937 | ACAAAUAUC UUUUUUGG | 795 |
| 4967 | UUCCAAAA CUGAUGA GCCGUUAGGC GAA AGAUAUUU | 7938 | AAAUAUCUU UUUUGGAA | 796 |
| 4968 | GUUCCAAA CUGAUGA GCCGUUAGGC GAA AAGAUAUU | 7939 | AAUAUCUUU UUUGGAAC | 797 |
| 4969 | AGUUCCAA CUGAUGA GCCGUUAGGC GAA AAAGAUAU | 7940 | AUAUCUUUU UUGGAACU | 798 |
| 4970 | UAGUUCCA CUGAUGA GCCGUUAGGC GAA AAAAGAUA | 7941 | UAUCUUUUU UGGAACUA | 799 |
| 4971 | UUAGUUCC CUGAUGA GCCGUUAGGC GAA AAAAAGAU | 7942 | AUCUUUUUU GGAACUAA | 800 |
| 4978 | AUUUGCUU CUGAUGA GCCGUUAGGC GAA AGUUCCAA | 7943 | UUGGAACUA AAGCAAAU | 801 |
| 4987 | AGGUCUAA CUGAUGA GCCGUUAGGC GAA AUUUGCUU | 7944 | AAGCAAAUU UUAGACCU | 802 |
| 4988 | AAGGUCUA CUGAUGA GCCGUUAGGC GAA AAUUUGCU | 7945 | AGCAAAUUU UAGACCUU | 803 |
| 4989 | AAAGGUCU CUGAUGA GCCGUUAGGC GAA AAAUUUGC | 7946 | GCAAAUUUU AGACCUUU | 804 |
| 4990 | UAAAGGUC CUGAUGA GCCGUUAGGC GAA AAAAUUUG | 7947 | CAAAUUUUA GACCUUUA | 805 |
| 4996 | CAUAGGUA CUGAUGA GCCGUUAGGC GAA AGGUCUAA | 7948 | UUAGACCUU UACCUAUG | 806 |
| 4997 | CCAUAGGU CUGAUGA GCCGUUAGGC GAA AAGGUCUA | 7949 | UAGACCUUU ACCUAUGG | 807 |
| 4998 | UCCAUAGG CUGAUGA GCCGUUAGGC GAA AAAGGUCU | 7950 | AGACCUUUA CCUAUGGA | 808 |
| 5002 | CACUUCCA CUGAUGA GCCGUUAGGC GAA AGGUAAAG | 7951 | CUUUACCUA UGGAAGUG | 809 |
| 5013 | GGACAUAG CUGAUGA GCCGUUAGGC GAA ACCACUUC | 7952 | GAAGUGGUU CUAUGUCC | 810 |
| 5014 | UGGACAUA CUGAUGA GCCGUUAGGC GAA AACCACUU | 7953 | AAGUGGUUC UAUGUCCA | 811 |
| 5016 | AAUGGACA CUGAUGA GCCGUUAGGC GAA AGAACCAC | 7954 | GUGGUUCUA UGUCCAUU | 812 |
| 5020 | UGAGAAUG CUGAUGA GCCGUUAGGC GAA ACAUAGAA | 7955 | UUCUAUGUC CAUUCUCA | 813 |
| 5024 | CGAAUGAG CUGAUGA GCCGUUAGGC GAA AUGGACAU | 7956 | AUGUCCAUU CUCAUUCG | 814 |
| 5025 | ACGAAUGA CUGAUGA GCCGUUAGGC GAA AAUGGACA | 7957 | UGUCCAUUC UCAUUCGU | 815 |
| 5027 | CCACGAAU CUGAUGA GCCGUUAGGC GAA AGAAUGGA | 7958 | UCCAUUCUC AUUCGUGG | 816 |
| 5030 | AUGCCACG CUGAUGA GCCGUUAGGC GAA AUGAGAAU | 7959 | AUUCUCAUU CGUGGCAU | 817 |
| 5031 | CAUGCCAC CUGAUGA GCCGUUAGGC GAA AAUGAGAA | 7960 | UUCUCAUUC GUGGCAUG | 818 |
| 5041 | CAAAUCAA CUGAUGA GCCGUUAGGC GAA ACAUGCCA | 7961 | UGGCAUGUU UUGAUUUG | 819 |
| 5042 | ACAAAUCA CUGAUGA GCCGUUAGGC GAA AACAUGCC | 7962 | GGCAUGUUU UGAUUUGU | 820 |
| 5043 | UACAAAUC CUGAUGA GCCGUUAGGC GAA AAACAUGC | 7963 | GCAUGUUUU GAUUUGUA | 821 |

98

| | | | | |
|---|---|---|---|---|
| 5047 | GUGCUACA CUGAUGA GCCGUUAGGC GAA AUCAAAAC | 7964 | GUUUUGAUU UGUAGCAC | 822 |
| 5048 | AGUGCUAC CUGAUGA GCCGUUAGGC GAA AAUCAAAA | 7965 | UUUUGAUUU GUAGCACU | 823 |
| 5051 | CUCAGUGC CUGAUGA GCCGUUAGGC GAA ACAAAUCA | 7966 | UGAUUUGUA GCACUGAG | 824 |
| 5069 | UCAGAGUU CUGAUGA GCCGUUAGGC GAA AGUGCCAC | 7967 | GUGGCACUC AACUCUGA | 825 |
| 5074 | UGGGCUCA CUGAUGA GCCGUUAGGC GAA AGUUGAGU | 7968 | ACUCAACUC UGAGCCCA | 826 |
| 5084 | GCCAAAAG CUGAUGA GCCGUUAGGC GAA AUGGGCUC | 7969 | GAGCCCAUA CUUUUGGC | 827 |
| 5087 | GGAGCCAA CUGAUGA GCCGUUAGGC GAA AGUAUGGG | 7970 | CCCAUACUU UUGGCUCC | 828 |
| 5088 | AGGAGCCA CUGAUGA GCCGUUAGGC GAA AAGUAUGG | 7971 | CCAUACUUU UGGCUCCU | 829 |
| 5089 | GAGGAGCC CUGAUGA GCCGUUAGGC GAA AAAGUAUG | 7972 | CAUACUUUU GGCUCCUC | 830 |
| 5094 | UACUAGAG CUGAUGA GCCGUUAGGC GAA AGCCAAAA | 7973 | UUUUGGCUC CUCUAGUA | 831 |
| 5097 | UCUUACUA CUGAUGA GCCGUUAGGC GAA AGGAGCCA | 7974 | UGGCUCCUC UAGUAAGA | 832 |
| 5099 | CAUCUUAC CUGAUGA GCCGUUAGGC GAA AGAGGAGC | 7975 | GCUCCUCUA GUAAGAUG | 833 |
| 5102 | GUGCAUCU CUGAUGA GCCGUUAGGC GAA ACUAGAGG | 7976 | CCUCUAGUA AGAUGCAC | 834 |
| 5119 | CUCUGGCU CUGAUGA GCCGUUAGGC GAA AGUUUUCA | 7977 | UGAAAACUU AGCCAGAG | 835 |
| 5120 | ACUCUGGC CUGAUGA GCCGUUAGGC GAA AAGUUUUC | 7978 | GAAAACUUA GCCAGAGU | 836 |
| 5129 | GACAACCU CUGAUGA GCCGUUAGGC GAA ACUCUGGC | 7979 | GCCAGAGUU AGGUUGUC | 837 |
| 5130 | AGACAACC CUGAUGA GCCGUUAGGC GAA AACUCUGG | 7980 | CCAGAGUUA GGUUGUCU | 838 |
| 5134 | CUGGAGAC CUGAUGA GCCGUUAGGC GAA ACCUAACU | 7981 | AGUUAGGUU GUCUCCAG | 839 |
| 5137 | GGCCUGGA CUGAUGA GCCGUUAGGC GAA ACAACCUA | 7982 | UAGGUUGUC UCCAGGCC | 840 |
| 5139 | AUGGCCUG CUGAUGA GCCGUUAGGC GAA AGACAACC | 7983 | GGUUGUCUC CAGGCCAU | 841 |
| 5156 | UUCAGUGU CUGAUGA GCCGUUAGGC GAA AGGCCAUC | 7984 | GAUGGCCUU ACACUGAA | 842 |
| 5157 | UUUCAGUG CUGAUGA GCCGUUAGGC GAA AAGGCCAU | 7985 | AUGGCCUUA CACUGAAA | 843 |
| 5170 | UAGAAUGU CUGAUGA GCCGUUAGGC GAA ACAUUUUC | 7986 | GAAAAUGUC ACAUUCUA | 844 |
| 5175 | CAAAAUAG CUGAUGA GCCGUUAGGC GAA AUGUGACA | 7987 | UGUCACAUU CUAUUUUG | 845 |
| 5176 | CCAAAAUA CUGAUGA GCCGUUAGGC GAA AAUGUGAC | 7988 | GUCACAUUC UAUUUUGG | 846 |
| 5178 | ACCCAAAA CUGAUGA GCCGUUAGGC GAA AGAAUGUG | 7989 | CACAUUCUA UUUUGGGU | 847 |
| 5180 | AUACCCAA CUGAUGA GCCGUUAGGC GAA AUAGAAUG | 7990 | CAUUCUAUU UUGGGUAU | 848 |
| 5181 | AAUACCCA CUGAUGA GCCGUUAGGC GAA AAUAGAAU | 7991 | AUUCUAUUU UGGGUAUU | 849 |
| 5182 | UAAUACCC CUGAUGA GCCGUUAGGC GAA AAAUAGAA | 7992 | UUCUAUUUU GGGUAUUA | 850 |
| 5187 | UAUAUUAA CUGAUGA GCCGUUAGGC GAA ACCCAAAA | 7993 | UUUUGGGUA UUAAUAUA | 851 |
| 5189 | UAUAUAUU CUGAUGA GCCGUUAGGC GAA AUACCCAA | 7994 | UUGGGUAUU AAUAUAUA | 852 |
| 5190 | CUAUAUAU CUGAUGA GCCGUUAGGC GAA AAUACCCA | 7995 | UGGGUAUUA AUAUAUAG | 853 |
| 5193 | GGACUAUA CUGAUGA GCCGUUAGGC GAA AUUAAUAC | 7996 | GUAUUAAUA UAUAGUCC | 854 |

99

| | | | | |
|---|---|---|---|---|
| 5195 | CUGGACUA CUGAUGA GCCGUUAGGC GAA AUAUUAAU | 7997 | AUUAAUAUA UAGUCCAG | 855 |
| 5197 | GUCUGGAC CUGAUGA GCCGUUAGGC GAA AUAUAUUA | 7998 | UAAUAUAUA GUCCAGAC | 856 |
| 5200 | AGUGUCUG CUGAUGA GCCGUUAGGC GAA ACUAUAUA | 7999 | UAUAUAGUC CAGACACU | 857 |
| 5209 | AUUGAGUU CUGAUGA GCCGUUAGGC GAA AGUGUCUG | 8000 | CAGACACUU AACUCAAU | 858 |
| 5210 | AAUUGAGU CUGAUGA GCCGUUAGGC GAA AAGUGUCU | 8001 | AGACACUUA ACUCAAUU | 859 |
| 5214 | AAGAAAUU CUGAUGA GCCGUUAGGC GAA AGUUAAGU | 8002 | ACUUAACUC AAUUUCUU | 860 |
| 5218 | UACCAAGA CUGAUGA GCCGUUAGGC GAA AUUGAGUU | 8003 | AACUCAAUU UCUUGGUA | 861 |
| 5219 | AUACCAAG CUGAUGA GCCGUUAGGC GAA AAUUGAGU | 8004 | ACUCAAUUU CUUGGUAU | 862 |
| 5220 | AAUACCAA CUGAUGA GCCGUUAGGC GAA AAAUUGAG | 8005 | CUCAAUUUC UUGGUAUU | 863 |
| 5222 | AUAAUACC CUGAUGA GCCGUUAGGC GAA AGAAAUUG | 8006 | CAAUUUCUU GGUAUUAU | 864 |
| 5226 | CAGAAUAA CUGAUGA GCCGUUAGGC GAA ACCAAGAA | 8007 | UUCUUGGUA UUAUUCUG | 865 |
| 5228 | AACAGAAU CUGAUGA GCCGUUAGGC GAA AUACCAAG | 8008 | CUUGGUAUU AUUCUGUU | 866 |
| 5229 | AAACAGAA CUGAUGA GCCGUUAGGC GAA AAUACCAA | 8009 | UUGGUAUUA UUCUGUUU | 867 |
| 5231 | CAAAACAG CUGAUGA GCCGUUAGGC GAA AUAAUACC | 8010 | GGUAUUAUU CUGUUUUG | 868 |
| 5232 | GCAAAACA CUGAUGA GCCGUUAGGC GAA AAUAAUAC | 8011 | GUAUUAUUC UGUUUUGC | 869 |
| 5236 | CUGUGCAA CUGAUGA GCCGUUAGGC GAA ACAGAAUA | 8012 | UAUUCUGUU UUGCACAG | 870 |
| 5237 | ACUGUGCA CUGAUGA GCCGUUAGGC GAA AACAGAAU | 8013 | AUUCUGUUU UGCACAGU | 871 |
| 5238 | AACUGUGC CUGAUGA GCCGUUAGGC GAA AAACAGAA | 8014 | UUCUGUUUU GCACAGUU | 872 |
| 5246 | UCACAACU CUGAUGA GCCGUUAGGC GAA ACUGUGCA | 8015 | UGCACAGUU AGUUGUGA | 873 |
| 5247 | UUCACAAC CUGAUGA GCCGUUAGGC GAA AACUGUGC | 8016 | GCACAGUUA GUUGUGAA | 874 |
| 5250 | UCUUUCAC CUGAUGA GCCGUUAGGC GAA ACUAACUG | 8017 | CAGUUAGUU GUGAAAGA | 875 |
| 5284 | CUCCUCAG CUGAUGA GCCGUUAGGC GAA ACUGCAUU | 8018 | AAUGCAGUC CUGAGGAG | 876 |
| 5296 | AUGGAGAA CUGAUGA GCCGUUAGGC GAA ACUCUCCU | 8019 | AGGAGAGUU UUCUCCAU | 877 |
| 5297 | UAUGGAGA CUGAUGA GCCGUUAGGC GAA AACUCUCC | 8020 | GGAGAGUUU UCUCCAUA | 878 |
| 5298 | AUAUGGAG CUGAUGA GCCGUUAGGC GAA AAACUCUC | 8021 | GAGAGUUUU CUCCAUAU | 879 |
| 5299 | GAUAUGGA CUGAUGA GCCGUUAGGC GAA AAAACUCU | 8022 | AGAGUUUUC UCCAUAUC | 880 |
| 5301 | UUGAUAUG CUGAUGA GCCGUUAGGC GAA AGAAAACU | 8023 | AGUUUUCUC CAUAUCAA | 881 |
| 5305 | CGUUUUGA CUGAUGA GCCGUUAGGC GAA AUGGAGAA | 8024 | UUCUCCAUA UCAAAACG | 882 |
| 5307 | CUCGUUUU CUGAUGA GCCGUUAGGC GAA AUAUGGAG | 8025 | CUCCAUAUC AAAACGAG | 883 |
| 5336 | ACCUUAUU CUGAUGA GCCGUUAGGC GAA ACCUUUUU | 8026 | AAAAAGGUC AAUAAGGU | 884 |
| 5340 | CUUGACCU CUGAUGA GCCGUUAGGC GAA AUUGACCU | 8027 | AGGUCAAUA AGGUCAAG | 885 |
| 5345 | CUUCCCUU CUGAUGA GCCGUUAGGC GAA ACCUUAUU | 8028 | AAUAAGGUC AAGGGAAG | 886 |
| 5361 | GGUAUAGA CUGAUGA GCCGUUAGGC GAA ACGGGGUC | 8029 | GACCCCGUC UCUAUACC | 887 |

100

| | | | | |
|---|---|---|---|---|
| 5363 | UUGGUAUA CUGAUGA GCCGUUAGGC GAA AGACGGGG | 8030 | CCCCGUCUC UAUACCAA | 888 |
| 5365 | GGUUGGUA CUGAUGA GCCGUUAGGC GAA AGAGACGG | 8031 | CCGUCUCUA UACCAACC | 889 |
| 5367 | UUGGUUGG CUGAUGA GCCGUUAGGC GAA AUAGAGAC | 8032 | GUCUCUAUA CCAACCAA | 890 |
| 5382 | UGUUGGUG CUGAUGA GCCGUUAGGC GAA AUUGGUUU | 8033 | AAACCAAUU CACCAACA | 891 |
| 5383 | GUGUUGGU CUGAUGA GCCGUUAGGC GAA AAUUGGUU | 8034 | AACCAAUUC ACCAACAC | 892 |
| 5395 | UGGGUCCC CUGAUGA GCCGUUAGGC GAA ACUGUGUU | 8035 | AACACAGUU GGGACCCA | 893 |
| 5417 | ACGUGACU CUGAUGA GCCGUUAGGC GAA ACUUCCUG | 8036 | CAGGAAGUC AGUCACGU | 894 |
| 5421 | GGAAACGU CUGAUGA GCCGUUAGGC GAA ACUGACUU | 8037 | AAGUCAGUC ACGUUUCC | 895 |
| 5426 | GAAAAGGA CUGAUGA GCCGUUAGGC GAA ACGUGACU | 8038 | AGUCACGUU UCCUUUUC | 896 |
| 5427 | UGAAAAGG CUGAUGA GCCGUUAGGC GAA AACGUGAC | 8039 | GUCACGUUU CCUUUUCA | 897 |
| 5428 | AUGAAAAG CUGAUGA GCCGUUAGGC GAA AAACGUGA | 8040 | UCACGUUUC CUUUUCAU | 898 |
| 5431 | UAAAUGAA CUGAUGA GCCGUUAGGC GAA AGGAAACG | 8041 | CGUUUCCUU UUCAUUUA | 899 |
| 5432 | UUAAAUGA CUGAUGA GCCGUUAGGC GAA AAGGAAAC | 8042 | GUUUCCUUU UCAUUUAA | 900 |
| 5433 | AUUAAAUG CUGAUGA GCCGUUAGGC GAA AAAGGAAA | 8043 | UUUCCUUUU CAUUUAAU | 901 |
| 5434 | CAUUAAAU CUGAUGA GCCGUUAGGC GAA AAAAGGAA | 8044 | UUCCUUUUC AUUUAAUG | 902 |
| 5437 | CCCCAUUA CUGAUGA GCCGUUAGGC GAA AUGAAAAG | 8045 | CUUUUCAUU UAAUGGGG | 903 |
| 5438 | UCCCCAUU CUGAUGA GCCGUUAGGC GAA AAUGAAAA | 8046 | UUUUCAUUU AAUGGGGA | 904 |
| 5439 | AUCCCCAU CUGAUGA GCCGUUAGGC GAA AAAUGAAA | 8047 | UUUCAUUUA AUGGGGAU | 905 |
| 5448 | GAUAGUGG CUGAUGA GCCGUUAGGC GAA AUCCCCAU | 8048 | AUGGGGAUU CCACUAUC | 906 |
| 5449 | AGAUAGUG CUGAUGA GCCGUUAGGC GAA AAUCCCCA | 8049 | UGGGGAUUC CACUAUCU | 907 |
| 5454 | GUGUGAGA CUGAUGA GCCGUUAGGC GAA AGUGGAAU | 8050 | AUUCCACUA UCUCACAC | 908 |
| 5456 | UAGUGUGA CUGAUGA GCCGUUAGGC GAA AUAGUGGA | 8051 | UCCACUAUC UCACACUA | 909 |
| 5458 | AUUAGUGU CUGAUGA GCCGUUAGGC GAA AGAUAGUG | 8052 | CACUAUCUC ACACUAAU | 910 |
| 5464 | UUUCAGAU CUGAUGA GCCGUUAGGC GAA AGUGUGAG | 8053 | CUCACACUA AUCUGAAA | 911 |
| 5467 | UCCUUUCA CUGAUGA GCCGUUAGGC GAA AUUAGUGU | 8054 | ACACUAAUC UGAAAGGA | 912 |
| 5489 | CGCCAGCU CUGAUGA GCCGUUAGGC GAA AUGCUCUU | 8055 | AAGAGCAUU AGCUGGCG | 913 |
| 5490 | GCGCCAGC CUGAUGA GCCGUUAGGC GAA AAUGCUCU | 8056 | AGAGCAUUA GCUGGCGC | 914 |
| 5501 | GUGCUUAA CUGAUGA GCCGUUAGGC GAA AUGCGCCA | 8057 | UGGCGCAUA UUAAGCAC | 915 |
| 5503 | AAGUGCUU CUGAUGA GCCGUUAGGC GAA AUAUGCGC | 8058 | GCGCAUAUU AAGCACUU | 916 |
| 5504 | AAAGUGCU CUGAUGA GCCGUUAGGC GAA AAUAUGCG | 8059 | CGCAUAUUA AGCACUUU | 917 |
| 5511 | GGAGCUUA CUGAUGA GCCGUUAGGC GAA AGUGCUUA | 8060 | UAAGCACUU UAAGCUCC | 918 |
| 5512 | AGGAGCUU CUGAUGA GCCGUUAGGC GAA AAGUGCUU | 8061 | AAGCACUUU AAGCUCCU | 919 |
| 5513 | AAGGAGCU CUGAUGA GCCGUUAGGC GAA AAAGUGCU | 8062 | AGCACUUUA AGCUCCUU | 920 |

101

| | | | | |
|---|---|---|---|---|
| 5518 | UACUCAAG CUGAUGA GCCGUUAGGC GAA AGCUUAAA | 8063 | UUUAAGCUC CUUGAGUA | 921 |
| 5521 | UUUUACUC CUGAUGA GCCGUUAGGC GAA AGGAGCUU | 8064 | AAGCUCCUU GAGUAAAA | 922 |
| 5526 | CACCUUUU CUGAUGA GCCGUUAGGC GAA ACUCAAGG | 8065 | CCUUGAGUA AAAAGGUG | 923 |
| 5537 | AAAUUACA CUGAUGA GCCGUUAGGC GAA ACCACCUU | 8066 | AAGGUGGUA UGUAAUUU | 924 |
| 5541 | GCAUAAAU CUGAUGA GCCGUUAGGC GAA ACAUACCA | 8067 | UGGUAUGUA AUUUAUGC | 925 |
| 5544 | CUUGCAUA CUGAUGA GCCGUUAGGC GAA AUUACAUA | 8068 | UAUGUAAUU UAUGCAAG | 926 |
| 5545 | CCUUGCAU CUGAUGA GCCGUUAGGC GAA AAUUACAU | 8069 | AUGUAAUUU AUGCAAGG | 927 |
| 5546 | ACCUUGCA CUGAUGA GCCGUUAGGC GAA AAAUUACA | 8070 | UGUAAUUUA UGCAAGGU | 928 |
| 5555 | UGGAGAAA CUGAUGA GCCGUUAGGC GAA ACCUUGCA | 8071 | UGCAAGGUA UUUCUCCA | 929 |
| 5557 | ACUGGAGA CUGAUGA GCCGUUAGGC GAA AUACCUUG | 8072 | CAAGGUAUU UCUCCAGU | 930 |
| 5558 | AACUGGAG CUGAUGA GCCGUUAGGC GAA AAUACCUU | 8073 | AAGGUAUUU CUCCAGUU | 931 |
| 5559 | CAACUGGA CUGAUGA GCCGUUAGGC GAA AAAUACCU | 8074 | AGGUAUUUC UCCAGUUG | 932 |
| 5561 | CCCAACUG CUGAUGA GCCGUUAGGC GAA AGAAAUAC | 8075 | GUAUUUCUC CAGUUGGG | 933 |
| 5566 | UGAGUCCC CUGAUGA GCCGUUAGGC GAA ACUGGAGA | 8076 | UCUCCAGUU GGGACUCA | 934 |
| 5573 | AAUAUCCU CUGAUGA GCCGUUAGGC GAA AGUCCCAA | 8077 | UUGGGACUC AGGAUAUU | 935 |
| 5579 | UUAACUAA CUGAUGA GCCGUUAGGC GAA AUCCUGAG | 8078 | CUCAGGAUA UUAGUUAA | 936 |
| 5581 | CAUUAACU CUGAUGA GCCGUUAGGC GAA AUAUCCUG | 8079 | CAGGAUAUU AGUUAAUG | 937 |
| 5582 | UCAUUAAC CUGAUGA GCCGUUAGGC GAA AAUAUCCU | 8080 | AGGAUAUUA GUUAAUGA | 938 |
| 5585 | GGCUCAUU CUGAUGA GCCGUUAGGC GAA ACUAAUAU | 8081 | AUAUUAGUU AAUGAGCC | 939 |
| 5586 | UGGCUCAU CUGAUGA GCCGUUAGGC GAA AACUAAUA | 8082 | UAUUAGUUA AUGAGCCA | 940 |
| 5596 | CUUCUAGU CUGAUGA GCCGUUAGGC GAA AUGGCUCA | 8083 | UGAGCCAUC ACUAGAAG | 941 |
| 5600 | UUUUCUUC CUGAUGA GCCGUUAGGC GAA AGUGAUGG | 8084 | CCAUCACUA GAAGAAAA | 942 |
| 5615 | CAGUUGAA CUGAUGA GCCGUUAGGC GAA AUGGGCUU | 8085 | AAGCCCAUU UUCAACUG | 943 |
| 5616 | GCAGUUGA CUGAUGA GCCGUUAGGC GAA AAUGGGCU | 8086 | AGCCCAUUU UCAACUGC | 944 |
| 5617 | AGCAGUUG CUGAUGA GCCGUUAGGC GAA AAAUGGGC | 8087 | GCCCAUUUU CAACUGCU | 945 |
| 5618 | AAGCAGUU CUGAUGA GCCGUUAGGC GAA AAAAUGGG | 8088 | CCCAUUUUC AACUGCUU | 946 |
| 5626 | AAGUUUCA CUGAUGA GCCGUUAGGC GAA AGCAGUUG | 8089 | CAACUGCUU UGAAACUU | 947 |
| 5627 | CAAGUUUC CUGAUGA GCCGUUAGGC GAA AAGCAGUU | 8090 | AACUGCUUU GAAACUUG | 948 |
| 5634 | CCCCAGGC CUGAUGA GCCGUUAGGC GAA AGUUUCAA | 8091 | UUGAAACUU GCCUGGGG | 949 |
| 5644 | CAUGCUCA CUGAUGA GCCGUUAGGC GAA ACCCCAGG | 8092 | CCUGGGGUC UGAGCAUG | 950 |
| 5661 | UGUCUCCC CUGAUGA GCCGUUAGGC GAA AUUCCCAU | 8093 | AUGGGAAUA GGGAGACA | 951 |
| 5674 | CCCUUUCC CUGAUGA GCCGUUAGGC GAA ACCCUGUC | 8094 | GACAGGGUA GGAAAGGG | 952 |
| 5688 | CUGAAGAG CUGAUGA GCCGUUAGGC GAA AGGCGCCC | 8095 | GGGCGCCUA CUCUUCAG | 953 |

102

| | | | | |
|---|---|---|---|---|
| 5691 | ACCCUGAA CUGAUGA GCCGUUAGGC GAA AGUAGGCG | 8096 | CGCCUACUC UUCAGGGU | 954 |
| 5693 | AGACCCUG CUGAUGA GCCGUUAGGC GAA AGAGUAGG | 8097 | CCUACUCUU CAGGGUCU | 955 |
| 5694 | UAGACCCU CUGAUGA GCCGUUAGGC GAA AAGAGUAG | 8098 | CUACUCUUC AGGGUCUA | 956 |
| 5700 | GAUCUUUA CUGAUGA GCCGUUAGGC GAA ACCCUGAA | 8099 | UUCAGGGUC UAAAGAUC | 957 |
| 5702 | UUGAUCUU CUGAUGA GCCGUUAGGC GAA AGACCCUG | 8100 | CAGGGUCUA AAGAUCAA | 958 |
| 5708 | GCCCACUU CUGAUGA GCCGUUAGGC GAA AUCUUUAG | 8101 | CUAAAGAUC AAGUGGGC | 959 |
| 5719 | AGCGAUCC CUGAUGA GCCGUUAGGC GAA AGGCCCAC | 8102 | GUGGGCCUU GGAUCGCU | 960 |
| 5724 | AGCUUAGC CUGAUGA GCCGUUAGGC GAA AUCCAAGG | 8103 | CCUUGGAUC GCUAAGCU | 961 |
| 5728 | AGCCAGCU CUGAUGA GCCGUUAGGC GAA AGCGAUCC | 8104 | GGAUCGCUA AGCUGGCU | 962 |
| 5737 | AUCAAACA CUGAUGA GCCGUUAGGC GAA AGCCAGCU | 8105 | AGCUGGCUC UGUUUGAU | 963 |
| 5741 | UAGCAUCA CUGAUGA GCCGUUAGGC GAA ACAGAGCC | 8106 | GGCUCUGUU UGAUGCUA | 964 |
| 5742 | AUAGCAUC CUGAUGA GCCGUUAGGC GAA AACAGAGC | 8107 | GCUCUGUUU GAUGCUAU | 965 |
| 5749 | UGCAUAAA CUGAUGA GCCGUUAGGC GAA AGCAUCAA | 8108 | UUGAUGCUA UUUAUGCA | 966 |
| 5751 | CUUGCAUA CUGAUGA GCCGUUAGGC GAA AUAGCAUC | 8109 | GAUGCUAUU UAUGCAAG | 967 |
| 5752 | ACUUGCAU CUGAUGA GCCGUUAGGC GAA AAUAGCAU | 8110 | AUGCUAUUU AUGCAAGU | 968 |
| 5753 | AACUUGCA CUGAUGA GCCGUUAGGC GAA AAAUAGCA | 8111 | UGCUAUUUA UGCAAGUU | 969 |
| 5761 | UAGACCCU CUGAUGA GCCGUUAGGC GAA ACUUGCAU | 8112 | AUGCAAGUU AGGGUCUA | 970 |
| 5762 | AUAGACCC CUGAUGA GCCGUUAGGC GAA AACUUGCA | 8113 | UGCAAGUUA GGGUCUAU | 971 |
| 5767 | AAUACAUA CUGAUGA GCCGUUAGGC GAA ACCCUAAC | 8114 | GUUAGGGUC UAUGUAUU | 972 |
| 5769 | UAAAUACA CUGAUGA GCCGUUAGGC GAA AGACCCUA | 8115 | UAGGGUCUA UGUAUUUA | 973 |
| 5773 | AUCCUAAA CUGAUGA GCCGUUAGGC GAA ACAUAGAC | 8116 | GUCUAUGUA UUUAGGAU | 974 |
| 5775 | GCAUCCUA CUGAUGA GCCGUUAGGC GAA AUACAUAG | 8117 | CUAUGUAUU UAGGAUGC | 975 |
| 5776 | CGCAUCCU CUGAUGA GCCGUUAGGC GAA AAUACAUA | 8118 | UAUGUAUUU AGGAUGCG | 976 |
| 5777 | GCGCAUCC CUGAUGA GCCGUUAGGC GAA AAAUACAU | 8119 | AUGUAUUUA GGAUGCGC | 977 |
| 5788 | CUGAAGAG CUGAUGA GCCGUUAGGC GAA AGGCGCAU | 8120 | AUGCGCCUA CUCUUCAG | 978 |
| 5791 | ACCCUGAA CUGAUGA GCCGUUAGGC GAA AGUAGGCG | 8096 | CGCCUACUC UUCAGGGU | 954 |
| 5793 | AGACCCUG CUGAUGA GCCGUUAGGC GAA AGAGUAGG | 8097 | CCUACUCUU CAGGGUCU | 955 |
| 5794 | UAGACCCU CUGAUGA GCCGUUAGGC GAA AAGAGUAG | 8098 | CUACUCUUC AGGGUCUA | 956 |
| 5800 | GAUCUUUA CUGAUGA GCCGUUAGGC GAA ACCCUGAA | 8099 | UUCAGGGUC UAAAGAUC | 957 |
| 5802 | UUGAUCUU CUGAUGA GCCGUUAGGC GAA AGACCCUG | 8100 | CAGGGUCUA AAGAUCAA | 958 |
| 5808 | GCCCACUU CUGAUGA GCCGUUAGGC GAA AUCUUUAG | 8101 | CUAAAGAUC AAGUGGGC | 959 |
| 5819 | AGCGAUCC CUGAUGA GCCGUUAGGC GAA AGGCCCAC | 8102 | GUGGGCCUU GGAUCGCU | 960 |
| 5824 | AGCUUAGC CUGAUGA GCCGUUAGGC GAA AUCCAAGG | 8103 | CCUUGGAUC GCUAAGCU | 961 |

| | | | | |
|---|---|---|---|---|
| 5828 | AGCCAGCU CUGAUGA GCCGUUAGGC GAA AGCGAUCC | 8104 | GGAUCGCUA AGCUGGCU | 962 |
| 5837 | AUCAAACA CUGAUGA GCCGUUAGGC GAA AGCCAGCU | 8105 | AGCUGGCUC UGUUUGAU | 963 |
| 5841 | UAGCAUCA CUGAUGA GCCGUUAGGC GAA ACAGAGCC | 8106 | GGCUCUGUU UGAUGCUA | 964 |
| 5842 | AUAGCAUC CUGAUGA GCCGUUAGGC GAA AACAGAGC | 8107 | GCUCUGUUU GAUGCUAU | 965 |
| 5849 | UGCAUAAA CUGAUGA GCCGUUAGGC GAA AGCAUCAA | 8108 | UUGAUGCUA UUUAUGCA | 966 |
| 5851 | CUUGCAUA CUGAUGA GCCGUUAGGC GAA AUAGCAUC | 8109 | GAUGCUAUU UAUGCAAG | 967 |
| 5852 | ACUUGCAU CUGAUGA GCCGUUAGGC GAA AAUAGCAU | 8110 | AUGCUAUUU AUGCAAGU | 968 |
| 5853 | AACUUGCA CUGAUGA GCCGUUAGGC GAA AAAUAGCA | 8111 | UGCUAUUUA UGCAAGUU | 969 |
| 5861 | UAGACCCU CUGAUGA GCCGUUAGGC GAA ACUUGCAU | 8112 | AUGCAAGUU AGGGUCUA | 970 |
| 5862 | AUAGACCC CUGAUGA GCCGUUAGGC GAA AACUUGCA | 8113 | UGCAAGUUA GGGUCUAU | 971 |
| 5867 | AAUACAUA CUGAUGA GCCGUUAGGC GAA ACCCUAAC | 8114 | GUUAGGGUC UAUGUAUU | 972 |
| 5869 | UAAAUACA CUGAUGA GCCGUUAGGC GAA AGACCCUA | 8115 | UAGGGUCUA UGUAUUUA | 973 |
| 5873 | AUCCUAAA CUGAUGA GCCGUUAGGC GAA ACAUAGAC | 8116 | GUCUAUGUA UUUAGGAU | 974 |
| 5875 | ACAUCCUA CUGAUGA GCCGUUAGGC GAA AUACAUAG | 8121 | CUAUGUAUU UAGGAUGU | 979 |
| 5876 | GACAUCCU CUGAUGA GCCGUUAGGC GAA AAUACAUA | 8122 | UAUGUAUUU AGGAUGUC | 980 |
| 5877 | AGACAUCC CUGAUGA GCCGUUAGGC GAA AAAUACAU | 8123 | AUGUAUUUA GGAUGUCU | 981 |
| 5884 | AAGGUGCA CUGAUGA GCCGUUAGGC GAA ACAUCCUA | 8124 | UAGGAUGUC UGCACCUU | 982 |
| 5892 | GGCUGCAG CUGAUGA GCCGUUAGGC GAA AGGUGCAG | 8125 | CUGCACCUU CUGCAGCC | 983 |
| 5893 | UGGCUGCA CUGAUGA GCCGUUAGGC GAA AAGGUGCA | 8126 | UGCACCUUC UGCAGCCA | 984 |
| 5904 | CAGCUUCU CUGAUGA GCCGUUAGGC GAA ACUGGCUG | 8127 | CAGCCAGUC AGAAGCUG | 985 |
| 5930 | GAAGCAGC CUGAUGA GCCGUUAGGC GAA AUCCACUG | 8128 | CAGUGGAUU GCUGCUUC | 986 |
| 5937 | UCCCCAAG CUGAUGA GCCGUUAGGC GAA AGCAGCAA | 8129 | UUGCUGCUU CUUGGGGA | 987 |
| 5938 | CUCCCCAA CUGAUGA GCCGUUAGGC GAA AAGCAGCA | 8130 | UGCUGCUUC UUGGGGAG | 988 |
| 5940 | UUCUCCCC CUGAUGA GCCGUUAGGC GAA AGAAGCAG | 8131 | CUGCUUCUU GGGGAGAA | 989 |
| 5953 | AGGAAGCA CUGAUGA GCCGUUAGGC GAA ACUCUUCU | 8132 | AGAAGAGUA UGCUUCCU | 990 |
| 5958 | AUAAAAGG CUGAUGA GCCGUUAGGC GAA AGCAUACU | 8133 | AGUAUGCUU CCUUUUAU | 991 |
| 5959 | GAUAAAAG CUGAUGA GCCGUUAGGC GAA AAGCAUAC | 8134 | GUAUGCUUC CUUUUAUC | 992 |
| 5962 | AUGGAUAA CUGAUGA GCCGUUAGGC GAA AGGAAGCA | 8135 | UGCUUCCUU UUAUCCAU | 993 |
| 5963 | CAUGGAUA CUGAUGA GCCGUUAGGC GAA AAGGAAGC | 8136 | GCUUCCUUU UAUCCAUG | 994 |
| 5964 | ACAUGGAU CUGAUGA GCCGUUAGGC GAA AAAGGAAG | 8137 | CUUCCUUUU AUCCAUGU | 995 |
| 5965 | UACAUGGA CUGAUGA GCCGUUAGGC GAA AAAAGGAA | 8138 | UUCCUUUUA UCCAUGUA | 996 |
| 5967 | AUUACAUG CUGAUGA GCCGUUAGGC GAA AUAAAAGG | 8139 | CCUUUUAUC CAUGUAAU | 997 |
| 5973 | AGUUAAAU CUGAUGA GCCGUUAGGC GAA ACAUGGAU | 8140 | AUCCAUGUA AUUUAACU | 998 |

| | | | | |
|---|---|---|---|---|
| 5976 | UACAGUUA CUGAUGA GCCGUUAGGC GAA AUUACAUG | 8141 | CAUGUAAUU UAACUGUA | 999 |
| 5977 | CUACAGUU CUGAUGA GCCGUUAGGC GAA AAUUACAU | 8142 | AUGUAAUUU AACUGUAG | 1000 |
| 5978 | UCUACAGU CUGAUGA GCCGUUAGGC GAA AAAUUACA | 8143 | UGUAAUUUA ACUGUAGA | 1001 |
| 5984 | UCAGGUUC CUGAUGA GCCGUUAGGC GAA ACAGUUAA | 8144 | UUAACUGUA GAACCUGA | 1002 |
| 5996 | GUUACUUA CUGAUGA GCCGUUAGGC GAA AGCUCAGG | 8145 | CCUGAGCUC UAAGUAAC | 1003 |
| 5998 | CGGUUACU CUGAUGA GCCGUUAGGC GAA AGAGCUCA | 8146 | UGAGCUCUA AGUAACCG | 1004 |
| 6002 | UCUUCGGU CUGAUGA GCCGUUAGGC GAA ACUUAGAG | 8147 | CUCUAAGUA ACCGAAGA | 1005 |
| 6015 | CAGAGGCA CUGAUGA GCCGUUAGGC GAA ACAUUCUU | 8148 | AAGAAUGUA UGCCUCUG | 1006 |
| 6021 | UAAGAACA CUGAUGA GCCGUUAGGC GAA AGGCAUAC | 8149 | GUAUGCCUC UGUUCUUA | 1007 |
| 6025 | CACAUAAG CUGAUGA GCCGUUAGGC GAA ACAGAGGC | 8150 | GCCUCUGUU CUUAUGUG | 1008 |
| 6026 | GCACAUAA CUGAUGA GCCGUUAGGC GAA AACAGAGG | 8151 | CCUCUGUUC UUAUGUGC | 1009 |
| 6028 | UGGCACAU CUGAUGA GCCGUUAGGC GAA AGAACAGA | 8152 | UCUGUUCUU AUGUGCCA | 1010 |
| 6029 | GUGGCACA CUGAUGA GCCGUUAGGC GAA AAGAACAG | 8153 | CUGUUCUUA UGUGCCAC | 1011 |
| 6040 | UAAACAAG CUGAUGA GCCGUUAGGC GAA AUGUGGCA | 8154 | UGCCACAUC CUUGUUUA | 1012 |
| 6043 | CUUUAAAC CUGAUGA GCCGUUAGGC GAA AGGAUGUG | 8155 | CACAUCCUU GUUUAAAG | 1013 |
| 6046 | AGCCUUUA CUGAUGA GCCGUUAGGC GAA ACAAGGAU | 8156 | AUCCUUGUU UAAAGGCU | 1014 |
| 6047 | GAGCCUUU CUGAUGA GCCGUUAGGC GAA AACAAGGA | 8157 | UCCUUGUUU AAAGGCUC | 1015 |
| 6048 | AGAGCCUU CUGAUGA GCCGUUAGGC GAA AAACAAGG | 8158 | CCUUGUUUA AAGGCUCU | 1016 |
| 6055 | CAUACAGA CUGAUGA GCCGUUAGGC GAA AGCCUUUA | 8159 | UAAAGGCUC UCUGUAUG | 1017 |
| 6057 | UUCAUACA CUGAUGA GCCGUUAGGC GAA AGAGCCUU | 8160 | AAGGCUCUC UGUAUGAA | 1018 |
| 6061 | UCUCUUCA CUGAUGA GCCGUUAGGC GAA ACAGAGAG | 8161 | CUCUCUGUA UGAAGAGA | 1019 |
| 6079 | GUGCUGAU CUGAUGA GCCGUUAGGC GAA ACGGUCCC | 8162 | GGGACCGUC AUCAGCAC | 1020 |
| 6082 | AAUGUGCU CUGAUGA GCCGUUAGGC GAA AUGACGGU | 8163 | ACCGUCAUC AGCACAUU | 1021 |
| 6090 | CACUAGGG CUGAUGA GCCGUUAGGC GAA AUGUGCUG | 8164 | CAGCACAUU CCCUAGUG | 1022 |
| 6091 | UCACUAGG CUGAUGA GCCGUUAGGC GAA AAUGUGCU | 8165 | AGCACAUUC CCUAGUGA | 1023 |
| 6095 | AGGCUCAC CUGAUGA GCCGUUAGGC GAA AGGGAAUG | 8166 | CAUUCCCUA GUGAGCCU | 1024 |
| 6104 | GGAGCCAG CUGAUGA GCCGUUAGGC GAA AGGCUCAC | 8167 | GUGAGCCUA CUGGCUCC | 1025 |
| 6111 | GCUGCCAG CUGAUGA GCCGUUAGGC GAA AGCCAGUA | 8168 | UACUGGCUC CUGGCAGC | 1026 |
| 6124 | UUCCACAA CUGAUGA GCCGUUAGGC GAA AGCCGCUG | 8169 | CAGCGGCUU UUGUGGAA | 1027 |
| 6125 | CUUCCACA CUGAUGA GCCGUUAGGC GAA AAGCCGCU | 8170 | AGCGGCUUU UGUGGAAG | 1028 |
| 6126 | UCUUCCAC CUGAUGA GCCGUUAGGC GAA AAAGCCGC | 8171 | GCGGCUUUU GUGGAAGA | 1029 |
| 6137 | UGGCUAGU CUGAUGA GCCGUUAGGC GAA AGUCUUCC | 8172 | GGAAGACUC ACUAGCCA | 1030 |
| 6141 | CUUCUGGC CUGAUGA GCCGUUAGGC GAA AGUGAGUC | 8173 | GACUCACUA GCCAGAAG | 1031 |

| | | | | |
|---|---|---|---|---|
| 6166 | GUGGAGAG CUGAUGA GCCGUUAGGC GAA ACUGUCCC | 8174 | GGGACAGUC CUCUCCAC | 1032 |
| 6169 | UUGGUGGA CUGAUGA GCCGUUAGGC GAA AGGACUGU | 8175 | ACAGUCCUC UCCACCAA | 1033 |
| 6171 | UCUUGGUG CUGAUGA GCCGUUAGGC GAA AGAGGACU | 8176 | AGUCCUCUC CACCAAGA | 1034 |
| 6181 | UGGAUUUA CUGAUGA GCCGUUAGGC GAA AUCUUGGU | 8177 | ACCAAGAUC UAAAUCCA | 1035 |
| 6183 | UUUGGAUU CUGAUGA GCCGUUAGGC GAA AGAUCUUG | 8178 | CAAGAUCUA AAUCCAAA | 1036 |
| 6187 | UUUGUUUG CUGAUGA GCCGUUAGGC GAA AUUUAGAU | 8179 | AUCUAAAUC CAAACAAA | 1037 |
| 6204 | UCUGGCUC CUGAUGA GCCGUUAGGC GAA AGCCUGCU | 8180 | AGCAGGCUA GAGCCAGA | 1038 |
| 6226 | ACAACAAA CUGAUGA GCCGUUAGGC GAA AUUUGUCC | 8181 | GGACAAAUC UUUGUUGU | 1039 |
| 6228 | GAACAACA CUGAUGA GCCGUUAGGC GAA AGAUUUGU | 8182 | ACAAAUCUU UGUUGUUC | 1040 |
| 6229 | GGAACAAC CUGAUGA GCCGUUAGGC GAA AAGAUUUG | 8183 | CAAAUCUUU GUUGUUCC | 1041 |
| 6232 | AGAGGAAC CUGAUGA GCCGUUAGGC GAA ACAAAGAU | 8184 | AUCUUUGUU GUUCCUCU | 1042 |
| 6235 | AGAAGAGG CUGAUGA GCCGUUAGGC GAA ACAACAAA | 8185 | UUUGUUGUU CCUCUUCU | 1043 |
| 6236 | AAGAAGAG CUGAUGA GCCGUUAGGC GAA AACAACAA | 8186 | UUGUUGUUC CUCUUCUU | 1044 |
| 6239 | GUAAAGAA CUGAUGA GCCGUUAGGC GAA AGGAACAA | 8187 | UUGUUCCUC UUCUUUAC | 1045 |
| 6241 | GUGUAAAG CUGAUGA GCCGUUAGGC GAA AGAGGAAC | 8188 | GUUCCUCUU CUUUACAC | 1046 |
| 6242 | UGUGUAAA CUGAUGA GCCGUUAGGC GAA AAGAGGAA | 8189 | UUCCUCUUC UUUACACA | 1047 |
| 6244 | UAUGUGUA CUGAUGA GCCGUUAGGC GAA AGAAGAGG | 8190 | CCUCUUCUU UACACAUA | 1048 |
| 6245 | GUAUGUGU CUGAUGA GCCGUUAGGC GAA AAGAAGAG | 8191 | CUCUUCUUU ACACAUAC | 1049 |
| 6246 | CGUAUGUG CUGAUGA GCCGUUAGGC GAA AAAGAAGA | 8192 | UCUUCUUUA CACAUACG | 1050 |
| 6252 | GGUUUGCG CUGAUGA GCCGUUAGGC GAA AUGUGUAA | 8193 | UUACACAUA CGCAAACC | 1051 |
| 6280 | AUUUAUAA CUGAUGA GCCGUUAGGC GAA AUUGCCAG | 8194 | CUGGCAAUU UUAUAAAU | 1052 |
| 6281 | GAUUUAUA CUGAUGA GCCGUUAGGC GAA AAUUGCCA | 8195 | UGGCAAUUU UAUAAAUC | 1053 |
| 6282 | UGAUUUAU CUGAUGA GCCGUUAGGC GAA AAAUUGCC | 8196 | GGCAAUUUU AUAAAUCA | 1054 |
| 6283 | CUGAUUUA CUGAUGA GCCGUUAGGC GAA AAAAUUGC | 8197 | GCAAUUUUA UAAAUCAG | 1055 |
| 6285 | ACCUGAUU CUGAUGA GCCGUUAGGC GAA AUAAAAUU | 8198 | AAUUUUAUA AAUCAGGU | 1056 |
| 6289 | AGUUACCU CUGAUGA GCCGUUAGGC GAA AUUUAUAA | 8199 | UUAUAAAUC AGGUAACU | 1057 |
| 6294 | CUUCCAGU CUGAUGA GCCGUUAGGC GAA ACCUGAUU | 8200 | AAUCAGGUA ACUGGAAG | 1058 |
| 6308 | CUGAGUUU CUGAUGA GCCGUUAGGC GAA ACCUCCUU | 8201 | AAGGAGGUU AAACUCAG | 1059 |
| 6309 | UCUGAGUU CUGAUGA GCCGUUAGGC GAA AACCUCCU | 8202 | AGGAGGUUA AACUCAGA | 1060 |
| 6314 | UUUUUUCU CUGAUGA GCCGUUAGGC GAA AGUUUAAC | 8203 | GUUAAACUC AGAAAAAA | 1061 |
| 6331 | AAUUGACU CUGAUGA GCCGUUAGGC GAA AGGUCUUC | 8204 | GAAGACCUC AGUCAAUU | 1062 |
| 6335 | AGAGAAUU CUGAUGA GCCGUUAGGC GAA ACUGAGGU | 8205 | ACCUCAGUC AAUUCUCU | 1063 |
| 6339 | AAGUAGAG CUGAUGA GCCGUUAGGC GAA AUUGACUG | 8206 | CAGUCAAUU CUCUACUU | 1064 |

| | | | | |
|---|---|---|---|---|
| 6340 | AAAGUAGA CUGAUGA GCCGUUAGGC GAA AAUUGACU | 8207 | AGUCAAUUC UCUACUUU | 1065 |
| 6342 | AAAAAGUA CUGAUGA GCCGUUAGGC GAA AGAAUUGA | 8208 | UCAAUUCUC UACUUUUU | 1066 |
| 6344 | AAAAAAAG CUGAUGA GCCGUUAGGC GAA AGAGAAUU | 8209 | AAUUCUCUA CUUUUUUU | 1067 |
| 6347 | AAAAAAAA CUGAUGA GCCGUUAGGC GAA AGUAGAGA | 8210 | UCUCUACUU UUUUUUUU | 1068 |
| 6348 | AAAAAAAA CUGAUGA GCCGUUAGGC GAA AAGUAGAG | 8211 | CUCUACUUU UUUUUUUU | 1069 |
| 6349 | AAAAAAAA CUGAUGA GCCGUUAGGC GAA AAAGUAGA | 8212 | UCUACUUUU UUUUUUUU | 1070 |
| 6350 | AAAAAAAA CUGAUGA GCCGUUAGGC GAA AAAAGUAG | 8213 | CUACUUUUU UUUUUUUU | 1071 |
| 6351 | AAAAAAAA CUGAUGA GCCGUUAGGC GAA AAAAAGUA | 8214 | UACUUUUUU UUUUUUUU | 1072 |
| 6352 | AAAAAAAA CUGAUGA GCCGUUAGGC GAA AAAAAAGU | 8215 | ACUUUUUUU UUUUUUUU | 1073 |
| 6353 | AAAAAAAA CUGAUGA GCCGUUAGGC GAA AAAAAAAG | 8216 | CUUUUUUUU UUUUUUUU | 1074 |
| 6354 | GAAAAAAA CUGAUGA GCCGUUAGGC GAA AAAAAAAA | 8217 | UUUUUUUUU UUUUUUUC | 1075 |
| 6355 | GGAAAAAA CUGAUGA GCCGUUAGGC GAA AAAAAAAA | 8218 | UUUUUUUUU UUUUUUCC | 1076 |
| 6356 | UGGAAAAA CUGAUGA GCCGUUAGGC GAA AAAAAAAA | 8219 | UUUUUUUUU UUUUUCCA | 1077 |
| 6357 | UUGGAAAA CUGAUGA GCCGUUAGGC GAA AAAAAAAA | 8220 | UUUUUUUUU UUUUCCAA | 1078 |
| 6358 | UUUGGAAA CUGAUGA GCCGUUAGGC GAA AAAAAAAA | 8221 | UUUUUUUUU UUUCCAAA | 1079 |
| 6359 | AUUUGGAA CUGAUGA GCCGUUAGGC GAA AAAAAAAA | 8222 | UUUUUUUUU UUCCAAAU | 1080 |
| 6360 | GAUUUGGA CUGAUGA GCCGUUAGGC GAA AAAAAAAA | 8223 | UUUUUUUUU UCCAAAUC | 1081 |
| 6361 | UGAUUUGG CUGAUGA GCCGUUAGGC GAA AAAAAAAA | 8224 | UUUUUUUUU CCAAAUCA | 1082 |
| 6362 | CUGAUUUG CUGAUGA GCCGUUAGGC GAA AAAAAAAA | 8225 | UUUUUUUUC CAAAUCAG | 1083 |
| 6368 | UAUUAUCU CUGAUGA GCCGUUAGGC GAA AUUUGGAA | 8226 | UUCCAAAUC AGAUAAUA | 1084 |
| 6373 | UGGGCUAU CUGAUGA GCCGUUAGGC GAA AUCUGAUU | 8227 | AAUCAGAUA AUAGCCCA | 1085 |
| 6376 | UGCUGGGC CUGAUGA GCCGUUAGGC GAA AUUAUCUG | 8228 | CAGAUAAUA GCCCAGCA | 1086 |
| 6388 | GUUAUCAC CUGAUGA GCCGUUAGGC GAA AUUUGCUG | 8229 | CAGCAAAUA GUGAUAAC | 1087 |
| 6394 | UUAUUUGU CUGAUGA GCCGUUAGGC GAA AUCACUAU | 8230 | AUAGUGAUA ACAAAUAA | 1088 |
| 6401 | UAAGGUUU CUGAUGA GCCGUUAGGC GAA AUUUGUUA | 8231 | UAACAAAUA AAACCUUA | 1089 |
| 6408 | GAACAGCU CUGAUGA GCCGUUAGGC GAA AGGUUUUA | 8232 | UAAAACCUU AGCUGUUC | 1090 |
| 6409 | UGAACAGC CUGAUGA GCCGUUAGGC GAA AAGGUUUU | 8233 | AAAACCUUA GCUGUUCA | 1091 |
| 6415 | AAGACAUG CUGAUGA GCCGUUAGGC GAA ACAGCUAA | 8234 | UUAGCUGUU CAUGUCUU | 1092 |
| 6416 | CAAGACAU CUGAUGA GCCGUUAGGC GAA AACAGCUA | 8235 | UAGCUGUUC AUGUCUUG | 1093 |
| 6421 | GAAAUCAA CUGAUGA GCCGUUAGGC GAA ACAUGAAC | 8236 | GUUCAUGUC UUGAUUUC | 1094 |
| 6423 | UUGAAAUC CUGAUGA GCCGUUAGGC GAA AGACAUGA | 8237 | UCAUGUCUU GAUUUCAA | 1095 |
| 6427 | AUUAUUGA CUGAUGA GCCGUUAGGC GAA AUCAAGAC | 8238 | GUCUUGAUU UCAAUAAU | 1096 |
| 6428 | AAUUAUUG CUGAUGA GCCGUUAGGC GAA AAUCAAGA | 8239 | UCUUGAUUU CAAUAAUU | 1097 |

107

| | | | | |
|---|---|---|---|---|
| 6429 | UAAUUAUU CUGAUGA GCCGUUAGGC GAA AAAUCAAG | 8240 | CUUGAUUUC AAUAAUUA | 1098 |
| 6433 | GAAUUAAU CUGAUGA GCCGUUAGGC GAA AUUGAAAU | 8241 | AUUUCAAUA AUUAAUUC | 1099 |
| 6436 | UAAGAAUU CUGAUGA GCCGUUAGGC GAA AUUAUUGA | 8242 | UCAAUAAUU AAUUCUUA | 1100 |
| 6437 | UUAAGAAU CUGAUGA GCCGUUAGGC GAA AAUUAUUG | 8243 | CAAUAAUUA AUUCUUAA | 1101 |
| 6440 | UGAUUAAG CUGAUGA GCCGUUAGGC GAA AUUAAUUA | 8244 | UAAUUAAUU CUUAAUCA | 1102 |
| 6441 | AUGAUUAA CUGAUGA GCCGUUAGGC GAA AAUUAAUU | 8245 | AAUUAAUUC UUAAUCAU | 1103 |
| 6443 | UAAUGAUU CUGAUGA GCCGUUAGGC GAA AGAAUUAA | 8246 | UUAAUUCUU AAUCAUUA | 1104 |
| 6444 | UUAAUGAU CUGAUGA GCCGUUAGGC GAA AAGAAUUA | 8247 | UAAUUCUUA AUCAUUAA | 1105 |
| 6447 | CUCUUAAU CUGAUGA GCCGUUAGGC GAA AUUAAGAA | 8248 | UUCUUAAUC AUUAAGAG | 1106 |
| 6450 | GGUCUCUU CUGAUGA GCCGUUAGGC GAA AUGAUUAA | 8249 | UUAAUCAUU AAGAGACC | 1107 |
| 6451 | UGGUCUCU CUGAUGA GCCGUUAGGC GAA AAUGAUUA | 8250 | UAAUCAUUA AGAGACCA | 1108 |
| 6461 | GUAUUUAU CUGAUGA GCCGUUAGGC GAA AUGGUCUC | 8251 | GAGACCAUA AUAAAUAC | 1109 |
| 6464 | GGAGUAUU CUGAUGA GCCGUUAGGC GAA AUUAUGGU | 8252 | ACCAUAAUA AAUACUCC | 1110 |
| 6468 | AAAAGGAG CUGAUGA GCCGUUAGGC GAA AUUUAUUA | 8253 | UAAUAAAUA CUCCUUUU | 1111 |
| 6471 | UUGAAAAG CUGAUGA GCCGUUAGGC GAA AGUAUUUA | 8254 | UAAAUACUC CUUUUCAA | 1112 |
| 6474 | CUCUUGAA CUGAUGA GCCGUUAGGC GAA AGGAGUAU | 8255 | AUACUCCUU UUCAAGAG | 1113 |
| 6475 | UCUCUUGA CUGAUGA GCCGUUAGGC GAA AAGGAGUA | 8256 | UACUCCUUU UCAAGAGA | 1114 |
| 6476 | UUCUCUUG CUGAUGA GCCGUUAGGC GAA AAAGGAGU | 8257 | ACUCCUUUU CAAGAGAA | 1115 |
| 6477 | UUUCUCUU CUGAUGA GCCGUUAGGC GAA AAAAGGAG | 8258 | CUCCUUUUC AAGAGAAA | 1116 |
| 6497 | ACAAUUCU CUGAUGA GCCGUUAGGC GAA AUGGUUUU | 8259 | AAAACCAUU AGAAUUGU | 1117 |
| 6498 | AACAAUUC CUGAUGA GCCGUUAGGC GAA AAUGGUUU | 8260 | AAACCAUUA GAAUUGUU | 1118 |
| 6503 | UGAGUAAC CUGAUGA GCCGUUAGGC GAA AUUCUAAU | 8261 | AUUAGAAUU GUUACUCA | 1119 |
| 6506 | AGCUGAGU CUGAUGA GCCGUUAGGC GAA ACAAUUCU | 8262 | AGAAUUGUU ACUCAGCU | 1120 |
| 6507 | GAGCUGAG CUGAUGA GCCGUUAGGC GAA AACAAUUC | 8263 | GAAUUGUUA CUCAGCUC | 1121 |
| 6510 | AAGGAGCU CUGAUGA GCCGUUAGGC GAA AGUAACAA | 8264 | UUGUUACUC AGCUCCUU | 1122 |
| 6515 | GUUUGAAG CUGAUGA GCCGUUAGGC GAA AGCUGAGU | 8265 | ACUCAGCUC CUUCAAAC | 1123 |
| 6518 | UGAGUUUG CUGAUGA GCCGUUAGGC GAA AGGAGCUG | 8266 | CAGCUCCUU CAAACUCA | 1124 |
| 6519 | CUGAGUUU CUGAUGA GCCGUUAGGC GAA AAGGAGCU | 8267 | AGCUCCUUC AAACUCAG | 1125 |
| 6525 | ACAAACCU CUGAUGA GCCGUUAGGC GAA AGUUUGAA | 8268 | UUCAAACUC AGGUUUGU | 1126 |
| 6530 | AUGCUACA CUGAUGA GCCGUUAGGC GAA ACCUGAGU | 8269 | ACUCAGGUU UGUAGCAU | 1127 |
| 6531 | UAUGCUAC CUGAUGA GCCGUUAGGC GAA AACCUGAG | 8270 | CUCAGGUUU GUAGCAUA | 1128 |
| 6534 | AUGUAUGC CUGAUGA GCCGUUAGGC GAA ACAAACCU | 8271 | AGGUUUGUA GCAUACAU | 1129 |
| 6539 | GACUCAUG CUGAUGA GCCGUUAGGC GAA AUGCUACA | 8272 | UGUAGCAUA CAUGAGUC | 1130 |

108

| | | | | |
|---|---|---|---|---|
| 6547 | GAUGGAUG CUGAUGA GCCGUUAGGC GAA ACUCAUGU | 8273 | ACAUGAGUC CAUCCAUC | 1131 |
| 6551 | GACUGAUG CUGAUGA GCCGUUAGGC GAA AUGGACUC | 8274 | GAGUCCAUC CAUCAGUC | 1132 |
| 6555 | CUUUGACU CUGAUGA GCCGUUAGGC GAA AUGGAUGG | 8275 | CCAUCCAUC AGUCAAAG | 1133 |
| 6559 | CAUUCUUU CUGAUGA GCCGUUAGGC GAA ACUGAUGG | 8276 | CCAUCAGUC AAAGAAUG | 1134 |
| 6570 | CCAGAUGG CUGAUGA GCCGUUAGGC GAA ACCAUUCU | 8277 | AGAAUGGUU CCAUCUGG | 1135 |
| 6571 | UCCAGAUG CUGAUGA GCCGUUAGGC GAA AACCAUUC | 8278 | GAAUGGUUC CAUCUGGA | 1136 |
| 6575 | AGACUCCA CUGAUGA GCCGUUAGGC GAA AUGGAACC | 8279 | GGUUCCAUC UGGAGUCU | 1137 |
| 6582 | UACAUUAA CUGAUGA GCCGUUAGGC GAA ACUCCAGA | 8280 | UCUGGAGUC UUAAUGUA | 1138 |
| 6584 | UCUACAUU CUGAUGA GCCGUUAGGC GAA AGACUCCA | 8281 | UGGAGUCUU AAUGUAGA | 1139 |
| 6585 | UUCUACAU CUGAUGA GCCGUUAGGC GAA AAGACUCC | 8282 | GGAGUCUUA AUGUAGAA | 1140 |
| 6590 | UUUCUUUC CUGAUGA GCCGUUAGGC GAA ACAUUAAG | 8283 | CUUAAUGUA GAAAGAAA | 1141 |
| 6609 | AUUAUUAC CUGAUGA GCCGUUAGGC GAA AGUCUCCA | 8284 | UGGAGACUU GUAAUAAU | 1142 |
| 6612 | CUCAUUAU CUGAUGA GCCGUUAGGC GAA ACAAGUCU | 8285 | AGACUUGUA AUAAUGAG | 1143 |
| 6615 | UAGCUCAU CUGAUGA GCCGUUAGGC GAA AUUACAAG | 8286 | CUUGUAAUA AUGAGCUA | 1144 |
| 6623 | UUUGUAAC CUGAUGA GCCGUUAGGC GAA AGCUCAUU | 8287 | AAUGAGCUA GUUACAAA | 1145 |
| 6626 | CACUUUGU CUGAUGA GCCGUUAGGC GAA ACUAGCUC | 8288 | GAGCUAGUU ACAAAGUG | 1146 |
| 6627 | GCACUUUG CUGAUGA GCCGUUAGGC GAA AACUAGCU | 8289 | AGCUAGUUA CAAAGUGC | 1147 |
| 6637 | UAAUGAAC CUGAUGA GCCGUUAGGC GAA AGCACUUU | 8290 | AAAGUGCUU GUUCAUUA | 1148 |
| 6640 | UUUUAAUG CUGAUGA GCCGUUAGGC GAA ACAAGCAC | 8291 | GUGCUUGUU CAUUAAAA | 1149 |
| 6641 | AUUUUAAU CUGAUGA GCCGUUAGGC GAA AACAAGCA | 8292 | UGCUUGUUC AUUAAAAU | 1150 |
| 6644 | GCUAUUUU CUGAUGA GCCGUUAGGC GAA AUGAACAA | 8293 | UUGUUCAUU AAAAUAGC | 1151 |
| 6645 | UGCUAUUU CUGAUGA GCCGUUAGGC GAA AAUGAACA | 8294 | UGUUCAUUA AAAUAGCA | 1152 |
| 6650 | UUCAGUGC CUGAUGA GCCGUUAGGC GAA AUUUUAAU | 8295 | AUUAAAAUA GCACUGAA | 1153 |
| 6662 | CAUGUUUC CUGAUGA GCCGUUAGGC GAA AUUUUCAG | 8296 | CUGAAAAUU GAAACAUG | 1154 |
| 6674 | UAUCAGUU CUGAUGA GCCGUUAGGC GAA AUUCAUGU | 8297 | ACAUGAAUU AACUGAUA | 1155 |
| 6675 | UUAUCAGU CUGAUGA GCCGUUAGGC GAA AAUUCAUG | 8298 | CAUGAAUUA ACUGAUAA | 1156 |
| 6682 | UGGAAUAU CUGAUGA GCCGUUAGGC GAA AUCAGUUA | 8299 | UAACUGAUA AUAUUCCA | 1157 |
| 6685 | GAUUGGAA CUGAUGA GCCGUUAGGC GAA AUUAUCAG | 8300 | CUGAUAAUA UUCCAAUC | 1158 |
| 6687 | AUGAUUGG CUGAUGA GCCGUUAGGC GAA AUAUUAUC | 8301 | GAUAAUAUU CCAAUCAU | 1159 |
| 6688 | AAUGAUUG CUGAUGA GCCGUUAGGC GAA AAUAUUAU | 8302 | AUAAUAUUC CAAUCAUU | 1160 |
| 6693 | UGGCAAAU CUGAUGA GCCGUUAGGC GAA AUUGGAAU | 8303 | AUUCCAAUC AUUUGCCA | 1161 |
| 6696 | AAAUGGCA CUGAUGA GCCGUUAGGC GAA AUGAUUGG | 8304 | CCAAUCAUU UGCCAUUU | 1162 |
| 6697 | UAAAUGGC CUGAUGA GCCGUUAGGC GAA AAUGAUUG | 8305 | CAAUCAUUU GCCAUUUA | 1163 |

109

| | | | | |
|---|---|---|---|---|
| 6703 | UUGUCAUA CUGAUGA GCCGUUAGGC GAA AUGGCAAA | 8306 | UUUGCCAUU UAUGACAA | 1164 |
| 6704 | UUUGUCAU CUGAUGA GCCGUUAGGC GAA AAUGGCAA | 8307 | UUGCCAUUU AUGACAAA | 1165 |
| 6705 | UUUUGUCA CUGAUGA GCCGUUAGGC GAA AAAUGGCA | 8308 | UGCCAUUUA UGACAAAA | 1166 |
| 6719 | UUAGUGCC CUGAUGA GCCGUUAGGC GAA ACCAUUUU | 8309 | AAAAUGGUU GGCACUAA | 1167 |
| 6726 | UUCUUUGU CUGAUGA GCCGUUAGGC GAA AGUGCCAA | 8310 | UUGGCACUA ACAAAGAA | 1168 |
| 6743 | CUGAAAGG CUGAUGA GCCGUUAGGC GAA AGUGCUCG | 8311 | CGAGCACUU CCUUUCAG | 1169 |
| 6744 | UCUGAAAG CUGAUGA GCCGUUAGGC GAA AAGUGCUC | 8312 | GAGCACUUC CUUUCAGA | 1170 |
| 6747 | AACUCUGA CUGAUGA GCCGUUAGGC GAA AGGAAGUG | 8313 | CACUUCCUU UCAGAGUU | 1171 |
| 6748 | AAACUCUG CUGAUGA GCCGUUAGGC GAA AAGGAAGU | 8314 | ACUUCCUUU CAGAGUUU | 1172 |
| 6749 | GAAACUCU CUGAUGA GCCGUUAGGC GAA AAAGGAAG | 8315 | CUUCCUUUC AGAGUUUC | 1173 |
| 6755 | AUCUCAGA CUGAUGA GCCGUUAGGC GAA ACUCUGAA | 8316 | UUCAGAGUU UCUGAGAU | 1174 |
| 6756 | UAUCUCAG CUGAUGA GCCGUUAGGC GAA AACUCUGA | 8317 | UCAGAGUUU CUGAGAUA | 1175 |
| 6757 | UUAUCUCA CUGAUGA GCCGUUAGGC GAA AAACUCUG | 8318 | CAGAGUUUC UGAGAUAA | 1176 |
| 6764 | ACGUACAU CUGAUGA GCCGUUAGGC GAA AUCUCAGA | 8319 | UCUGAGAUA AUGUACGU | 1177 |
| 6769 | GUUCCACG CUGAUGA GCCGUUAGGC GAA ACAUUAUC | 8320 | GAUAAUGUA CGUGGAAC | 1178 |
| 6781 | UCCACCCA CUGAUGA GCCGUUAGGC GAA ACUGUUCC | 8321 | GGAACAGUC UGGGUGGA | 1179 |
| 6814 | AAGACACA CUGAUGA GCCGUUAGGC GAA ACUUGCAC | 8322 | GUGCAAGUC UGUGUCUU | 1180 |
| 6820 | ACUGACAA CUGAUGA GCCGUUAGGC GAA ACACAGAC | 8323 | GUCUGUGUC UUGUCAGU | 1181 |
| 6822 | GGACUGAC CUGAUGA GCCGUUAGGC GAA AGACACAG | 8324 | CUGUGUCUU GUCAGUCC | 1182 |
| 6825 | CUUGGACU CUGAUGA GCCGUUAGGC GAA ACAAGACA | 8325 | UGUCUUGUC AGUCCAAG | 1183 |
| 6829 | ACUUCUUG CUGAUGA GCCGUUAGGC GAA ACUGACAA | 8326 | UUGUCAGUC CAAGAAGU | 1184 |
| 6851 | CUAAAAUU CUGAUGA GCCGUUAGGC GAA ACAUCUCG | 8327 | CGAGAUGUU AAUUUUAG | 1185 |
| 6852 | CCUAAAAU CUGAUGA GCCGUUAGGC GAA AACAUCUC | 8328 | GAGAUGUUA AUUUUAGG | 1186 |
| 6855 | GUCCCUAA CUGAUGA GCCGUUAGGC GAA AUUAACAU | 8329 | AUGUUAAUU UUAGGGAC | 1187 |
| 6856 | GGUCCCUA CUGAUGA GCCGUUAGGC GAA AAUUAACA | 8330 | UGUUAAUUU UAGGGACC | 1188 |
| 6857 | GGGUCCCU CUGAUGA GCCGUUAGGC GAA AAAUUAAC | 8331 | GUUAAUUUU AGGGACCC | 1189 |
| 6858 | CGGGUCCC CUGAUGA GCCGUUAGGC GAA AAAAUUAA | 8332 | UUAAUUUUA GGGACCCG | 1190 |
| 6872 | UAGGAAAC CUGAUGA GCCGUUAGGC GAA AGGCACGG | 8333 | CCGUGCCUU GUUUCCUA | 1191 |
| 6875 | GGCUAGGA CUGAUGA GCCGUUAGGC GAA ACAAGGCA | 8334 | UGCCUUGUU UCCUAGCC | 1192 |
| 6876 | GGGCUAGG CUGAUGA GCCGUUAGGC GAA AACAAGGC | 8335 | GCCUUGUUU CCUAGCCC | 1193 |
| 6877 | UGGGCUAG CUGAUGA GCCGUUAGGC GAA AAACAAGG | 8336 | CCUUGUUUC CUAGCCCA | 1194 |
| 6880 | UUGUGGGC CUGAUGA GCCGUUAGGC GAA AGGAAACA | 8337 | UGUUUCCUA GCCCACAA | 1195 |
| 6901 | AUCUGUUU CUGAUGA GCCGUUAGGC GAA AUGUUUGC | 8338 | GCAAACAUC AAACAGAU | 1196 |

110

| | | | | |
|---|---|---|---|---|
| 6910 | CUAGCGAG CUGAUGA GCCGUUAGGC GAA AUCUGUUU | 8339 | AAACAGAUA CUCGCUAG | 1197 |
| 6913 | AGGCUAGC CUGAUGA GCCGUUAGGC GAA AGUAUCUG | 8340 | CAGAUACUC GCUAGCCU | 1198 |
| 6917 | AAUGAGGC CUGAUGA GCCGUUAGGC GAA AGCGAGUA | 8341 | UACUCGCUA GCCUCAUU | 1199 |
| 6922 | AUUUAAAU CUGAUGA GCCGUUAGGC GAA AGGCUAGC | 8342 | GCUAGCCUC AUUUAAAU | 1200 |
| 6925 | UCAAUUUA CUGAUGA GCCGUUAGGC GAA AUGAGGCU | 8343 | AGCCUCAUU UAAAUUGA | 1201 |
| 6926 | AUCAAUUU CUGAUGA GCCGUUAGGC GAA AAUGAGGC | 8344 | GCCUCAUUU AAAUUGAU | 1202 |
| 6927 | AAUCAAUU CUGAUGA GCCGUUAGGC GAA AAAUGAGG | 8345 | CCUCAUUUA AAUUGAUU | 1203 |
| 6931 | CUUUAAUC CUGAUGA GCCGUUAGGC GAA AUUUAAAU | 8346 | AUUUAAAUU GAUUAAAG | 1204 |
| 6935 | CCUCCUUU CUGAUGA GCCGUUAGGC GAA AUCAAUUU | 8347 | AAAUUGAUU AAAGGAGG | 1205 |
| 6936 | UCCUCCUU CUGAUGA GCCGUUAGGC GAA AAUCAAUU | 8348 | AAUUGAUUA AAGGAGGA | 1206 |
| 6951 | CGGCCAAA CUGAUGA GCCGUUAGGC GAA AUGCACUC | 8349 | GAGUGCAUC UUUGGCCG | 1207 |
| 6953 | GUCGGCCA CUGAUGA GCCGUUAGGC GAA AGAUGCAC | 8350 | GUGCAUCUU UGGCCGAC | 1208 |
| 6954 | UGUCGGCC CUGAUGA GCCGUUAGGC GAA AAGAUGCA | 8351 | UGCAUCUUU GGCCGACA | 1209 |
| 6970 | CACACAGU CUGAUGA GCCGUUAGGC GAA ACACCACU | 8352 | AGUGGUGUA ACUGUGUG | 1210 |
| 7026 | AACACACA CUGAUGA GCCGUUAGGC GAA ACACCCAC | 8353 | GUGGGUGUA UGUGUGUU | 1211 |
| 7034 | AUGCACAA CUGAUGA GCCGUUAGGC GAA ACACACAU | 8354 | AUGUGUGUU UUGUGCAU | 1212 |
| 7035 | UAUGCACA CUGAUGA GCCGUUAGGC GAA AACACACA | 8355 | UGUGUGUUU UGUGCAUA | 1213 |
| 7036 | UUAUGCAC CUGAUGA GCCGUUAGGC GAA AAACACAC | 8356 | GUGUGUUUU GUGCAUAA | 1214 |
| 7043 | UAAAUAGU CUGAUGA GCCGUUAGGC GAA AUGCACAA | 8357 | UUGUGCAUA ACUAUUUA | 1215 |
| 7047 | UCCUUAAA CUGAUGA GCCGUUAGGC GAA AGUUAUGC | 8358 | GCAUAACUA UUUAAGGA | 1216 |
| 7049 | UUUCCUUA CUGAUGA GCCGUUAGGC GAA AUAGUUAU | 8359 | AUAACUAUU UAAGGAAA | 1217 |
| 7050 | GUUUCCUU CUGAUGA GCCGUUAGGC GAA AAUAGUUA | 8360 | UAACUAUUU AAGGAAAC | 1218 |
| 7051 | AGUUUCCU CUGAUGA GCCGUUAGGC GAA AAAUAGUU | 8361 | AACUAUUUA AGGAAACU | 1219 |
| 7065 | AACUUUAA CUGAUGA GCCGUUAGGC GAA AUUCCAGU | 8362 | ACUGGAAUU UUAAAGUU | 1220 |
| 7066 | UAACUUUA CUGAUGA GCCGUUAGGC GAA AAUUCCAG | 8363 | CUGGAAUUU UAAAGUUA | 1221 |
| 7067 | GUAACUUU CUGAUGA GCCGUUAGGC GAA AAAUUCCA | 8364 | UGGAAUUUU AAAGUUAC | 1222 |
| 7068 | AGUAACUU CUGAUGA GCCGUUAGGC GAA AAAAUUCC | 8365 | GGAAUUUUA AAGUUACU | 1223 |
| 7073 | AUAAAAGU CUGAUGA GCCGUUAGGC GAA ACUUUAAA | 8366 | UUUAAAGUU ACUUUUAU | 1224 |
| 7074 | UAUAAAAG CUGAUGA GCCGUUAGGC GAA AACUUUAA | 8367 | UUAAAGUUA CUUUUAUA | 1225 |
| 7077 | UUGUAUAA CUGAUGA GCCGUUAGGC GAA AGUAACUU | 8368 | AAGUUACUU UUAUACAA | 1226 |
| 7078 | UUUGUAUA CUGAUGA GCCGUUAGGC GAA AAGUAACU | 8369 | AGUUACUUU UAUACAAA | 1227 |
| 7079 | GUUUGUAU CUGAUGA GCCGUUAGGC GAA AAAGUAAC | 8370 | GUUACUUUU AUACAAAC | 1228 |
| 7080 | GGUUUGUA CUGAUGA GCCGUUAGGC GAA AAAAGUAA | 8371 | UUACUUUUA UACAAACC | 1229 |

111

| | | | | |
|---|---|---|---|---|
| 7082 | UUGGUUUG CUGAUGA GCCGUUAGGC GAA AUAAAAGU | 8372 | ACUUUUAUA CAAACCAA | 1230 |
| 7095 | GUAGCAUA CUGAUGA GCCGUUAGGC GAA AUUCUUGG | 8373 | CCAAGAAUA UAUGCUAC | 1231 |
| 7097 | CUGUAGCA CUGAUGA GCCGUUAGGC GAA AUAUUCUU | 8374 | AAGAAUAUA UGCUACAG | 1232 |
| 7102 | UAUAUCUG CUGAUGA GCCGUUAGGC GAA AGCAUAUA | 8375 | UAUAUGCUA CAGAUAUA | 1233 |
| 7108 | CUGUCUUA CUGAUGA GCCGUUAGGC GAA AUCUGUAG | 8376 | CUACAGAUA UAAGACAG | 1234 |
| 7110 | GUCUGUCU CUGAUGA GCCGUUAGGC GAA AUAUCUGU | 8377 | ACAGAUAUA AGACAGAC | 1235 |
| 7124 | UAGGACCA CUGAUGA GCCGUUAGGC GAA ACCAUGUC | 8378 | GACAUGGUU UGGUCCUA | 1236 |
| 7125 | AUAGGACC CUGAUGA GCCGUUAGGC GAA AACCAUGU | 8379 | ACAUGGUUU GGUCCUAU | 1237 |
| 7129 | AAAUAUAG CUGAUGA GCCGUUAGGC GAA ACCAAACC | 8380 | GGUUUGGUC CUAUAUUU | 1238 |
| 7132 | UAGAAAUA CUGAUGA GCCGUUAGGC GAA AGGACCAA | 8381 | UUGGUCCUA UAUUUCUA | 1239 |
| 7134 | ACUAGAAA CUGAUGA GCCGUUAGGC GAA AUAGGACC | 8382 | GGUCCUAUA UUUCUAGU | 1240 |
| 7136 | UGACUAGA CUGAUGA GCCGUUAGGC GAA AUAUAGGA | 8383 | UCCUAUAUU UCUAGUCA | 1241 |
| 7137 | AUGACUAG CUGAUGA GCCGUUAGGC GAA AAUAUAGG | 8384 | CCUAUAUUU CUAGUCAU | 1242 |
| 7138 | CAUGACUA CUGAUGA GCCGUUAGGC GAA AAAUAUAG | 8385 | CUAUAUUUC UAGUCAUG | 1243 |
| 7140 | AUCAUGAC CUGAUGA GCCGUUAGGC GAA AGAAAUAU | 8386 | AUAUUUCUA GUCAUGAU | 1244 |
| 7143 | UUCAUCAU CUGAUGA GCCGUUAGGC GAA ACUAGAAA | 8387 | UUUCUAGUC AUGAUGAA | 1245 |
| 7155 | AUACAAAA CUGAUGA GCCGUUAGGC GAA ACAUUCAU | 8388 | AUGAAUGUA UUUUGUAU | 1246 |
| 7157 | GUAUACAA CUGAUGA GCCGUUAGGC GAA AUACAUUC | 8389 | GAAUGUAUU UUGUAUAC | 1247 |
| 7158 | GGUAUACA CUGAUGA GCCGUUAGGC GAA AAUACAUU | 8390 | AAUGUAUUU UGUAUACC | 1248 |
| 7159 | UGGUAUAC CUGAUGA GCCGUUAGGC GAA AAAUACAU | 8391 | AUGUAUUUU GUAUACCA | 1249 |
| 7162 | AGAUGGUA CUGAUGA GCCGUUAGGC GAA ACAAAAUA | 8392 | UAUUUUGUA UACCAUCU | 1250 |
| 7164 | GAAGAUGG CUGAUGA GCCGUUAGGC GAA AUACAAAA | 8393 | UUUUGUAUA CCAUCUUC | 1251 |
| 7169 | UAUAUGAA CUGAUGA GCCGUUAGGC GAA AUGGUAUA | 8394 | UAUACCAUC UUCAUAUA | 1252 |
| 7171 | AUUAUAUG CUGAUGA GCCGUUAGGC GAA AGAUGGUA | 8395 | UACCAUCUU CAUAUAAU | 1253 |
| 7172 | UAUUAUAU CUGAUGA GCCGUUAGGC GAA AAGAUGGU | 8396 | ACCAUCUUC AUAUAAUA | 1254 |
| 7175 | GUAUAUUA CUGAUGA GCCGUUAGGC GAA AUGAAGAU | 8397 | AUCUUCAUA UAAUAUAC | 1255 |
| 7177 | AAGUAUAU CUGAUGA GCCGUUAGGC GAA AUAUGAAG | 8398 | CUUCAUAUA AUAUACUU | 1256 |
| 7180 | UUUAAGUA CUGAUGA GCCGUUAGGC GAA AUUAUAUG | 8399 | CAUAUAAUA UACUUAAA | 1257 |
| 7182 | UUUUUAAG CUGAUGA GCCGUUAGGC GAA AUAUUAUA | 8400 | UAUAAUAUA CUUAAAAA | 1258 |
| 7185 | AUAUUUUU CUGAUGA GCCGUUAGGC GAA AGUAUAUU | 8401 | AAUAUACUU AAAAAUAU | 1259 |
| 7186 | AAUAUUUU CUGAUGA GCCGUUAGGC GAA AAGUAUAU | 8402 | AUAUACUUA AAAAUAUU | 1260 |
| 7192 | UUAAGAAA CUGAUGA GCCGUUAGGC GAA AUUUUUAA | 8403 | UUAAAAAUA UUUCUUAA | 1261 |
| 7194 | AAUUAAGA CUGAUGA GCCGUUAGGC GAA AUAUUUUU | 8404 | AAAAAUAUU UCUUAAUU | 1262 |

| | | | | |
|---|---|---|---|---|
| 7195 | CAAUUAAG CUGAUGA GCCGUUAGGC GAA AAUAUUUU | 8405 | AAAAUAUUU CUUAAUUG | 1263 |
| 7196 | CCAAUUAA CUGAUGA GCCGUUAGGC GAA AAAUAUUU | 8406 | AAAUAUUUC UUAAUUGG | 1264 |
| 7198 | UCCCAAUU CUGAUGA GCCGUUAGGC GAA AGAAAUAU | 8407 | AUAUUUCUU AAUUGGGA | 1265 |
| 7199 | AUCCCAAU CUGAUGA GCCGUUAGGC GAA AAGAAAUA | 8408 | UAUUUCUUA AUUGGGAU | 1266 |
| 7202 | CAAAUCCC CUGAUGA GCCGUUAGGC GAA AUUAAGAA | 8409 | UUCUUAAUU GGGAUUUG | 1267 |
| 7208 | CGAUUACA CUGAUGA GCCGUUAGGC GAA AUCCCAAU | 8410 | AUUGGGAUU UGUAAUCG | 1268 |
| 7209 | ACGAUUAC CUGAUGA GCCGUUAGGC GAA AAUCCCAA | 8411 | UUGGGAUUU GUAAUCGU | 1269 |
| 7212 | GGUACGAU CUGAUGA GCCGUUAGGC GAA ACAAAUCC | 8412 | GGAUUUGUA AUCGUACC | 1270 |
| 7215 | GUUGGUAC CUGAUGA GCCGUUAGGC GAA AUUACAAA | 8413 | UUUGUAAUC GUACCAAC | 1271 |
| 7218 | UAAGUUGG CUGAUGA GCCGUUAGGC GAA ACGAUUAC | 8414 | GUAAUCGUA CCAACUUA | 1272 |
| 7225 | UAUCAAUU CUGAUGA GCCGUUAGGC GAA AGUUGGUA | 8415 | UACCAACUU AAUUGAUA | 1273 |
| 7226 | UUAUCAAU CUGAUGA GCCGUUAGGC GAA AAGUUGGU | 8416 | ACCAACUUA AUUGAUAA | 1274 |
| 7229 | AGUUUAUC CUGAUGA GCCGUUAGGC GAA AUUAAGUU | 8417 | AACUUAAUU GAUAAACU | 1275 |
| 7233 | GCCAAGUU CUGAUGA GCCGUUAGGC GAA AUCAAUUA | 8418 | UAAUUGAUA AACUUGGC | 1276 |
| 7238 | CAGUUGCC CUGAUGA GCCGUUAGGC GAA AGUUUAUC | 8419 | GAUAAACUU GGCAACUG | 1277 |
| 7249 | GAACAUAA CUGAUGA GCCGUUAGGC GAA AGCAGUUG | 8420 | CAACUGCUU UUAUGUUC | 1278 |
| 7250 | AGAACAUA CUGAUGA GCCGUUAGGC GAA AAGCAGUU | 8421 | AACUGCUUU UAUGUUCU | 1279 |
| 7251 | CAGAACAU CUGAUGA GCCGUUAGGC GAA AAAGCAGU | 8422 | ACUGCUUUU AUGUUCUG | 1280 |
| 7252 | ACAGAACA CUGAUGA GCCGUUAGGC GAA AAAAGCAG | 8423 | CUGCUUUUA UGUUCUGU | 1281 |
| 7256 | GGAGACAG CUGAUGA GCCGUUAGGC GAA ACAUAAAA | 8424 | UUUUAUGUU CUGUCUCC | 1282 |
| 7257 | AGGAGACA CUGAUGA GCCGUUAGGC GAA AACAUAAA | 8425 | UUUAUGUUC UGUCUCCU | 1283 |
| 7261 | UGGAAGGA CUGAUGA GCCGUUAGGC GAA ACAGAACA | 8426 | UGUUCUGUC UCCUUCCA | 1284 |
| 7263 | UAUGGAAG CUGAUGA GCCGUUAGGC GAA AGACAGAA | 8427 | UUCUGUCUC CUUCCAUA | 1285 |
| 7266 | AUUUAUGG CUGAUGA GCCGUUAGGC GAA AGGAGACA | 8428 | UGUCUCCUU CCAUAAAU | 1286 |
| 7267 | AAUUUAUG CUGAUGA GCCGUUAGGC GAA AAGGAGAC | 8429 | GUCUCCUUC CAUAAAUU | 1287 |
| 7271 | GAAAAAUU CUGAUGA GCCGUUAGGC GAA AUGGAAGG | 8430 | CCUUCCAUA AAUUUUUC | 1288 |
| 7275 | UUUUGAAA CUGAUGA GCCGUUAGGC GAA AUUUAUGG | 8431 | CCAUAAAUU UUUCAAAA | 1289 |
| 7276 | AUUUUGAA CUGAUGA GCCGUUAGGC GAA AAUUUAUG | 8432 | CAUAAAUUU UUCAAAAU | 1290 |
| 7277 | UAUUUUGA CUGAUGA GCCGUUAGGC GAA AAAUUUAU | 8433 | AUAAAUUUU UCAAAAUA | 1291 |
| 7278 | GUAUUUUG CUGAUGA GCCGUUAGGC GAA AAAAUUUA | 8434 | UAAAUUUUU CAAAAUAC | 1292 |
| 7279 | AGUAUUUU CUGAUGA GCCGUUAGGC GAA AAAAAUUU | 8435 | AAAUUUUUC AAAAUACU | 1293 |
| 7285 | UGAAUUAG CUGAUGA GCCGUUAGGC GAA AUUUUGAA | 8436 | UUCAAAAUA CUAAUUCA | 1294 |
| 7288 | UGUUGAAU CUGAUGA GCCGUUAGGC GAA AGUAUUUU | 8437 | AAAAUACUA AUUCAACA | 1295 |

| | | | | |
|---|---|---|---|---|
| 7291 | CUUUGUUG CUGAUGA GCCGUUAGGC GAA AUUAGUAU | 8438 | AUACUAAUU CAACAAAG | 1296 |
| 7292 | UCUUUGUU CUGAUGA GCCGUUAGGC GAA AAUUAGUA | 8439 | UACUAAUUC AACAAAGA | 1297 |
| 7308 | AAAAAAAA CUGAUGA GCCGUUAGGC GAA AGCUUUUU | 8440 | AAAAAGCUC UUUUUUUU | 1298 |
| 7310 | GGAAAAAA CUGAUGA GCCGUUAGGC GAA AGAGCUUU | 8441 | AAAGCUCUU UUUUUUCC | 1299 |
| 7311 | AGGAAAAA CUGAUGA GCCGUUAGGC GAA AAGAGCUU | 8442 | AAGCUCUUU UUUUUCCU | 1300 |
| 7312 | UAGGAAAA CUGAUGA GCCGUUAGGC GAA AAAGAGCU | 8443 | AGCUCUUUU UUUUCCUA | 1301 |
| 7313 | UUAGGAAA CUGAUGA GCCGUUAGGC GAA AAAAGAGC | 8444 | GCUCUUUUU UUUCCUAA | 1302 |
| 7314 | UUUAGGAA CUGAUGA GCCGUUAGGC GAA AAAAAGAG | 8445 | CUCUUUUUU UUCCUAAA | 1303 |
| 7315 | UUUUAGGA CUGAUGA GCCGUUAGGC GAA AAAAAAGA | 8446 | UCUUUUUUU UCCUAAAA | 1304 |
| 7316 | AUUUUAGG CUGAUGA GCCGUUAGGC GAA AAAAAAAG | 8447 | CUUUUUUUU CCUAAAAU | 1305 |
| 7317 | UAUUUUAG CUGAUGA GCCGUUAGGC GAA AAAAAAAA | 8448 | UUUUUUUUC CUAAAAUA | 1306 |
| 7320 | GUUUAUUU CUGAUGA GCCGUUAGGC GAA AGGAAAAA | 8449 | UUUUUCCUA AAAUAAAC | 1307 |
| 7325 | UUUGAGUU CUGAUGA GCCGUUAGGC GAA AUUUUAGG | 8450 | CCUAAAAUA AACUCAAA | 1308 |
| 7330 | AUAAAUUU CUGAUGA GCCGUUAGGC GAA AGUUUAUU | 8451 | AAUAAACUC AAAUUUAU | 1309 |
| 7335 | CAAGGAUA CUGAUGA GCCGUUAGGC GAA AUUUGAGU | 8452 | ACUCAAAUU UAUCCUUG | 1310 |
| 7336 | ACAAGGAU CUGAUGA GCCGUUAGGC GAA AAUUUGAG | 8453 | CUCAAAUUU AUCCUUGU | 1311 |
| 7337 | AACAAGGA CUGAUGA GCCGUUAGGC GAA AAAUUUGA | 8454 | UCAAAUUUA UCCUUGUU | 1312 |
| 7339 | UAAACAAG CUGAUGA GCCGUUAGGC GAA AUAAAUUU | 8455 | AAAUUUAUC CUUGUUUA | 1313 |
| 7342 | CUCUAAAC CUGAUGA GCCGUUAGGC GAA AGGAUAAA | 8456 | UUUAUCCUU GUUUAGAG | 1314 |
| 7345 | CUGCUCUA CUGAUGA GCCGUUAGGC GAA ACAAGGAU | 8457 | AUCCUUGUU UAGAGCAG | 1315 |
| 7346 | UCUGCUCU CUGAUGA GCCGUUAGGC GAA AACAAGGA | 8458 | UCCUUGUUU AGAGCAGA | 1316 |
| 7347 | CUCUGCUC CUGAUGA GCCGUUAGGC GAA AAACAAGG | 8459 | CCUUGUUUA GAGCAGAG | 1317 |
| 7362 | UUUUUCUU CUGAUGA GCCGUUAGGC GAA AUUUUUCU | 8460 | AGAAAAAUU AAGAAAAA | 1318 |
| 7363 | GUUUUUCU CUGAUGA GCCGUUAGGC GAA AAUUUUUC | 8461 | GAAAAAUUA AGAAAAAC | 1319 |
| 7373 | CCAUUUCA CUGAUGA GCCGUUAGGC GAA AGUUUUUC | 8462 | GAAAAACUU UGAAAUGG | 1320 |
| 7374 | ACCAUUUC CUGAUGA GCCGUUAGGC GAA AAGUUUUU | 8463 | AAAAACUUU GAAAUGGU | 1321 |
| 7383 | UUUUUUGA CUGAUGA GCCGUUAGGC GAA ACCAUUUC | 8464 | GAAAUGGUC UCAAAAAA | 1322 |
| 7385 | AAUUUUUU CUGAUGA GCCGUUAGGC GAA AGACCAUU | 8465 | AAUGGUCUC AAAAAAUU | 1323 |
| 7393 | UAUUUAGC CUGAUGA GCCGUUAGGC GAA AUUUUUUG | 8466 | CAAAAAAUU GCUAAAUA | 1324 |
| 7397 | AAAAUAUU CUGAUGA GCCGUUAGGC GAA AGCAAUUU | 8467 | AAAUUGCUA AAUAUUUU | 1325 |
| 7401 | AUUGAAAA CUGAUGA GCCGUUAGGC GAA AUUUAGCA | 8468 | UGCUAAAUA UUUUCAAU | 1326 |
| 7403 | CCAUUGAA CUGAUGA GCCGUUAGGC GAA AUAUUUAG | 8469 | CUAAAUAUU UUCAAUGG | 1327 |
| 7404 | UCCAUUGA CUGAUGA GCCGUUAGGC GAA AAUAUUUA | 8470 | UAAAUAUUU UCAAUGGA | 1328 |

| | | | | |
|---|---|---|---|---|
| 7405 | UUCCAUUG CUGAUGA GCCGUUAGGC GAA AAAUAUUU | 8471 | AAAUAUUUU CAAUGGAA | 1329 |
| 7406 | UUUCCAUU CUGAUGA GCCGUUAGGC GAA AAAAUAUU | 8472 | AAUAUUUUC AAUGGAAA | 1330 |
| 7418 | CUAACAUU CUGAUGA GCCGUUAGGC GAA AGUUUUCC | 8473 | GGAAAACUA AAUGUUAG | 1331 |
| 7424 | GCUAAACU CUGAUGA GCCGUUAGGC GAA ACAUUUAG | 8474 | CUAAAUGUU AGUUUAGC | 1332 |
| 7425 | AGCUAAAC CUGAUGA GCCGUUAGGC GAA AACAUUUA | 8475 | UAAAUGUUA GUUUAGCU | 1333 |
| 7428 | AUCAGCUA CUGAUGA GCCGUUAGGC GAA ACUAACAU | 8476 | AUGUUAGUU UAGCUGAU | 1334 |
| 7429 | AAUCAGCU CUGAUGA GCCGUUAGGC GAA AACUAACA | 8477 | UGUUAGUUU AGCUGAUU | 1335 |
| 7430 | CAAUCAGC CUGAUGA GCCGUUAGGC GAA AAACUAAC | 8478 | GUUAGUUUA GCUGAUUG | 1336 |
| 7437 | CCCCAUAC CUGAUGA GCCGUUAGGC GAA AUCAGCUA | 8479 | UAGCUGAUU GUAUGGGG | 1337 |
| 7440 | AAACCCCA CUGAUGA GCCGUUAGGC GAA ACAAUCAG | 8480 | CUGAUUGUA UGGGGUUU | 1338 |
| 7447 | GGUUCGAA CUGAUGA GCCGUUAGGC GAA ACCCCAUA | 8481 | UAUGGGGUU UUCGAACC | 1339 |
| 7448 | AGGUUCGA CUGAUGA GCCGUUAGGC GAA AACCCCAU | 8482 | AUGGGGUUU UCGAACCU | 1340 |
| 7449 | AAGGUUCG CUGAUGA GCCGUUAGGC GAA AAACCCCA | 8483 | UGGGGUUUU CGAACCUU | 1341 |
| 7450 | AAAGGUUC CUGAUGA GCCGUUAGGC GAA AAAACCCC | 8484 | GGGGUUUUC GAACCUUU | 1342 |
| 7457 | AAAAGUGA CUGAUGA GCCGUUAGGC GAA AGGUUCGA | 8485 | UCGAACCUU UCACUUUU | 1343 |
| 7458 | AAAAAGUG CUGAUGA GCCGUUAGGC GAA AAGGUUCG | 8486 | CGAACCUUU CACUUUUU | 1344 |
| 7459 | CAAAAAGU CUGAUGA GCCGUUAGGC GAA AAAGGUUC | 8487 | GAACCUUUC ACUUUUUG | 1345 |
| 7463 | CAAACAAA CUGAUGA GCCGUUAGGC GAA AGUGAAAG | 8488 | CUUUCACUU UUUGUUUG | 1346 |
| 7464 | ACAAACAA CUGAUGA GCCGUUAGGC GAA AAGUGAAA | 8489 | UUUCACUUU UUGUUUGU | 1347 |
| 7465 | AACAAACA CUGAUGA GCCGUUAGGC GAA AAAGUGAA | 8490 | UUCACUUUU UGUUUGUU | 1348 |
| 7466 | AAACAAAC CUGAUGA GCCGUUAGGC GAA AAAAGUGA | 8491 | UCACUUUUU GUUUGUUU | 1349 |
| 7469 | GUAAAACA CUGAUGA GCCGUUAGGC GAA ACAAAAAG | 8492 | CUUUUUGUU UGUUUUAC | 1350 |
| 7470 | GGUAAAAC CUGAUGA GCCGUUAGGC GAA AACAAAAA | 8493 | UUUUUGUUU GUUUUACC | 1351 |
| 7473 | AUAGGUAA CUGAUGA GCCGUUAGGC GAA ACAAACAA | 8494 | UUGUUUGUU UUACCUAU | 1352 |
| 7474 | AAUAGGUA CUGAUGA GCCGUUAGGC GAA AACAAACA | 8495 | UGUUUGUUU UACCUAUU | 1353 |
| 7475 | AAAUAGGU CUGAUGA GCCGUUAGGC GAA AAACAAAC | 8496 | GUUUGUUUU ACCUAUUU | 1354 |
| 7476 | GAAAUAGG CUGAUGA GCCGUUAGGC GAA AAAACAAA | 8497 | UUUGUUUUA CCUAUUUC | 1355 |
| 7480 | UUGUGAAA CUGAUGA GCCGUUAGGC GAA AGGUAAAA | 8498 | UUUUACCUA UUUCACAA | 1356 |
| 7482 | AGUUGUGA CUGAUGA GCCGUUAGGC GAA AUAGGUAA | 8499 | UUACCUAUU UCACAACU | 1357 |
| 7483 | CAGUUGUG CUGAUGA GCCGUUAGGC GAA AAUAGGUA | 8500 | UACCUAUUU CACAACUG | 1358 |
| 7484 | ACAGUUGU CUGAUGA GCCGUUAGGC GAA AAAUAGGU | 8501 | ACCUAUUUC ACAACUGU | 1359 |
| 7495 | UGGCAAUU CUGAUGA GCCGUUAGGC GAA ACACAGUU | 8502 | AACUGUGUA AAUUGCCA | 1360 |
| 7499 | UUAUUGGC CUGAUGA GCCGUUAGGC GAA AUUUACAC | 8503 | GUGUAAAUU GCCAAUAA | 1361 |

115

| | | | | |
|---|---|---|---|---|
| 7506 | ACAGGAAU CUGAUGA GCCGUUAGGC GAA AUUGGCAA | 8504 | UUGCCAAUA AUUCCUGU | 1362 |
| 7509 | UGGACAGG CUGAUGA GCCGUUAGGC GAA AUUAUUGG | 8505 | CCAAUAAUU CCUGUCCA | 1363 |
| 7510 | AUGGACAG CUGAUGA GCCGUUAGGC GAA AAUUAUUG | 8506 | CAAUAAUUC CUGUCCAU | 1364 |
| 7515 | UUUUCAUG CUGAUGA GCCGUUAGGC GAA ACAGGAAU | 8507 | AUUCCUGUC CAUGAAAA | 1365 |
| 7531 | CACUGGAU CUGAUGA GCCGUUAGGC GAA AUUUGCAU | 8508 | AUGCAAAUU AUCCAGUG | 1366 |
| 7532 | ACACUGGA CUGAUGA GCCGUUAGGC GAA AAUUUGCA | 8509 | UGCAAAUUA UCCAGUGU | 1367 |
| 7534 | CUACACUG CUGAUGA GCCGUUAGGC GAA AUAAUUUG | 8510 | CAAAUUAUC CAGUGUAG | 1368 |
| 7541 | AAUAUAUC CUGAUGA GCCGUUAGGC GAA ACACUGGA | 8511 | UCCAGUGUA GAUAUAUU | 1369 |
| 7545 | GUCAAAUA CUGAUGA GCCGUUAGGC GAA AUCUACAC | 8512 | GUGUAGAUA UAUUUGAC | 1370 |
| 7547 | UGGUCAAA CUGAUGA GCCGUUAGGC GAA AUAUCUAC | 8513 | GUAGAUAUA UUUGACCA | 1371 |
| 7549 | GAUGGUCA CUGAUGA GCCGUUAGGC GAA AUAUAUCU | 8514 | AGAUAUAUU UGACCAUC | 1372 |
| 7550 | UGAUGGUC CUGAUGA GCCGUUAGGC GAA AAUAUAUC | 8515 | GAUAUAUUU GACCAUCA | 1373 |
| 7557 | CAUAGGGU CUGAUGA GCCGUUAGGC GAA AUGGUCAA | 8516 | UUGACCAUC ACCCUAUG | 1374 |
| 7563 | AAUAUCCA CUGAUGA GCCGUUAGGC GAA AGGGUGAU | 8517 | AUCACCCUA UGGAUAUU | 1375 |
| 7569 | CUAGCCAA CUGAUGA GCCGUUAGGC GAA AUCCAUAG | 8518 | CUAUGGAUA UUGGCUAG | 1376 |
| 7571 | AACUAGCC CUGAUGA GCCGUUAGGC GAA AUAUCCAU | 8519 | AUGGAUAUU GGCUAGUU | 1377 |
| 7576 | GGCAAAAC CUGAUGA GCCGUUAGGC GAA AGCCAAUA | 8520 | UAUUGGCUA GUUUUGCC | 1378 |
| 7579 | AAAGGCAA CUGAUGA GCCGUUAGGC GAA ACUAGCCA | 8521 | UGGCUAGUU UUGCCUUU | 1379 |
| 7580 | UAAAGGCA CUGAUGA GCCGUUAGGC GAA AACUAGCC | 8522 | GGCUAGUUU UGCCUUUA | 1380 |
| 7581 | AUAAAGGC CUGAUGA GCCGUUAGGC GAA AAACUAGC | 8523 | GCUAGUUUU GCCUUUAU | 1381 |
| 7586 | GCUUAAUA CUGAUGA GCCGUUAGGC GAA AGGCAAAA | 8524 | UUUUGCCUU UAUUAAGC | 1382 |
| 7587 | UGCUUAAU CUGAUGA GCCGUUAGGC GAA AAGGCAAA | 8525 | UUUGCCUUU AUUAAGCA | 1383 |
| 7588 | UUGCUUAA CUGAUGA GCCGUUAGGC GAA AAAGGCAA | 8526 | UUGCCUUUA UUAAGCAA | 1384 |
| 7590 | AUUUGCUU CUGAUGA GCCGUUAGGC GAA AUAAAGGC | 8527 | GCCUUUAUU AAGCAAAU | 1385 |
| 7591 | AAUUUGCU CUGAUGA GCCGUUAGGC GAA AAUAAAGG | 8528 | CCUUUAUUA AGCAAAUU | 1386 |
| 7599 | CUGAAAUG CUGAUGA GCCGUUAGGC GAA AUUUGCUU | 8529 | AAGCAAAUU CAUUUCAG | 1387 |
| 7600 | GCUGAAAU CUGAUGA GCCGUUAGGC GAA AAUUUGCU | 8530 | AGCAAAUUC AUUUCAGC | 1388 |
| 7603 | CAGGCUGA CUGAUGA GCCGUUAGGC GAA AUGAAUUU | 8531 | AAAUUCAUU UCAGCCUG | 1389 |
| 7604 | UCAGGCUG CUGAUGA GCCGUUAGGC GAA AAUGAAUU | 8532 | AAUUCAUUU CAGCCUGA | 1390 |
| 7605 | UUCAGGCU CUGAUGA GCCGUUAGGC GAA AAAUGAAU | 8533 | AUUCAUUUC AGCCUGAA | 1391 |
| 7617 | UAUAGGCA CUGAUGA GCCGUUAGGC GAA ACAUUCAG | 8534 | CUGAAUGUC UGCCUAUA | 1392 |
| 7623 | AGAAUAUA CUGAUGA GCCGUUAGGC GAA AGGCAGAC | 8535 | GUCUGCCUA UAUAUUCU | 1393 |
| 7625 | AGAGAAUA CUGAUGA GCCGUUAGGC GAA AUAGGCAG | 8536 | CUGCCUAUA UAUUCUCU | 1394 |

| | | | | |
|---|---|---|---|---|
| 7627 | GCAGAGAA CUGAUGA GCCGUUAGGC GAA AUAUAGGC | 8537 | GCCUAUAUA UUCUCUGC | 1395 |
| 7629 | GAGCAGAG CUGAUGA GCCGUUAGGC GAA AUAUAUAG | 8538 | CUAUAUAUU CUCUGCUC | 1396 |
| 7630 | AGAGCAGA CUGAUGA GCCGUUAGGC GAA AAUAUAUA | 8539 | UAUAUAUUC UCUGCUCU | 1397 |
| 7632 | AAAGAGCA CUGAUGA GCCGUUAGGC GAA AGAAUAUA | 8540 | UAUAUUCUC UGCUCUUU | 1398 |
| 7637 | AAUACAAA CUGAUGA GCCGUUAGGC GAA AGCAGAGA | 8541 | UCUCUGCUC UUUGUAUU | 1399 |
| 7639 | AGAAUACA CUGAUGA GCCGUUAGGC GAA AGAGCAGA | 8542 | UCUGCUCUU UGUAUUCU | 1400 |
| 7640 | GAGAAUAC CUGAUGA GCCGUUAGGC GAA AAGAGCAG | 8543 | CUGCUCUUU GUAUUCUC | 1401 |
| 7643 | AAGGAGAA CUGAUGA GCCGUUAGGC GAA ACAAAGAG | 8544 | CUCUUUGUA UUCUCCUU | 1402 |
| 7645 | CAAAGGAG CUGAUGA GCCGUUAGGC GAA AUACAAAG | 8545 | CUUUGUAUU CUCCUUUG | 1403 |
| 7646 | UCAAAGGA CUGAUGA GCCGUUAGGC GAA AAUACAAA | 8546 | UUUGUAUUC UCCUUUGA | 1404 |
| 7648 | GUUCAAAG CUGAUGA GCCGUUAGGC GAA AGAAUACA | 8547 | UGUAUUCUC CUUUGAAC | 1405 |
| 7651 | CGGGUUCA CUGAUGA GCCGUUAGGC GAA AGGAGAAU | 8548 | AUUCUCCUU UGAACCCG | 1406 |
| 7652 | ACGGGUUC CUGAUGA GCCGUUAGGC GAA AAGGAGAA | 8549 | UUCUCCUUU GAACCCGU | 1407 |
| 7661 | GAUGUUUU CUGAUGA GCCGUUAGGC GAA ACGGGUUC | 8550 | GAACCCGUU AAAACAUC | 1408 |
| 7662 | GGAUGUUU CUGAUGA GCCGUUAGGC GAA AACGGGUU | 8551 | AACCCGUUA AAACAUCC | 1409 |
| 7669 | UGCCACAG CUGAUGA GCCGUUAGGC GAA AUGUUUUA | 8552 | UAAAACAUC CUGUGGCA | 1410 |

Underlined region can be any X sequence or linker, as described herein.

117

**Table III: Human *flt*1 VEGF Receptor-Hairpin Ribozyme and Substrate sequence** 237.198

| nt. Position | HP Ribozyme Sequence | Rz Seq ID No. | Substrate | Seq ID No. |
|---|---|---|---|---|
| 16 | CGGGGAGG AGAA GAGAGG ACCAGAGAAACACACGUUGUGGUACAUUACCUGGUA | 8553 | CCUCUCG GCU CCUCCCCG | 1411 |
| 39 | CCGCUCCG AGAA GCCGCC ACCAGAGAAACACACGUUGUGGUACAUUACCUGGUA | 8554 | GGCGGCG GCU CGGAGCGG | 1412 |
| 180 | CCGCCAGA AGAA GUCCUC ACCAGAGAAACACACGUUGUGGUACAUUACCUGGUA | 8555 | GAGGACG GAC UCUGGCGG | 1413 |
| 190 | AACGACCC AGAA GCCAGA ACCAGAGAAACACACGUUGUGGUACAUUACCUGGUA | 8556 | UCUGGCG GCC GGGUCGUU | 1414 |
| 278 | GCGCGCAC AGAA GGACCC ACCAGAGAAACACACGUUGUGGUACAUUACCUGGUA | 8557 | GGGUCCU GCU GUGCGCGC | 1415 |
| 290 | GACAGCUG AGAA GCGCGC ACCAGAGAAACACACGUUGUGGUACAUUACCUGGUA | 8558 | GCGCGCU GCU CAGCUGUC | 1416 |
| 295 | AAGCAGAC AGAA GAGCAG ACCAGAGAAACACACGUUGUGGUACAUUACCUGGUA | 8559 | CUGCUCA GCU GUCUGCUU | 1417 |
| 298 | GAGAAGCA AGAA GCUGAG ACCAGAGAAACACACGUUGUGGUACAUUACCUGGUA | 8560 | CUCAGCU GUC UGCUUCUC | 1418 |
| 302 | CUGUGAGA AGAA GACAGC ACCAGAGAAACACACGUUGUGGUACAUUACCUGGUA | 8561 | GCUGUCU GCU UCUCACAG | 1419 |
| 420 | CAUUUAUG AGAA GCUUCC ACCAGAGAAACACACGUUGUGGUACAUUACCUGGUA | 8562 | GGAAGCA GCC CAUAAAUG | 1420 |
| 486 | CUUCCACA AGAA GAUUUA ACCAGAGAAACACACGUUGUGGUACAUUACCUGGUA | 8563 | UAAAUCU GCC UGUGGAAG | 1421 |
| 537 | UUUGCUUG AGAA GUGUUC ACCAGAGAAACACACGUUGUGGUACAUUACCUGGUA | 8564 | GAACACA GCU CAAGCAAA | 1422 |
| 565 | AUAUUUGC AGAA GUAGAA ACCAGAGAAACACACGUUGUGGUACAUUACCUGGUA | 8565 | UUCUACA GCU GCAAAUAU | 1423 |
| 721 | CGUAACCC AGAA GGGAAU ACCAGAGAAACACACGUUGUGGUACAUUACCUGGUA | 8566 | AUUCCCU GCC GGGUUACG | 1424 |
| 786 | CGUUUUCC AGAA GGGAUC ACCAGAGAAACACACGUUGUGGUACAUUACCUGGUA | 8567 | GAUCCCU GAU GGAAAACG | 1425 |
| 863 | CUUCACAG AGAA GAAGCC ACCAGAGAAACACACGUUGUGGUACAUUACCUGGUA | 8568 | GGCUUCU GAC CUGUGAAG | 1426 |
| 1056 | UUUUUUUC AGAA GGGUAA ACCAGAGAAACACACGUUGUGGUACAUUACCUGGUA | 8569 | UUACCCU GAU GAAAAAAA | 1427 |
| 1301 | GCCGGUAA AGAA GCUUGC ACCAGAGAAACACACGUUGUGGUACAUUACCUGGUA | 8570 | GCAAGCG GUC UUACCGGC | 1428 |
| 1310 | UCAUAGAG AGAA GGUAAG ACCAGAGAAACACACGUUGUGGUACAUUACCUGGUA | 8571 | CUUACCG GCU CUCUAUGA | 1429 |
| 1389 | AAAUAGCG AGAA GAUUUC ACCAGAGAAACACACGUUGUGGUACAUUACCUGGUA | 8572 | GAAAUCU GCU CGCUAUUU | 1430 |
| 1535 | UUUCGUAA AGAA GGGGUU ACCAGAGAAACACACGUUGUGGUACAUUACCUGGUA | 8573 | AACCCCA GAU UUACGAAA | 1431 |
| 1566 | AGAGCCGG AGAA GGAAAC ACCAGAGAAACACACGUUGUGGUACAUUACCUGGUA | 8574 | GUUUCCA GAC CCGGCUCU | 1432 |
| 1572 | GGGUAGAG AGAA GGGUCU ACCAGAGAAACACACGUUGUGGUACAUUACCUGGUA | 8575 | AGACCCG GCU CUCUACCC | 1433 |
| 1604 | CGGUACAA AGAA GGAUUU ACCAGAGAAACACACGUUGUGGUACAUUACCUGGUA | 8576 | AAAUCCU GAC UUGUACCG | 1434 |
| 1824 | AUUCUAGA AGAA GCCACA ACCAGAGAAACACACGUUGUGGUACAUUACCUGGUA | 8577 | UGUGGCU GAC UCUAGAAU | 1435 |
| 1908 | UUUGGCAC AGAA GUGAUA ACCAGAGAAACACACGUUGUGGUACAUUACCUGGUA | 8578 | UAUCACA GAU GUGCCAAA | 1436 |
| 1949 | CUCCUUCC AGAA GCAUUU ACCAGAGAAACACACGUUGUGGUACAUUACCUGGUA | 8579 | AAAUGCC GAC GGAAGGAG | 1437 |
| 1973 | CUGUGCAA AGAA GUUUCA ACCAGAGAAACACACGUUGUGGUACAUUACCUGGUA | 8580 | UGAAACU GUC UUGCACAG | 1438 |
| 2275 | AGUGGUGG AGAA GCUGAU ACCAGAGAAACACACGUUGUGGUACAUUACCUGGUA | 8581 | AUCAGCA GUU CCACCACU | 1439 |
| 2321 | ACCAAGUG AGAA GAGGCU ACCAGAGAAACACACGUUGUGGUACAUUACCUGGUA | 8582 | AGCCUCA GAU CACUUGGU | 1440 |
| 2396 | UUUCAAUA AGAA GCGUGC ACCAGAGAAACACACGUUGUGGUACAUUACCUGGUA | 8583 | GCACGCU GUU UAUUGAAA | 1441 |
| 2490 | GUUCCUUG AGAA GUGAGG ACCAGAGAAACACACGUUGUGGUACAUUACCUGGUA | 8584 | CCUCACU GUU CAAGGAAC | 1442 |

| | | | | |
|---|---|---|---|---|
| 2525 | UUAGAGUG AGAA GCUCCA ACCAGAGAAACACACGUUGUGGUACAUUACCUGGUA | 8585 | UGGAGCU GAU CACUCUAA | 1443 |
| 2625 | GAUAGGUA AGAA GUCUUU ACCAGAGAAACACACGUUGUGGUACAUUACCUGGUA | 8586 | AAAGACU GAC UACCUAUC | 1444 |
| 2652 | GGAACUUC AGAA GGGUCC ACCAGAGAAACACACGUUGUGGUACAUUACCUGGUA | 8587 | GGACCCA GAU GAAGUUCC | 1445 |
| 2684 | CAUAAGGG AGAA GCUCAC ACCAGAGAAACACACGUUGUGGUACAUUACCUGGUA | 8588 | GUGAGCG GCU CCCUUAUG | 1446 |
| 2816 | CAGCCACA AGAA GGCACG ACCAGAGAAACACACGUUGUGGUACAUUACCUGGUA | 8589 | CGUGCCG GAC UGUGGCUG | 1447 |
| 2873 | GCUCAGUC AGAA GAGCUU ACCAGAGAAACACACGUUGUGGUACAUUACCUGGUA | 8590 | AAGCUCU GAU GACUGAGC | 1448 |
| 2930 | AGGCUCCC AGAA GGUUAA ACCAGAGAAACACACGUUGUGGUACAUUACCUGGUA | 8591 | UUAACCU GCU GGGAGCCU | 1449 |
| 2963 | CAAUCACC AGAA GAGGCC ACCAGAGAAACACACGUUGUGGUACAUUACCUGGUA | 8592 | GGCCUCU GAU GGUGAUUG | 1450 |
| 3157 | UUCCUGAA AGAA GGAGCU ACCAGAGAAACACACGUUGUGGUACAUUACCUGGUA | 8593 | AGCUCCG GCU UUCAGGAA | 1451 |
| 3207 | UAGAAACC AGAA GAAUCC ACCAGAGAAACACACGUUGUGGUACAUUACCUGGUA | 8594 | GGAUUCU GAC GGUUUCUA | 1452 |
| 3211 | CUUGUAGA AGAA GUCAGA ACCAGAGAAACACACGUUGUGGUACAUUACCUGGUA | 8595 | UCUGACG GUU UCUACAAG | 1453 |
| 3245 | UGUAAGAA AGAA GAUCUU ACCAGAGAAACACACGUUGUGGUACAUUACCUGGUA | 8596 | AAGAUCU GAU UUCUUACA | 1454 |
| 3256 | CACUUGAA AGAA GUAAGA ACCAGAGAAACACACGUUGUGGUACAUUACCUGGUA | 8597 | UCUUACA GUU UUCAAGUG | 1455 |
| 3287 | UUCUGGAA AGAA GGAACU ACCAGAGAAACACACGUUGUGGUACAUUACCUGGUA | 8598 | AGUUCCU GUC UUCCAGAA | 1456 |
| 3402 | CUCACAUA AGAA GGGUUC ACCAGAGAAACACACGUUGUGGUACAUUACCUGGUA | 8599 | GAACCCC GAU UAUGUGAG | 1457 |
| 3580 | CCUCAGGC AGAA GCAAAA ACCAGAGAAACACACGUUGUGGUACAUUACCUGGUA | 8600 | UUUUGCA GUC GCCUGAGG | 1458 |
| 3641 | CCAGCAUG AGAA GAUAGA ACCAGAGAAACACACGUUGUGGUACAUUACCUGGUA | 8601 | UCUAUCA GAU CAUGCUGG | 1459 |
| 3655 | UCUGUGCC AGAA GUCCAG ACCAGAGAAACACACGUUGUGGUACAUUACCUGGUA | 8602 | CUGGACU GCU GGCACAGA | 1460 |
| 3810 | UCAGAGAA AGAA GGAGUU ACCAGAGAAACACACGUUGUGGUACAUUACCUGGUA | 8603 | AACUCCU GCC UUCUCUGA | 1461 |
| 3846 | AACUUCGG AGAA GAAAUA ACCAGAGAAACACACGUUGUGGUACAUUACCUGGUA | 8604 | UAUUUCA GCU CCGAAGUU | 1462 |
| 3873 | CUGACAUC AGAA GAGCUU ACCAGAGAAACACACGUUGUGGUACAUUACCUGGUA | 8605 | AAGCUCU GAU GAUGUCAG | 1463 |
| 3995 | GAGAGGCC AGAA GAGUGC ACCAGAGAAACACACGUUGUGGUACAUUACCUGGUA | 8606 | GCACUCU GUU GGCCUCUC | 1464 |
| 4100 | UGACAUCA AGAA GCCCCG ACCAGAGAAACACACGUUGUGGUACAUUACCUGGUA | 8607 | CGGGGCU GUC UGAUGUCA | 1465 |
| 4104 | CUGCUGAC AGAA GACAGC ACCAGAGAAACACACGUUGUGGUACAUUACCUGGUA | 8608 | GCUGUCU GAU GUCAGCAG | 1466 |
| 4120 | AUGGCAGA AGAA GGGCCU ACCAGAGAAACACACGUUGUGGUACAUUACCUGGUA | 8609 | AGGCCCA GUU UCUGCCAU | 1467 |
| 4135 | GUGCCCAC AGAA GGAAUG ACCAGAGAAACACACGUUGUGGUACAUUACCUGGUA | 8610 | CAUUCCA GCU GUGGGCAC | 1468 |
| 4210 | GGGCGGGG AGAA GCACGC ACCAGAGAAACACACGUUGUGGUACAUUACCUGGUA | 8611 | GCGUGCU GCU CCCCGCCC | 1469 |
| 4217 | AGUCUGGG AGAA GGGAGC ACCAGAGAAACACACGUUGUGGUACAUUACCUGGUA | 8612 | GCUCCCC GCC CCCAGACU | 1470 |
| 4224 | GAGUUGUA AGAA GGGGGC ACCAGAGAAACACACGUUGUGGUACAUUACCUGGUA | 8613 | GCCCCCA GAC UACAACUC | 1471 |
| 4382 | CAAAAAGC AGAA GGCUCC ACCAGAGAAACACACGUUGUGGUACAUUACCUGGUA | 8614 | GGAGCCA GCU GCUUUUUG | 1472 |
| 4385 | UCACAAAA AGAA GCUGGC ACCAGAGAAACACACGUUGUGGUACAUUACCUGGUA | 8615 | GCCAGCU GCU UUUUGUGA | 1473 |
| 4537 | GGGGUUGG AGAA GGGAAG ACCAGAGAAACACACGUUGUGGUACAUUACCUGGUA | 8616 | CUUCCCU GCU CCAACCCC | 1474 |
| 4573 | CUCAAUCA AGAA GGUCCU ACCAGAGAAACACACGUUGUGGUACAUUACCUGGUA | 8617 | AGGACCA GUU UGAUUGAG | 1475 |
| 4594 | AUUGGGUG AGAA GUGCAG ACCAGAGAAACACACGUUGUGGUACAUUACCUGGUA | 8618 | CUGCACU GAU CACCCAAU | 1476 |
| 4628 | GGCUGCAG AGAA GGCCCA ACCAGAGAAACACACGUUGUGGUACAUUACCUGGUA | 8619 | UGGGCCA GCC CUGCAGCC | 1477 |
| 4636 | GGGUUUUG AGAA GCAGGG ACCAGAGAAACACACGUUGUGGUACAUUACCUGGUA | 8620 | CCCUGCA GCC CAAAACCC | 1478 |

| | | | | |
|---|---|---|---|---|
| 4866 | AGGGUCAG AGAA GGGAAG ACCAGAGAAACACACGUUGUGGUACAUUACCUGGUA | 8621 | CUUCCCA GCU CUGACCCU | 1479 |
| 4871 | GUAGAAGG AGAA GAGCUG ACCAGAGAAACACACGUUGUGGUACAUUACCUGGUA | 8622 | CAGCUCU GAC CCUUCUAC | 1480 |
| 4905 | CGCUGUCC AGAA GCUCCU ACCAGAGAAACACACGUUGUGGUACAUUACCUGGUA | 8623 | AGGAGCA GAU GGACAGCG | 1481 |
| 5233 | CUGUGCAA AGAA GAAUAA ACCAGAGAAACACACGUUGUGGUACAUUACCUGGUA | 8624 | UUAUUCU GUU UUGCACAG | 1482 |
| 5281 | CUCCUCAG AGAA GCAUUU ACCAGAGAAACACACGUUGUGGUACAUUACCUGGUA | 8625 | AAAUGCA GUC CUGAGGAG | 1483 |
| 5319 | UUUCCUCC AGAA GCCCUC ACCAGAGAAACACACGUUGUGGUACAUUACCUGGUA | 8626 | GAGGGCU GAU GGAGGAAA | 1484 |
| 5358 | GGUAUAGA AGAA GGGUCU ACCAGAGAAACACACGUUGUGGUACAUUACCUGGUA | 8627 | AGACCCC GUC UCUAUACC | 1485 |
| 5392 | UGGGUCCC AGAA GUGUUG ACCAGAGAAACACACGUUGUGGUACAUUACCUGGUA | 8628 | CAACACA GUU GGGACCCA | 1486 |
| 5563 | UGAGUCCC AGAA GGAGAA ACCAGAGAAACACACGUUGUGGUACAUUACCUGGUA | 8629 | UUCUCCA GUU GGGACUCA | 1487 |
| 5622 | AGUUUCAA AGAA GUUGAA ACCAGAGAAACACACGUUGUGGUACAUUACCUGGUA | 8630 | UUCAACU GCU UUGAAACU | 1488 |
| 5738 | UAGCAUCA AGAA GAGCCA ACCAGAGAAACACACGUUGUGGUACAUUACCUGGUA | 8631 | UGGCUCU GUU UGAUGCUA | 1489 |
| 5838 | UAGCAUCA AGAA GAGCCA ACCAGAGAAACACACGUUGUGGUACAUUACCUGGUA | 8631 | UGGCUCU GUU UGAUGCUA | 1489 |
| 5933 | CCCCAAGA AGAA GCAAUC ACCAGAGAAACACACGUUGUGGUACAUUACCUGGUA | 8632 | GAUUGCU GCU UCUUGGGG | 1490 |
| 6022 | CACAUAAG AGAA GAGGCA ACCAGAGAAACACACGUUGUGGUACAUUACCUGGUA | 8633 | UGCCUCU GUU CUUAUGUG | 1491 |
| 6120 | UCCACAAA AGAA GCUGCC ACCAGAGAAACACACGUUGUGGUACAUUACCUGGUA | 8634 | GGCAGCG GCU UUUGUGGA | 1492 |
| 6163 | GUGGAGAG AGAA GUCCCA ACCAGAGAAACACACGUUGUGGUACAUUACCUGGUA | 8635 | UGGGACA GUC CUCUCCAC | 1493 |
| 6270 | AAAUUGCC AGAA GUCACA ACCAGAGAAACACACGUUGUGGUACAUUACCUGGUA | 8636 | UGUGACA GCU GGCAAUUU | 1494 |
| 6412 | AAGACAUG AGAA GCUAAG ACCAGAGAAACACACGUUGUGGUACAUUACCUGGUA | 8637 | CUUAGCU GUU CAUGUCUU | 1495 |
| 6511 | UUUGAAGG AGAA GAGUAA ACCAGAGAAACACACGUUGUGGUACAUUACCUGGUA | 8638 | UUACUCA GCU CCUUCAAA | 1496 |
| 6778 | UCCACCCA AGAA GUUCCA ACCAGAGAAACACACGUUGUGGUACAUUACCUGGUA | 8639 | UGGAACA GUC UGGGUGGA | 1497 |
| 6826 | ACUUCUUG AGAA GACAAG ACCAGAGAAACACACGUUGUGGUACAUUACCUGGUA | 8640 | CUUGUCA GUC CAAGAAGU | 1498 |
| 7245 | AACAUAAA AGAA GUUGCC ACCAGAGAAACACACGUUGUGGUACAUUACCUGGUA | 8641 | GGCAACU GCU UUUAUGUU | 1499 |
| 7258 | UGGAAGGA AGAA GAACAU ACCAGAGAAACACACGUUGUGGUACAUUACCUGGUA | 8642 | AUGUUCU GUC UCCUUCCA | 1500 |
| 7433 | CCCAUACA AGAA GCUAAA ACCAGAGAAACACACGUUGUGGUACAUUACCUGGUA | 8643 | UUUAGCU GAU UGUAUGGG | 1501 |
| 7512 | UUUUCAUG AGAA GGAAUU ACCAGAGAAACACACGUUGUGGUACAUUACCUGGUA | 8644 | AAUUCCU GUC CAUGAAAA | 1502 |
| 7606 | GACAUUCA AGAA GAAAUG ACCAGAGAAACACACGUUGUGGUACAUUACCUGGUA | 8645 | CAUUUCA GCC UGAAUGUC | 1503 |
| 7618 | AAUAUAUA AGAA GACAUU ACCAGAGAAACACACGUUGUGGUACAUUACCUGGUA | 8646 | AAUGUCU GCC UAUAUAUU | 1504 |
| 7633 | AUACAAAG AGAA GAGAAU ACCAGAGAAACACACGUUGUGGUACAUUACCUGGUA | 8647 | AUUCUCU GCU CUUUGUAU | 1505 |

Table IV: Human KDR VEGF Receptor-Hammerhead Ribozyme and Substrate Sequence 237.198

| nt. Position | HH Ribozyme Sequence | Seq ID No. | Substrate | Rz Seq ID No. |
|---|---|---|---|---|
| 21 | CACAGGGC CUGAUGA GCCGUUAGGC GAA ACGGCCAG | 8648 | CUGGCCGUC GCCCUGUG | 1506 |
| 33 | UCCACGCA CUGAUGA GCCGUUAGGC GAA AGCCACAG | 8649 | CUGUGGCUC UGCGUGGA | 1507 |
| 56 | AACCCACA CUGAUGA GCCGUUAGGC GAA AGGCGGCC | 8650 | GGCCGCCUC UGUGGGUU | 1508 |
| 64 | ACUAGGCA CUGAUGA GCCGUUAGGC GAA ACCCACAG | 8651 | CUGUGGGUU UGCCUAGU | 1509 |
| 65 | CACUAGGC CUGAUGA GCCGUUAGGC GAA AACCCACA | 8652 | UGUGGGUUU GCCUAGUG | 1510 |
| 70 | AGAAACAC CUGAUGA GCCGUUAGGC GAA AGGCAAAC | 8653 | GUUUGCCUA GUGUUUCU | 1511 |
| 75 | UCAAGAGA CUGAUGA GCCGUUAGGC GAA ACACUAGG | 8654 | CCUAGUGUU UCUCUUGA | 1512 |
| 76 | AUCAAGAG CUGAUGA GCCGUUAGGC GAA AACACUAG | 8655 | CUAGUGUUU CUCUUGAU | 1513 |
| 77 | GAUCAAGA CUGAUGA GCCGUUAGGC GAA AAACACUA | 8656 | UAGUGUUUC UCUUGAUC | 1514 |
| 79 | CAGAUCAA CUGAUGA GCCGUUAGGC GAA AGAAACAC | 8657 | GUGUUUCUC UUGAUCUG | 1515 |
| 81 | GGCAGAUC CUGAUGA GCCGUUAGGC GAA AGAGAAAC | 8658 | GUUUCUCUU GAUCUGCC | 1516 |
| 85 | CCUGGGCA CUGAUGA GCCGUUAGGC GAA AUCAAGAG | 8659 | CUCUUGAUC UGCCCAGG | 1517 |
| 96 | UGUAUGCU CUGAUGA GCCGUUAGGC GAA AGCCUGGG | 8660 | CCCAGGCUC AGCAUACA | 1518 |
| 102 | UCUUUUUG CUGAUGA GCCGUUAGGC GAA AUGCUGAG | 8661 | CUCAGCAUA CAAAAAGA | 1519 |
| 114 | AUUGUAAG CUGAUGA GCCGUUAGGC GAA AUGUCUUU | 8662 | AAAGACAUA CUUACAAU | 1520 |
| 117 | UUAAUUGU CUGAUGA GCCGUUAGGC GAA AGUAUGUC | 8663 | GACAUACUU ACAAUUAA | 1521 |
| 118 | CUUAAUUG CUGAUGA GCCGUUAGGC GAA AAGUAUGU | 8664 | ACAUACUUA CAAUUAAG | 1522 |
| 123 | UUAGCCUU CUGAUGA GCCGUUAGGC GAA AUUGUAAG | 8665 | CUUACAAUU AAGGCUAA | 1523 |
| 124 | AUUAGCCU CUGAUGA GCCGUUAGGC GAA AAUUGUAA | 8666 | UUACAAUUA AGGCUAAU | 1524 |
| 130 | AGUUGUAU CUGAUGA GCCGUUAGGC GAA AGCCUUAA | 8667 | UUAAGGCUA AUACAACU | 1525 |
| 133 | AAGAGUUG CUGAUGA GCCGUUAGGC GAA AUUAGCCU | 8668 | AGGCUAAUA CAACUCUU | 1526 |
| 139 | AAUUUGAA CUGAUGA GCCGUUAGGC GAA AGUUGUAU | 8669 | AUACAACUC UUCAAAUU | 1527 |
| 141 | GUAAUUUG CUGAUGA GCCGUUAGGC GAA AGAGUUGU | 8670 | ACAACUCUU CAAAUUAC | 1528 |
| 142 | AGUAAUUU CUGAUGA GCCGUUAGGC GAA AAGAGUUG | 8671 | CAACUCUUC AAAUUACU | 1529 |
| 147 | CUGCAAGU CUGAUGA GCCGUUAGGC GAA AUUUGAAG | 8672 | CUUCAAAUU ACUUGCAG | 1530 |
| 148 | CCUGCAAG CUGAUGA GCCGUUAGGC GAA AAUUUGAA | 8673 | UUCAAAUUA CUUGCAGG | 1531 |
| 151 | UCCCCUGC CUGAUGA GCCGUUAGGC GAA AGUAAUUU | 8674 | AAAUUACUU GCAGGGGA | 1532 |
| 170 | GCCAGUCC CUGAUGA GCCGUUAGGC GAA AGUCCCUC | 8675 | GAGGGACUU GGACUGGC | 1533 |
| 180 | UUGGGCCA CUGAUGA GCCGUUAGGC GAA AGCCAGUC | 8676 | GACUGGCUU UGGCCCAA | 1534 |
| 181 | AUUGGGCC CUGAUGA GCCGUUAGGC GAA AAGCCAGU | 8677 | ACUGGCUUU GGCCCAAU | 1535 |
| 190 | ACUCUGAU CUGAUGA GCCGUUAGGC GAA AUUGGGCC | 8678 | GGCCCAAUA AUCAGAGU | 1536 |

121

| | | | | |
|---|---|---|---|---|
| 193 | GCCACUCU CUGAUGA GCCGUUAGGC GAA AUUAUUGG | 8679 | CCAAUAAUC AGAGUGGC | 1537 |
| 243 | UUACAGAA CUGAUGA GCCGUUAGGC GAA AGGCCAUC | 8680 | GAUGGCCUC UUCUGUAA | 1538 |
| 245 | UCUUACAG CUGAUGA GCCGUUAGGC GAA AGAGGCCA | 8681 | UGGCCUCUU CUGUAAGA | 1539 |
| 246 | GUCUUACA CUGAUGA GCCGUUAGGC GAA AAGAGGCC | 8682 | GGCCUCUUC UGUAAGAC | 1540 |
| 250 | GAGUGUCU CUGAUGA GCCGUUAGGC GAA ACAGAAGA | 8683 | UCUUCUGUA AGACACUC | 1541 |
| 258 | GGAAUUGU CUGAUGA GCCGUUAGGC GAA AGUGUCUU | 8684 | AAGACACUC ACAAUUCC | 1542 |
| 264 | ACUUUUGG CUGAUGA GCCGUUAGGC GAA AUUGUGAG | 8685 | CUCACAAUU CCAAAAGU | 1543 |
| 265 | CACUUUUG CUGAUGA GCCGUUAGGC GAA AAUUGUGA | 8686 | UCACAAUUC CAAAAGUG | 1544 |
| 276 | UCAUUUCC CUGAUGA GCCGUUAGGC GAA AUCACUUU | 8687 | AAAGUGAUC GGAAAUGA | 1545 |
| 296 | AGCACUUG CUGAUGA GCCGUUAGGC GAA AGGCUCCA | 8688 | UGGAGCCUA CAAGUGCU | 1546 |
| 305 | CCCGGUAG CUGAUGA GCCGUUAGGC GAA AGCACUUG | 8689 | CAAGUGCUU CUACCGGG | 1547 |
| 306 | UCCCGGUA CUGAUGA GCCGUUAGGC GAA AAGCACUU | 8690 | AAGUGCUUC UACCGGGA | 1548 |
| 308 | UUUCCCGG CUGAUGA GCCGUUAGGC GAA AGAAGCAC | 8691 | GUGCUUCUA CCGGGAAA | 1549 |
| 323 | CCGAGGCC CUGAUGA GCCGUUAGGC GAA AGUCAGUU | 8692 | AACUGACUU GGCCUCGG | 1550 |
| 329 | AAAUGACC CUGAUGA GCCGUUAGGC GAA AGGCCAAG | 8693 | CUUGGCCUC GGUCAUUU | 1551 |
| 333 | ACAUAAAU CUGAUGA GCCGUUAGGC GAA ACCGAGGC | 8694 | GCCUCGGUC AUUUAUGU | 1552 |
| 336 | UAGACAUA CUGAUGA GCCGUUAGGC GAA AUGACCGA | 8695 | UCGGUCAUU UAUGUCUA | 1553 |
| 337 | AUAGACAU CUGAUGA GCCGUUAGGC GAA AAUGACCG | 8696 | CGGUCAUUU AUGUCUAU | 1554 |
| 338 | CAUAGACA CUGAUGA GCCGUUAGGC GAA AAAUGACC | 8697 | GGUCAUUUA UGUCUAUG | 1555 |
| 342 | UGAACAUA CUGAUGA GCCGUUAGGC GAA ACAUAAAU | 8698 | AUUUAUGUC UAUGUUCA | 1556 |
| 344 | CUUGAACA CUGAUGA GCCGUUAGGC GAA AGACAUAA | 8699 | UUAUGUCUA UGUUCAAG | 1557 |
| 348 | UAAUCUUG CUGAUGA GCCGUUAGGC GAA ACAUAGAC | 8700 | GUCUAUGUU CAAGAUUA | 1558 |
| 349 | GUAAUCUU CUGAUGA GCCGUUAGGC GAA AACAUAGA | 8701 | UCUAUGUUC AAGAUUAC | 1559 |
| 355 | AGAUCUGU CUGAUGA GCCGUUAGGC GAA AUCUUGAA | 8702 | UUCAAGAUU ACAGAUCU | 1560 |
| 356 | GAGAUCUG CUGAUGA GCCGUUAGGC GAA AAUCUUGA | 8703 | UCAAGAUUA CAGAUCUC | 1561 |
| 362 | UAAAUGGA CUGAUGA GCCGUUAGGC GAA AUCUGUAA | 8704 | UUACAGAUC UCCAUUUA | 1562 |
| 364 | AAUAAAUG CUGAUGA GCCGUUAGGC GAA AGAUCUGU | 8705 | ACAGAUCUC CAUUUAUU | 1563 |
| 368 | AAGCAAUA CUGAUGA GCCGUUAGGC GAA AUGGAGAU | 8706 | AUCUCCAUU UAUUGCUU | 1564 |
| 369 | GAAGCAAU CUGAUGA GCCGUUAGGC GAA AAUGGAGA | 8707 | UCUCCAUUU AUUGCUUC | 1565 |
| 370 | AGAAGCAA CUGAUGA GCCGUUAGGC GAA AAAUGGAG | 8708 | CUCCAUUUA UUGCUUCU | 1566 |
| 372 | ACAGAAGC CUGAUGA GCCGUUAGGC GAA AUAAAUGG | 8709 | CCAUUUAUU GCUUCUGU | 1567 |
| 376 | ACUAACAG CUGAUGA GCCGUUAGGC GAA AGCAAUAA | 8710 | UUAUUGCUU CUGUUAGU | 1568 |
| 377 | CACUAACA CUGAUGA GCCGUUAGGC GAA AAGCAAUA | 8711 | UAUUGCUUC UGUUAGUG | 1569 |
| 381 | UGGUCACU CUGAUGA GCCGUUAGGC GAA ACAGAAGC | 8712 | GCUUCUGUU AGUGACCA | 1570 |
| 382 | UUGGUCAC CUGAUGA GCCGUUAGGC GAA AACAGAAG | 8713 | CUUCUGUUA GUGACCAA | 1571 |

| | | | | |
|---|---|---|---|---|
| 399 | AUGUACAC CUGAUGA GCCGUUAGGC GAA ACUCCAUG | 8714 | CAUGGAGUC GUGUACAU | 1572 |
| 404 | CAGUAAUG CUGAUGA GCCGUUAGGC GAA ACACGACU | 8715 | AGUCGUGUA CAUUACUG | 1573 |
| 408 | UUCUCAGU CUGAUGA GCCGUUAGGC GAA AUGUACAC | 8716 | GUGUACAUU ACUGAGAA | 1574 |
| 409 | GUUCUCAG CUGAUGA GCCGUUAGGC GAA AAUGUACA | 8717 | UGUACAUUA CUGAGAAC | 1575 |
| 438 | AGACAUGG CUGAUGA GCCGUUAGGC GAA AUCACCAC | 8718 | GUGGUGAUU CCAUGUCU | 1576 |
| 439 | GAGACAUG CUGAUGA GCCGUUAGGC GAA AAUCACCA | 8719 | UGGUGAUUC CAUGUCUC | 1577 |
| 445 | GGACCCGA CUGAUGA GCCGUUAGGC GAA ACAUGGAA | 8720 | UUCCAUGUC UCGGGUCC | 1578 |
| 447 | AUGGACCC CUGAUGA GCCGUUAGGC GAA AGACAUGG | 8721 | CCAUGUCUC GGGUCCAU | 1579 |
| 452 | UUGAAAUG CUGAUGA GCCGUUAGGC GAA ACCCGAGA | 8722 | UCUCGGGUC CAUUUCAA | 1580 |
| 456 | AGAUUUGA CUGAUGA GCCGUUAGGC GAA AUGGACCC | 8723 | GGGUCCAUU UCAAAUCU | 1581 |
| 457 | GAGAUUUG CUGAUGA GCCGUUAGGC GAA AAUGGACC | 8724 | GGUCCAUUU CAAAUCUC | 1582 |
| 458 | UGAGAUUU CUGAUGA GCCGUUAGGC GAA AAAUGGAC | 8725 | GUCCAUUUC AAAUCUCA | 1583 |
| 463 | CACGUUGA CUGAUGA GCCGUUAGGC GAA AUUUGAAA | 8726 | UUUCAAAUC UCAACGUG | 1584 |
| 465 | GACACGUU CUGAUGA GCCGUUAGGC GAA AGAUUUGA | 8727 | UCAAAUCUC AACGUGUC | 1585 |
| 473 | CACAAAGU CUGAUGA GCCGUUAGGC GAA ACACGUUG | 8728 | CAACGUGUC ACUUUGUG | 1586 |
| 477 | CUUGCACA CUGAUGA GCCGUUAGGC GAA AGUGACAC | 8729 | GUGUCACUU UGUGCAAG | 1587 |
| 478 | UCUUGCAC CUGAUGA GCCGUUAGGC GAA AAGUGACA | 8730 | UGUCACUUU GUGCAAGA | 1588 |
| 488 | UUUCUGGG CUGAUGA GCCGUUAGGC GAA AUCUUGCA | 8731 | UGCAAGAUA CCCAGAAA | 1589 |
| 503 | CAGGAACA CUGAUGA GCCGUUAGGC GAA AUCUCUUU | 8732 | AAAGAGAUU UGUUCCUG | 1590 |
| 504 | UCAGGAAC CUGAUGA GCCGUUAGGC GAA AAUCUCUU | 8733 | AAGAGAUUU GUUCCUGA | 1591 |
| 507 | CCAUCAGG CUGAUGA GCCGUUAGGC GAA ACAAAUCU | 8734 | AGAUUUGUU CCUGAUGG | 1592 |
| 508 | ACCAUCAG CUGAUGA GCCGUUAGGC GAA AACAAAUC | 8735 | GAUUUGUUC CUGAUGGU | 1593 |
| 517 | AAUUCUGU CUGAUGA GCCGUUAGGC GAA ACCAUCAG | 8736 | CUGAUGGUA ACAGAAUU | 1594 |
| 525 | UCCCAGGA CUGAUGA GCCGUUAGGC GAA AUUCUGUU | 8737 | AACAGAAUU UCCUGGGA | 1595 |
| 526 | GUCCCAGG CUGAUGA GCCGUUAGGC GAA AAUUCUGU | 8738 | ACAGAAUUU CCUGGGAC | 1596 |
| 527 | UGUCCCAG CUGAUGA GCCGUUAGGC GAA AAAUUCUG | 8739 | CAGAAUUUC CUGGGACA | 1597 |
| 548 | GAAUAGUA CUGAUGA GCCGUUAGGC GAA AGCCCUUC | 8740 | GAAGGGCUU UACUAUUC | 1598 |
| 549 | GGAAUAGU CUGAUGA GCCGUUAGGC GAA AAGCCCUU | 8741 | AAGGGCUUU ACUAUUCC | 1599 |
| 550 | GGGAAUAG CUGAUGA GCCGUUAGGC GAA AAAGCCCU | 8742 | AGGGCUUUA CUAUUCCC | 1600 |
| 553 | GCUGGGAA CUGAUGA GCCGUUAGGC GAA AGUAAAGC | 8743 | GCUUUACUA UUCCCAGC | 1601 |
| 555 | UAGCUGGG CUGAUGA GCCGUUAGGC GAA AUAGUAAA | 8744 | UUUACUAUU CCCAGCUA | 1602 |
| 556 | GUAGCUGG CUGAUGA GCCGUUAGGC GAA AAUAGUAA | 8745 | UUACUAUUC CCAGCUAC | 1603 |
| 563 | UGAUCAUG CUGAUGA GCCGUUAGGC GAA AGCUGGGA | 8746 | UCCCAGCUA CAUGAUCA | 1604 |
| 570 | GCAUAGCU CUGAUGA GCCGUUAGGC GAA AUCAUGUA | 8747 | UACAUGAUC AGCUAUGC | 1605 |
| 575 | UGCCAGCA CUGAUGA GCCGUUAGGC GAA AGCUGAUC | 8748 | GAUCAGCUA UGCUGGCA | 1606 |

123

| | | | | |
|---|---|---|---|---|
| 588 | UCACAGAA CUGAUGA GCCGUUAGGC GAA ACCAUGCC | 8749 | GGCAUGGUC UUCUGUGA | 1607 |
| 590 | CUUCACAG CUGAUGA GCCGUUAGGC GAA AGACCAUG | 8750 | CAUGGUCUU CUGUGAAG | 1608 |
| 591 | GCUUCACA CUGAUGA GCCGUUAGGC GAA AAGACCAU | 8751 | AUGGUCUUC UGUGAAGC | 1609 |
| 606 | UCAUCAUU CUGAUGA GCCGUUAGGC GAA AUUUUUGC | 8752 | GCAAAAAUU AAUGAUGA | 1610 |
| 607 | UUCAUCAU CUGAUGA GCCGUUAGGC GAA AAUUUUUG | 8753 | CAAAAAUUA AUGAUGAA | 1611 |
| 619 | AGACUGGU CUGAUGA GCCGUUAGGC GAA ACUUUCAU | 8754 | AUGAAAGUU ACCAGUCU | 1612 |
| 620 | UAGACUGG CUGAUGA GCCGUUAGGC GAA AACUUUCA | 8755 | UGAAAGUUA CCAGUCUA | 1613 |
| 626 | ACAUAAUA CUGAUGA GCCGUUAGGC GAA ACUGGUAA | 8756 | UUACCAGUC UAUUAUGU | 1614 |
| 628 | GUACAUAA CUGAUGA GCCGUUAGGC GAA AGACUGGU | 8757 | ACCAGUCUA UUAUGUAC | 1615 |
| 630 | AUGUACAU CUGAUGA GCCGUUAGGC GAA AUAGACUG | 8758 | CAGUCUAUU AUGUACAU | 1616 |
| 631 | UAUGUACA CUGAUGA GCCGUUAGGC GAA AAUAGACU | 8759 | AGUCUAUUA UGUACAUA | 1617 |
| 635 | CAACUAUG CUGAUGA GCCGUUAGGC GAA ACAUAAUA | 8760 | UAUUAUGUA CAUAGUUG | 1618 |
| 639 | ACGACAAC CUGAUGA GCCGUUAGGC GAA AUGUACAU | 8761 | AUGUACAUA GUUGUCGU | 1619 |
| 642 | ACAACGAC CUGAUGA GCCGUUAGGC GAA ACUAUGUA | 8762 | UACAUAGUU GUCGUUGU | 1620 |
| 645 | CCUACAAC CUGAUGA GCCGUUAGGC GAA ACAACUAU | 8763 | AUAGUUGUC GUUGUAGG | 1621 |
| 648 | UACCCUAC CUGAUGA GCCGUUAGGC GAA ACGACAAC | 8764 | GUUGUCGUU GUAGGGUA | 1622 |
| 651 | CUAUACCC CUGAUGA GCCGUUAGGC GAA ACAACGAC | 8765 | GUCGUUGUA GGGUAUAG | 1623 |
| 656 | AAAUCCUA CUGAUGA GCCGUUAGGC GAA ACCCUACA | 8766 | UGUAGGGUA UAGGAUUU | 1624 |
| 658 | AUAAAUCC CUGAUGA GCCGUUAGGC GAA AUACCCUA | 8767 | UAGGGUAUA GGAUUUAU | 1625 |
| 663 | ACAUCAUA CUGAUGA GCCGUUAGGC GAA AUCCUAUA | 8768 | UAUAGGAUU UAUGAUGU | 1626 |
| 664 | CACAUCAU CUGAUGA GCCGUUAGGC GAA AAUCCUAU | 8769 | AUAGGAUUU AUGAUGUG | 1627 |
| 665 | CCACAUCA CUGAUGA GCCGUUAGGC GAA AAAUCCUA | 8770 | UAGGAUUUA UGAUGUGG | 1628 |
| 675 | GGACUCAG CUGAUGA GCCGUUAGGC GAA ACCACAUC | 8771 | GAUGUGGUU CUGAGUCC | 1629 |
| 676 | CGGACUCA CUGAUGA GCCGUUAGGC GAA AACCACAU | 8772 | AUGUGGUUC UGAGUCCG | 1630 |
| 682 | AUGAGACG CUGAUGA GCCGUUAGGC GAA ACUCAGAA | 8773 | UUCUGAGUC CGUCUCAU | 1631 |
| 686 | UUCCAUGA CUGAUGA GCCGUUAGGC GAA ACGGACUC | 8774 | GAGUCCGUC UCAUGGAA | 1632 |
| 688 | AAUUCCAU CUGAUGA GCCGUUAGGC GAA AGACGGAC | 8775 | GUCCGUCUC AUGGAAUU | 1633 |
| 696 | GAUAGUUC CUGAUGA GCCGUUAGGC GAA AUUCCAUG | 8776 | CAUGGAAUU GAACUAUC | 1634 |
| 702 | CCAACAGA CUGAUGA GCCGUUAGGC GAA AGUUCAAU | 8777 | AUUGAACUA UCUGUUGG | 1635 |
| 704 | CUCCAACA CUGAUGA GCCGUUAGGC GAA AUAGUUCA | 8778 | UGAACUAUC UGUUGGAG | 1636 |
| 708 | UUUUCUCC CUGAUGA GCCGUUAGGC GAA ACAGAUAG | 8779 | CUAUCUGUU GGAGAAAA | 1637 |
| 720 | UUUAAGAC CUGAUGA GCCGUUAGGC GAA AGCUUUUC | 8780 | GAAAAGCUU GUCUUAAA | 1638 |
| 723 | CAAUUUAA CUGAUGA GCCGUUAGGC GAA ACAAGCUU | 8781 | AAGCUUGUC UUAAAUUG | 1639 |
| 725 | UACAAUUU CUGAUGA GCCGUUAGGC GAA AGACAAGC | 8782 | GCUUGUCUU AAAUUGUA | 1640 |
| 726 | GUACAAUU CUGAUGA GCCGUUAGGC GAA AAGACAAG | 8783 | CUUGUCUUA AAUUGUAC | 1641 |

124

| | | | | |
|---|---|---|---|---|
| 730 | UGCUGUAC CUGAUGA GCCGUUAGGC GAA AUUUAAGA | 8784 | UCUUAAAUU GUACAGCA | 1642 |
| 733 | UCUUGCUG CUGAUGA GCCGUUAGGC GAA ACAAUUUA | 8785 | UAAAUUGUA CAGCAAGA | 1643 |
| 750 | CCCACAUU CUGAUGA GCCGUUAGGC GAA AGUUCAGU | 8786 | ACUGAACUA AAUGUGGG | 1644 |
| 762 | UUGAAGUC CUGAUGA GCCGUUAGGC GAA AUCCCCAC | 8787 | GUGGGGAUU GACUUCAA | 1645 |
| 767 | CCCAGUUG CUGAUGA GCCGUUAGGC GAA AGUCAAUC | 8788 | GAUUGACUU CAACUGGG | 1646 |
| 768 | UCCCAGUU CUGAUGA GCCGUUAGGC GAA AAGUCAAU | 8789 | AUUGACUUC AACUGGGA | 1647 |
| 779 | AAGAAGGG CUGAUGA GCCGUUAGGC GAA AUUCCCAG | 8790 | CUGGGAAUA CCCUUCUU | 1648 |
| 784 | CUUCGAAG CUGAUGA GCCGUUAGGC GAA AGGGUAUU | 8791 | AAUACCCUU CUUCGAAG | 1649 |
| 785 | GCUUCGAA CUGAUGA GCCGUUAGGC GAA AAGGGUAU | 8792 | AUACCCUUC UUCGAAGC | 1650 |
| 787 | AUGCUUCG CUGAUGA GCCGUUAGGC GAA AGAAGGGU | 8793 | ACCCUUCUU CGAAGCAU | 1651 |
| 788 | GAUGCUUC CUGAUGA GCCGUUAGGC GAA AAGAAGGG | 8794 | CCCUUCUUC GAAGCAUC | 1652 |
| 796 | CUUAUGCU CUGAUGA GCCGUUAGGC GAA AUGCUUCG | 8795 | CGAAGCAUC AGCAUAAG | 1653 |
| 802 | AAGUUUCU CUGAUGA GCCGUUAGGC GAA AUGCUGAU | 8796 | AUCAGCAUA AGAAACUU | 1654 |
| 810 | CGGUUUAC CUGAUGA GCCGUUAGGC GAA AGUUUCUU | 8797 | AAGAAACUU GUAAACCG | 1655 |
| 813 | UCUCGGUU CUGAUGA GCCGUUAGGC GAA ACAAGUUU | 8798 | AAACUUGUA AACCGAGA | 1656 |
| 825 | UGGGUUUU CUGAUGA GCCGUUAGGC GAA AGGUCUCG | 8799 | CGAGACCUA AAAACCCA | 1657 |
| 836 | CACUCCCA CUGAUGA GCCGUUAGGC GAA ACUGGGUU | 8800 | AACCCAGUC UGGGAGUG | 1658 |
| 857 | UGCUCAAA CUGAUGA GCCGUUAGGC GAA AUUUCUUC | 8801 | GAAGAAAUU UUUGAGCA | 1659 |
| 858 | GUGCUCAA CUGAUGA GCCGUUAGGC GAA AAUUUCUU | 8802 | AAGAAAUUU UUGAGCAC | 1660 |
| 859 | GGUGCUCA CUGAUGA GCCGUUAGGC GAA AAAUUUCU | 8803 | AGAAAUUUU UGAGCACC | 1661 |
| 860 | AGGUGCUC CUGAUGA GCCGUUAGGC GAA AAAAUUUC | 8804 | GAAAUUUUU GAGCACCU | 1662 |
| 869 | CUAUAGUU CUGAUGA GCCGUUAGGC GAA AGGUGCUC | 8805 | GAGCACCUU AACUAUAG | 1663 |
| 870 | UCUAUAGU CUGAUGA GCCGUUAGGC GAA AAGGUGCU | 8806 | AGCACCUUA ACUAUAGA | 1664 |
| 874 | ACCAUCUA CUGAUGA GCCGUUAGGC GAA AGUUAAGG | 8807 | CCUUAACUA UAGAUGGU | 1665 |
| 876 | ACACCAUC CUGAUGA GCCGUUAGGC GAA AUAGUUAA | 8808 | UUAACUAUA GAUGGUGU | 1666 |
| 885 | CUCCGGGU CUGAUGA GCCGUUAGGC GAA ACACCAUC | 8809 | GAUGGUGUA ACCCGGAG | 1667 |
| 905 | AGGUGUAC CUGAUGA GCCGUUAGGC GAA AUCCUUGG | 8810 | CCAAGGAUU GUACACCU | 1668 |
| 908 | CACAGGUG CUGAUGA GCCGUUAGGC GAA ACAAUCCU | 8811 | AGGAUUGUA CACCUGUG | 1669 |
| 923 | GCCCACUG CUGAUGA GCCGUUAGGC GAA AUGCUGCA | 8812 | UGCAGCAUC CAGUGGGC | 1670 |
| 956 | CCCUGACA CUGAUGA GCCGUUAGGC GAA AUGUGCUG | 8813 | CAGCACAUU UGUCAGGG | 1671 |
| 957 | ACCCUGAC CUGAUGA GCCGUUAGGC GAA AAUGUGCU | 8814 | AGCACAUUU GUCAGGGU | 1672 |
| 960 | UGGACCCU CUGAUGA GCCGUUAGGC GAA ACAAAUGU | 8815 | ACAUUUGUC AGGGUCCA | 1673 |
| 966 | UUUUCAUG CUGAUGA GCCGUUAGGC GAA ACCCUGAC | 8816 | GUCAGGGUC CAUGAAAA | 1674 |
| 979 | AGCAACAA CUGAUGA GCCGUUAGGC GAA AGGUUUUU | 8817 | AAAAACCUU UUGUUGCU | 1675 |
| 980 | AAGCAACA CUGAUGA GCCGUUAGGC GAA AAGGUUUU | 8818 | AAAACCUUU UGUUGCUU | 1676 |

| | | | | |
|---|---|---|---|---|
| 981 | AAAGCAAC CUGAUGA GCCGUUAGGC GAA AAAGGUUU | 8819 | AAACCUUUU GUUGCUUU | 1677 |
| 984 | CCAAAAGC CUGAUGA GCCGUUAGGC GAA ACAAAAGG | 8820 | CCUUUUGUU GCUUUUGG | 1678 |
| 988 | ACUUCCAA CUGAUGA GCCGUUAGGC GAA AGCAACAA | 8821 | UUGUUGCUU UUGGAAGU | 1679 |
| 989 | CACUUCCA CUGAUGA GCCGUUAGGC GAA AAGCAACA | 8822 | UGUUGCUUU UGGAAGUG | 1680 |
| 990 | CCACUUCC CUGAUGA GCCGUUAGGC GAA AAAGCAAC | 8823 | GUUGCUUUU GGAAGUGG | 1681 |
| 1007 | CCACCAGA CUGAUGA GCCGUUAGGC GAA AUUCCAUG | 8824 | CAUGGAAUC UCUGGUGG | 1682 |
| 1009 | UUCCACCA CUGAUGA GCCGUUAGGC GAA AGAUUCCA | 8825 | UGGAAUCUC UGGUGGAA | 1683 |
| 1038 | GGGAUUCU CUGAUGA GCCGUUAGGC GAA ACACGCUC | 8826 | GAGCGUGUC AGAAUCCC | 1684 |
| 1044 | UUCGCAGG CUGAUGA GCCGUUAGGC GAA AUUCUGAC | 8827 | GUCAGAAUC CCUGCGAA | 1685 |
| 1055 | AACCAAGG CUGAUGA GCCGUUAGGC GAA ACUUCGCA | 8828 | UGCGAAGUA CCUUGGUU | 1686 |
| 1059 | GGGUAACC CUGAUGA GCCGUUAGGC GAA AGGUACUU | 8829 | AAGUACCUU GGUUACCC | 1687 |
| 1063 | GGGUGGGU CUGAUGA GCCGUUAGGC GAA ACCAAGGU | 8830 | ACCUUGGUU ACCCACCC | 1688 |
| 1064 | GGGGUGGG CUGAUGA GCCGUUAGGC GAA AACCAAGG | 8831 | CCUUGGUUA CCCACCCC | 1689 |
| 1080 | UACCAUUU CUGAUGA GCCGUUAGGC GAA AUUUCUGG | 8832 | CCAGAAAUA AAAUGGUA | 1690 |
| 1088 | CAUUUUUA CUGAUGA GCCGUUAGGC GAA ACCAUUUU | 8833 | AAAAUGGUA UAAAAAUG | 1691 |
| 1090 | UCCAUUUU CUGAUGA GCCGUUAGGC GAA AUACCAUU | 8834 | AAUGGUAUA AAAAUGGA | 1692 |
| 1101 | UCAAGGGG CUGAUGA GCCGUUAGGC GAA AUUCCAUU | 8835 | AAUGGAAUA CCCCUUGA | 1693 |
| 1107 | UUGGACUC CUGAUGA GCCGUUAGGC GAA AGGGGUAU | 8836 | AUACCCCUU GAGUCCAA | 1694 |
| 1112 | UGUGAUUG CUGAUGA GCCGUUAGGC GAA ACUCAAGG | 8837 | CCUUGAGUC CAAUCACA | 1695 |
| 1117 | AAUUGUGU CUGAUGA GCCGUUAGGC GAA AUUGGACU | 8838 | AGUCCAAUC ACACAAUU | 1696 |
| 1125 | CCCGCUUU CUGAUGA GCCGUUAGGC GAA AUUGUGUG | 8839 | CACACAAUU AAAGCGGG | 1697 |
| 1126 | CCCCGCUU CUGAUGA GCCGUUAGGC GAA AAUUGUGU | 8840 | ACACAAUUA AAGCGGGG | 1698 |
| 1140 | AUCGUCAG CUGAUGA GCCGUUAGGC GAA ACAUGCCC | 8841 | GGGCAUGUA CUGACGAU | 1699 |
| 1149 | ACUUCCAU CUGAUGA GCCGUUAGGC GAA AUCGUCAG | 8842 | CUGACGAUU AUGGAAGU | 1700 |
| 1150 | CACUUCCA CUGAUGA GCCGUUAGGC GAA AAUCGUCA | 8843 | UGACGAUUA UGGAAGUG | 1701 |
| 1180 | GACAGUGU CUGAUGA GCCGUUAGGC GAA AUUUCCUG | 8844 | CAGGAAAUU ACACUGUC | 1702 |
| 1181 | UGACAGUG CUGAUGA GCCGUUAGGC GAA AAUUUCCU | 8845 | AGGAAAUUA CACUGUCA | 1703 |
| 1188 | GUAAGGAU CUGAUGA GCCGUUAGGC GAA ACAGUGUA | 8846 | UACACUGUC AUCCUUAC | 1704 |
| 1191 | UUGGUAAG CUGAUGA GCCGUUAGGC GAA AUGACAGU | 8847 | ACUGUCAUC CUUACCAA | 1705 |
| 1194 | GGAUUGGU CUGAUGA GCCGUUAGGC GAA AGGAUGAC | 8848 | GUCAUCCUU ACCAAUCC | 1706 |
| 1195 | GGGAUUGG CUGAUGA GCCGUUAGGC GAA AAGGAUGA | 8849 | UCAUCCUUA CCAAUCCC | 1707 |
| 1201 | UGAAAUGG CUGAUGA GCCGUUAGGC GAA AUUGGUAA | 8850 | UUACCAAUC CCAUUUCA | 1708 |
| 1206 | UCCUUUGA CUGAUGA GCCGUUAGGC GAA AUGGGAUU | 8851 | AAUCCCAUU UCAAAGGA | 1709 |
| 1207 | CUCCUUUG CUGAUGA GCCGUUAGGC GAA AAUGGGAU | 8852 | AUCCCAUUU CAAAGGAG | 1710 |
| 1208 | UCUCCUUU CUGAUGA GCCGUUAGGC GAA AAAUGGGA | 8853 | UCCCAUUUC AAAGGAGA | 1711 |

| | | | | | |
|---|---|---|---|---|---|
| 1233 | ACCAGAGA CUGAUGA GCCGUUAGGC GAA ACCACAUG | 8854 | CAUGUGGUC UCUCUGGU | 1712 |
| 1235 | CAACCAGA CUGAUGA GCCGUUAGGC GAA AGACCACA | 8855 | UGUGGUCUC UCUGGUUG | 1713 |
| 1237 | CACAACCA CUGAUGA GCCGUUAGGC GAA AGAGACCA | 8856 | UGGUCUCUC UGGUUGUG | 1714 |
| 1242 | ACAUACAC CUGAUGA GCCGUUAGGC GAA ACCAGAGA | 8857 | UCUCUGGUU GUGUAUGU | 1715 |
| 1247 | GUGGGACA CUGAUGA GCCGUUAGGC GAA ACACAACC | 8858 | GGUUGUGUA UGUCCCAC | 1716 |
| 1251 | UGGGGUGG CUGAUGA GCCGUUAGGC GAA ACAUACAC | 8859 | GUGUAUGUC CCACCCCA | 1717 |
| 1263 | UUCUCACC CUGAUGA GCCGUUAGGC GAA AUCUGGGG | 8860 | CCCCAGAUU GGUGAGAA | 1718 |
| 1274 | AGAUUAGA CUGAUGA GCCGUUAGGC GAA AUUUCUCA | 8861 | UGAGAAAUC UCUAAUCU | 1719 |
| 1276 | AGAGAUUA CUGAUGA GCCGUUAGGC GAA AGAUUUCU | 8862 | AGAAAUCUC UAAUCUCU | 1720 |
| 1278 | GGAGAGAU CUGAUGA GCCGUUAGGC GAA AGAGAUUU | 8863 | AAAUCUCUA AUCUCUCC | 1721 |
| 1281 | ACAGGAGA CUGAUGA GCCGUUAGGC GAA AUUAGAGA | 8864 | UCUCUAAUC UCUCCUGU | 1722 |
| 1283 | CCACAGGA CUGAUGA GCCGUUAGGC GAA AGAUUAGA | 8865 | UCUAAUCUC UCCUGUGG | 1723 |
| 1285 | AUCCACAG CUGAUGA GCCGUUAGGC GAA AGAGAUUA | 8866 | UAAUCUCUC CUGUGGAU | 1724 |
| 1294 | CUGGUAGG CUGAUGA GCCGUUAGGC GAA AUCCACAG | 8867 | CUGUGGAUU CCUACCAG | 1725 |
| 1295 | ACUGGUAG CUGAUGA GCCGUUAGGC GAA AAUCCACA | 8868 | UGUGGAUUC CUACCAGU | 1726 |
| 1298 | CGUACUGG CUGAUGA GCCGUUAGGC GAA AGGAAUCC | 8869 | GGAUUCCUA CCAGUACG | 1727 |
| 1304 | UGGUGCCG CUGAUGA GCCGUUAGGC GAA ACUGGUAG | 8870 | CUACCAGUA CGGCACCA | 1728 |
| 1315 | CAGCGUUU CUGAUGA GCCGUUAGGC GAA AGUGGUGC | 8871 | GCACCACUC AAACGCUG | 1729 |
| 1330 | AUAGACCG CUGAUGA GCCGUUAGGC GAA ACAUGUCA | 8872 | UGACAUGUA CGGUCUAU | 1730 |
| 1335 | AUGGCAUA CUGAUGA GCCGUUAGGC GAA ACCGUACA | 8873 | UGUACGGUC UAUGCCAU | 1731 |
| 1337 | GAAUGGCA CUGAUGA GCCGUUAGGC GAA AGACCGUA | 8874 | UACGGUCUA UGCCAUUC | 1732 |
| 1344 | GGGGGAGG CUGAUGA GCCGUUAGGC GAA AUGGCAUA | 8875 | UAUGCCAUU CCUCCCCC | 1733 |
| 1345 | CGGGGGAG CUGAUGA GCCGUUAGGC GAA AAUGGCAU | 8876 | AUGCCAUUC CUCCCCCG | 1734 |
| 1348 | AUGCGGGG CUGAUGA GCCGUUAGGC GAA AGGAAUGG | 8877 | CCAUUCCUC CCCCGCAU | 1735 |
| 1357 | GUGGAUGU CUGAUGA GCCGUUAGGC GAA AUGCGGGG | 8878 | CCCCGCAUC ACAUCCAC | 1736 |
| 1362 | UACCAGUG CUGAUGA GCCGUUAGGC GAA AUGUGAUG | 8879 | CAUCACAUC CACUGGUA | 1737 |
| 1370 | ACUGCCAA CUGAUGA GCCGUUAGGC GAA ACCAGUGG | 8880 | CCACUGGUA UUGGCAGU | 1738 |
| 1372 | CAACUGCC CUGAUGA GCCGUUAGGC GAA AUACCAGU | 8881 | ACUGGUAUU GGCAGUUG | 1739 |
| 1379 | CUUCCUCC CUGAUGA GCCGUUAGGC GAA ACUGCCAA | 8882 | UUGGCAGUU GGAGGAAG | 1740 |
| 1416 | GUCACUGA CUGAUGA GCCGUUAGGC GAA ACAGCUUG | 8883 | CAAGCUGUC UCAGUGAC | 1741 |
| 1418 | UUGUCACU CUGAUGA GCCGUUAGGC GAA AGACAGCU | 8884 | AGCUGUCUC AGUGACAA | 1742 |
| 1433 | CACAAGGG CUGAUGA GCCGUUAGGC GAA AUGGGUUU | 8885 | AAACCCAUA CCCUUGUG | 1743 |
| 1438 | UUCUUCAC CUGAUGA GCCGUUAGGC GAA AGGGUAUG | 8886 | CAUACCCUU GUGAAGAA | 1744 |
| 1466 | CUCCCUGG CUGAUGA GCCGUUAGGC GAA AGUCCUCC | 8887 | GGAGGACUU CCAGGGAG | 1745 |
| 1467 | CCUCCCUG CUGAUGA GCCGUUAGGC GAA AAGUCCUC | 8888 | GAGGACUUC CAGGGAGG | 1746 |

127

| | | | | |
|---|---|---|---|---|
| 1480 | UUCAAUUU CUGAUGA GCCGUUAGGC GAA AUUUCCUC | 8889 | GAGGAAAUA AAAUUGAA | 1747 |
| 1485 | UUAACUUC CUGAUGA GCCGUUAGGC GAA AUUUUAUU | 8890 | AAUAAAAUU GAAGUUAA | 1748 |
| 1491 | UUUUUAUU CUGAUGA GCCGUUAGGC GAA ACUUCAAU | 8891 | AUUGAAGUU AAUAAAAA | 1749 |
| 1492 | AUUUUUAU CUGAUGA GCCGUUAGGC GAA AACUUCAA | 8892 | UUGAAGUUA AUAAAAAU | 1750 |
| 1495 | UUGAUUUU CUGAUGA GCCGUUAGGC GAA AUUAACUU | 8893 | AAGUUAAUA AAAAUCAA | 1751 |
| 1501 | AGCAAAUU CUGAUGA GCCGUUAGGC GAA AUUUUUAU | 8894 | AUAAAAAUC AAUUUGCU | 1752 |
| 1505 | UUAGAGCA CUGAUGA GCCGUUAGGC GAA AUUGAUUU | 8895 | AAAUCAAUU UGCUCUAA | 1753 |
| 1506 | AUUAGAGC CUGAUGA GCCGUUAGGC GAA AAUUGAUU | 8896 | AAUCAAUUU GCUCUAAU | 1754 |
| 1510 | UUCAAUUA CUGAUGA GCCGUUAGGC GAA AGCAAAUU | 8897 | AAUUUGCUC UAAUUGAA | 1755 |
| 1512 | CCUUCAAU CUGAUGA GCCGUUAGGC GAA AGAGCAAA | 8898 | UUUGCUCUA AUUGAAGG | 1756 |
| 1515 | UUUCCUUC CUGAUGA GCCGUUAGGC GAA AUUAGAGC | 8899 | GCUCUAAUU GAAGGAAA | 1757 |
| 1536 | AGGGUACU CUGAUGA GCCGUUAGGC GAA ACAGUUUU | 8900 | AAAACUGUA AGUACCCU | 1758 |
| 1540 | AACAAGGG CUGAUGA GCCGUUAGGC GAA ACUUACAG | 8901 | CUGUAAGUA CCCUUGUU | 1759 |
| 1545 | UGGAUAAC CUGAUGA GCCGUUAGGC GAA AGGGUACU | 8902 | AGUACCCUU GUUAUCCA | 1760 |
| 1548 | GCUUGGAU CUGAUGA GCCGUUAGGC GAA ACAAGGGU | 8903 | ACCCUUGUU AUCCAAGC | 1761 |
| 1549 | CGCUUGGA CUGAUGA GCCGUUAGGC GAA AACAAGGG | 8904 | CCCUUGUUA UCCAAGCG | 1762 |
| 1551 | GCCGCUUG CUGAUGA GCCGUUAGGC GAA AUAACAAG | 8905 | CUUGUUAUC CAAGCGGC | 1763 |
| 1568 | ACAAAGCU CUGAUGA GCCGUUAGGC GAA ACACAUUU | 8906 | AAAUGUGUC AGCUUUGU | 1764 |
| 1573 | UUUGUACA CUGAUGA GCCGUUAGGC GAA AGCUGACA | 8907 | UGUCAGCUU UGUACAAA | 1765 |
| 1574 | AUUUGUAC CUGAUGA GCCGUUAGGC GAA AAGCUGAC | 8908 | GUCAGCUUU GUACAAAU | 1766 |
| 1577 | CACAUUUG CUGAUGA GCCGUUAGGC GAA ACAAAGCU | 8909 | AGCUUUGUA CAAAUGUG | 1767 |
| 1593 | ACUUUGUU CUGAUGA GCCGUUAGGC GAA ACCGCUUC | 8910 | GAAGCGGUC AACAAAGU | 1768 |
| 1602 | CCUCUCCC CUGAUGA GCCGUUAGGC GAA ACUUUGUU | 8911 | AACAAAGUC GGGAGAGG | 1769 |
| 1623 | UGGAAGGA CUGAUGA GCCGUUAGGC GAA AUCACCCU | 8912 | AGGGUGAUC UCCUUCCA | 1770 |
| 1625 | CGUGGAAG CUGAUGA GCCGUUAGGC GAA AGAUCACC | 8913 | GGUGAUCUC CUUCCACG | 1771 |
| 1628 | UCACGUGG CUGAUGA GCCGUUAGGC GAA AGGAGAUC | 8914 | GAUCUCCUU CCACGUGA | 1772 |
| 1629 | GUCACGUG CUGAUGA GCCGUUAGGC GAA AAGGAGAU | 8915 | AUCUCCUUC CACGUGAC | 1773 |
| 1645 | AAUUUCAG CUGAUGA GCCGUUAGGC GAA ACCCCUGG | 8916 | CCAGGGGUC CUGAAAUU | 1774 |
| 1653 | UGCAAAGU CUGAUGA GCCGUUAGGC GAA AUUUCAGG | 8917 | CCUGAAAUU ACUUUGCA | 1775 |
| 1654 | UUGCAAAG CUGAUGA GCCGUUAGGC GAA AAUUUCAG | 8918 | CUGAAAUUA CUUUGCAA | 1776 |
| 1657 | AGGUUGCA CUGAUGA GCCGUUAGGC GAA AGUAAUUU | 8919 | AAAUUACUU UGCAACCU | 1777 |
| 1658 | CAGGUUGC CUGAUGA GCCGUUAGGC GAA AAGUAAUU | 8920 | AAUUACUUU GCAACCUG | 1778 |
| 1697 | ACCACAAA CUGAUGA GCCGUUAGGC GAA ACACGCUC | 8921 | GAGCGUGUC UUUGUGGU | 1779 |
| 1699 | GCACCACA CUGAUGA GCCGUUAGGC GAA AGACACGC | 8922 | GCGUGUCUU UGUGGUGC | 1780 |
| 1700 | UGCACCAC CUGAUGA GCCGUUAGGC GAA AAGACACG | 8923 | CGUGUCUUU GUGGUGCA | 1781 |

| | | | | |
|---|---|---|---|---|
| 1721 | CAAACGUA CUGAUGA GCCGUUAGGC GAA AUCUGUCU | 8924 | AGACAGAUC UACGUUUG | 1782 |
| 1723 | CUCAAACG CUGAUGA GCCGUUAGGC GAA AGAUCUGU | 8925 | ACAGAUCUA CGUUUGAG | 1783 |
| 1727 | GGUUCUCA CUGAUGA GCCGUUAGGC GAA ACGUAGAU | 8926 | AUCUACGUU UGAGAACC | 1784 |
| 1728 | AGGUUCUC CUGAUGA GCCGUUAGGC GAA AACGUAGA | 8927 | UCUACGUUU GAGAACCU | 1785 |
| 1737 | UACCAUGU CUGAUGA GCCGUUAGGC GAA AGGUUCUC | 8928 | GAGAACCUC ACAUGGUA | 1786 |
| 1745 | CAAGCUUG CUGAUGA GCCGUUAGGC GAA ACCAUGUG | 8929 | CACAUGGUA CAAGCUUG | 1787 |
| 1752 | UGUGGGCC CUGAUGA GCCGUUAGGC GAA AGCUUGUA | 8930 | UACAAGCUU GGCCCACA | 1788 |
| 1765 | GAUUGGCA CUGAUGA GCCGUUAGGC GAA AGGCUGUG | 8931 | CACAGCCUC UGCCAAUC | 1789 |
| 1773 | CCCACAUG CUGAUGA GCCGUUAGGC GAA AUUGGCAG | 8932 | CUGCCAAUC CAUGUGGG | 1790 |
| 1787 | GUGUGGGC CUGAUGA GCCGUUAGGC GAA ACUCUCCC | 8933 | GGGAGAGUU GCCCACAC | 1791 |
| 1800 | UUCUUGCA CUGAUGA GCCGUUAGGC GAA ACAGGUGU | 8934 | ACACCUGUU UGCAAGAA | 1792 |
| 1801 | GUUCUUGC CUGAUGA GCCGUUAGGC GAA AACAGGUG | 8935 | CACCUGUUU GCAAGAAC | 1793 |
| 1811 | GAGUAUCC CUGAUGA GCCGUUAGGC GAA AGUUCUUG | 8936 | CAAGAACUU GGAUACUC | 1794 |
| 1816 | CCAAAGAG CUGAUGA GCCGUUAGGC GAA AUCCAAGU | 8937 | ACUUGGAUA CUCUUUGG | 1795 |
| 1819 | UUUCCAAA CUGAUGA GCCGUUAGGC GAA AGUAUCCA | 8938 | UGGAUACUC UUUGGAAA | 1796 |
| 1821 | AAUUUCCA CUGAUGA GCCGUUAGGC GAA AGAGUAUC | 8939 | GAUACUCUU UGGAAAUU | 1797 |
| 1822 | CAAUUUCC CUGAUGA GCCGUUAGGC GAA AAGAGUAU | 8940 | AUACUCUUU GGAAAUUG | 1798 |
| 1829 | UGGCAUUC CUGAUGA GCCGUUAGGC GAA AUUUCCAA | 8941 | UUGGAAAUU GAAUGCCA | 1799 |
| 1844 | UAUUAGAG CUGAUGA GCCGUUAGGC GAA ACAUGGUG | 8942 | CACCAUGUU CUCUAAUA | 1800 |
| 1845 | CUAUUAGA CUGAUGA GCCGUUAGGC GAA AACAUGGU | 8943 | ACCAUGUUC UCUAAUAG | 1801 |
| 1847 | UGCUAUUA CUGAUGA GCCGUUAGGC GAA AGAACAUG | 8944 | CAUGUUCUC UAAUAGCA | 1802 |
| 1849 | UGUGCUAU CUGAUGA GCCGUUAGGC GAA AGAGAACA | 8945 | UGUUCUCUA AUAGCACA | 1803 |
| 1852 | AUUUGUGC CUGAUGA GCCGUUAGGC GAA AUUAGAGA | 8946 | UCUCUAAUA GCACAAAU | 1804 |
| 1866 | AUGAUCAA CUGAUGA GCCGUUAGGC GAA AUGUCAUU | 8947 | AAUGACAUU UUGAUCAU | 1805 |
| 1867 | CAUGAUCA CUGAUGA GCCGUUAGGC GAA AAUGUCAU | 8948 | AUGACAUUU UGAUCAUG | 1806 |
| 1868 | CCAUGAUC CUGAUGA GCCGUUAGGC GAA AAAUGUCA | 8949 | UGACAUUUU GAUCAUGG | 1807 |
| 1872 | AGCUCCAU CUGAUGA GCCGUUAGGC GAA AUCAAAAU | 8950 | AUUUUGAUC AUGGAGCU | 1808 |
| 1881 | GCAUUCUU CUGAUGA GCCGUUAGGC GAA AGCUCCAU | 8951 | AUGGAGCUU AAGAAUGC | 1809 |
| 1882 | UGCAUUCU CUGAUGA GCCGUUAGGC GAA AAGCUCCA | 8952 | UGGAGCUUA AGAAUGCA | 1810 |
| 1892 | CCUGCAAG CUGAUGA GCCGUUAGGC GAA AUGCAUUC | 8953 | GAAUGCAUC CUUGCAGG | 1811 |
| 1895 | GGUCCUGC CUGAUGA GCCGUUAGGC GAA AGGAUGCA | 8954 | UGCAUCCUU GCAGGACC | 1812 |
| 1913 | GGCAGACA CUGAUGA GCCGUUAGGC GAA AGUCUCCU | 8955 | AGGAGACUA UGUCUGCC | 1813 |
| 1917 | GCAAGGCA CUGAUGA GCCGUUAGGC GAA ACAUAGUC | 8956 | GACUAUGUC UGCCUUGC | 1814 |
| 1923 | UCUUGAGC CUGAUGA GCCGUUAGGC GAA AGGCAGAC | 8957 | GUCUGCCUU GCUCAAGA | 1815 |
| 1927 | CCUGUCUU CUGAUGA GCCGUUAGGC GAA AGCAAGGC | 8958 | GCCUUGCUC AAGACAGG | 1816 |

129

| | | | | |
|---|---|---|---|---|
| 1954 | GACCACGC CUGAUGA GCCGUUAGGC GAA AUGUCUUU | 8959 | AAAGACAUU GCGUGGUC | 1817 |
| 1962 | AGCUGCCU CUGAUGA GCCGUUAGGC GAA ACCACGCA | 8960 | UGCGUGGUC AGGCAGCU | 1818 |
| 1971 | AGGACUGU CUGAUGA GCCGUUAGGC GAA AGCUGCCU | 8961 | AGGCAGCUC ACAGUCCU | 1819 |
| 1977 | CGCUCUAG CUGAUGA GCCGUUAGGC GAA ACUGUGAG | 8962 | CUCACAGUC CUAGAGCG | 1820 |
| 1980 | ACACGCUC CUGAUGA GCCGUUAGGC GAA AGGACUGU | 8963 | ACAGUCCUA GAGCGUGU | 1821 |
| 2001 | UUUCCUGU CUGAUGA GCCGUUAGGC GAA AUCGUGGG | 8964 | CCCACGAUC ACAGGAAA | 1822 |
| 2020 | UGUCGUCU CUGAUGA GCCGUUAGGC GAA AUUCUCCA | 8965 | UGGAGAAUC AGACGACA | 1823 |
| 2032 | UUCCCCAA CUGAUGA GCCGUUAGGC GAA ACUUGUCG | 8966 | CGACAAGUA UUGGGGAA | 1824 |
| 2034 | CUUUCCCC CUGAUGA GCCGUUAGGC GAA AUACUUGU | 8967 | ACAAGUAUU GGGGAAAG | 1825 |
| 2046 | GAGACUUC CUGAUGA GCCGUUAGGC GAA AUGCUUUC | 8968 | GAAAGCAUC GAAGUCUC | 1826 |
| 2052 | GUGCAUGA CUGAUGA GCCGUUAGGC GAA ACUUCGAU | 8969 | AUCGAAGUC UCAUGCAC | 1827 |
| 2054 | CCGUGCAU CUGAUGA GCCGUUAGGC GAA AGACUUCG | 8970 | CGAAGUCUC AUGCACGG | 1828 |
| 2066 | GAUUCCCA CUGAUGA GCCGUUAGGC GAA AUGCCGUG | 8971 | CACGGCAUC UGGGAAUC | 1829 |
| 2074 | UGGAGGGG CUGAUGA GCCGUUAGGC GAA AUUCCCAG | 8972 | CUGGGAAUC CCCCUCCA | 1830 |
| 2080 | GAUCUGUG CUGAUGA GCCGUUAGGC GAA AGGGGGAU | 8973 | AUCCCCCUC CACAGAUC | 1831 |
| 2088 | AACCACAU CUGAUGA GCCGUUAGGC GAA AUCUGUGG | 8974 | CCACAGAUC AUGUGGUU | 1832 |
| 2096 | UAUCUUUA CUGAUGA GCCGUUAGGC GAA ACCACAUG | 8975 | CAUGUGGUU UAAAGAUA | 1833 |
| 2097 | UUAUCUUU CUGAUGA GCCGUUAGGC GAA AACCACAU | 8976 | AUGUGGUUU AAAGAUAA | 1834 |
| 2098 | AUUAUCUU CUGAUGA GCCGUUAGGC GAA AAACCACA | 8977 | UGUGGUUUA AAGAUAAU | 1835 |
| 2104 | GGUCUCAU CUGAUGA GCCGUUAGGC GAA AUCUUUAA | 8978 | UUAAAGAUA AUGAGACC | 1836 |
| 2115 | UCUUCUAC CUGAUGA GCCGUUAGGC GAA AGGGUCUC | 8979 | GAGACCCUU GUAGAAGA | 1837 |
| 2118 | GAGUCUUC CUGAUGA GCCGUUAGGC GAA ACAAGGGU | 8980 | ACCCUUGUA GAAGACUC | 1838 |
| 2126 | CAAUGCCU CUGAUGA GCCGUUAGGC GAA AGUCUUCU | 8981 | AGAAGACUC AGGCAUUG | 1839 |
| 2133 | UUCAAUAC CUGAUGA GCCGUUAGGC GAA AUGCCUGA | 8982 | UCAGGCAUU GUAUUGAA | 1840 |
| 2136 | UCCUUCAA CUGAUGA GCCGUUAGGC GAA ACAAUGCC | 8983 | GGCAUUGUA UUGAAGGA | 1841 |
| 2138 | CAUCCUUC CUGAUGA GCCGUUAGGC GAA AUACAAUG | 8984 | CAUUGUAUU GAAGGAUG | 1842 |
| 2160 | CGGAUAGU CUGAUGA GCCGUUAGGC GAA AGGUUCCG | 8985 | CGGAACCUC ACUAUCCG | 1843 |
| 2164 | UCUGCGGA CUGAUGA GCCGUUAGGC GAA AGUGAGGU | 8986 | ACCUCACUA UCCGCAGA | 1844 |
| 2166 | ACUCUGCG CUGAUGA GCCGUUAGGC GAA AUAGUGAG | 8987 | CUCACUAUC CGCAGAGU | 1845 |
| 2196 | CAGGUGUA CUGAUGA GCCGUUAGGC GAA AGGCCUUC | 8988 | GAAGGCCUC UACACCUG | 1846 |
| 2198 | GGCAGGUG CUGAUGA GCCGUUAGGC GAA AGAGGCCU | 8989 | AGGCCUCUA CACCUGCC | 1847 |
| 2220 | CAGCCAAG CUGAUGA GCCGUUAGGC GAA ACACUGCA | 8990 | UGCAGUGUU CUUGGCUG | 1848 |
| 2221 | ACAGCCAA CUGAUGA GCCGUUAGGC GAA AACACUGC | 8991 | GCAGUGUUC UUGGCUGU | 1849 |
| 2223 | GCACAGCC CUGAUGA GCCGUUAGGC GAA AGAACACU | 8992 | AGUGUUCUU GGCUGUGC | 1850 |
| 2246 | UUAUGAAA CUGAUGA GCCGUUAGGC GAA AUGCCUCC | 8993 | GGAGGCAUU UUUCAUAA | 1851 |

130

| | | | | |
|---|---|---|---|---|
| 2247 | AUUAUGAA CUGAUGA GCCGUUAGGC GAA AAUGCCUC | 8994 | GAGGCAUUU UUCAUAAU | 1852 |
| 2248 | UAUUAUGA CUGAUGA GCCGUUAGGC GAA AAAUGCCU | 8995 | AGGCAUUUU UCAUAAUA | 1853 |
| 2249 | CUAUUAUG CUGAUGA GCCGUUAGGC GAA AAAAUGCC | 8996 | GGCAUUUUU CAUAAUAG | 1854 |
| 2250 | UCUAUUAU CUGAUGA GCCGUUAGGC GAA AAAAAUGC | 8997 | GCAUUUUUC AUAAUAGA | 1855 |
| 2253 | CCUUCUAU CUGAUGA GCCGUUAGGC GAA AUGAAAAA | 8998 | UUUUUCAUA AUAGAAGG | 1856 |
| 2256 | GCACCUUC CUGAUGA GCCGUUAGGC GAA AUUAUGAA | 8999 | UUCAUAAUA GAAGGUGC | 1857 |
| 2282 | UGAUUUCC CUGAUGA GCCGUUAGGC GAA AGUUCGUC | 9000 | GACGAACUU GGAAAUCA | 1858 |
| 2289 | AGAAUAAU CUGAUGA GCCGUUAGGC GAA AUUUCCAA | 9001 | UUGGAAAUC AUUAUUCU | 1859 |
| 2292 | ACUAGAAU CUGAUGA GCCGUUAGGC GAA AUGAUUUC | 9002 | GAAAUCAUU AUUCUAGU | 1860 |
| 2293 | UACUAGAA CUGAUGA GCCGUUAGGC GAA AAUGAUUU | 9003 | AAAUCAUUA UUCUAGUA | 1861 |
| 2295 | CCUACUAG CUGAUGA GCCGUUAGGC GAA AUAAUGAU | 9004 | AUCAUUAUU CUAGUAGG | 1862 |
| 2296 | GCCUACUA CUGAUGA GCCGUUAGGC GAA AAUAAUGA | 9005 | UCAUUAUUC UAGUAGGC | 1863 |
| 2298 | GUGCCUAC CUGAUGA GCCGUUAGGC GAA AGAAUAAU | 9006 | AUUAUUCUA GUAGGCAC | 1864 |
| 2301 | GUCGUGCC CUGAUGA GCCGUUAGGC GAA ACUAGAAU | 9007 | AUUCUAGUA GGCACGAC | 1865 |
| 2316 | AACAUGGC CUGAUGA GCCGUUAGGC GAA AUCACCGU | 9008 | ACGGUGAUU GCCAUGUU | 1866 |
| 2324 | GCCAGAAG CUGAUGA GCCGUUAGGC GAA ACAUGGCA | 9009 | UGCCAUGUU CUUCUGGC | 1867 |
| 2325 | AGCCAGAA CUGAUGA GCCGUUAGGC GAA AACAUGGC | 9010 | GCCAUGUUC UUCUGGCU | 1868 |
| 2327 | GUAGCCAG CUGAUGA GCCGUUAGGC GAA AGAACAUG | 9011 | CAUGUUCUU CUGGCUAC | 1869 |
| 2328 | AGUAGCCA CUGAUGA GCCGUUAGGC GAA AAGAACAU | 9012 | AUGUUCUUC UGGCUACU | 1870 |
| 2334 | ACAAGAAG CUGAUGA GCCGUUAGGC GAA AGCCAGAA | 9013 | UUCUGGCUA CUUCUUGU | 1871 |
| 2337 | AUGACAAG CUGAUGA GCCGUUAGGC GAA AGUAGCCA | 9014 | UGGCUACUU CUUGUCAU | 1872 |
| 2338 | GAUGACAA CUGAUGA GCCGUUAGGC GAA AAGUAGCC | 9015 | GGCUACUUC UUGUCAUC | 1873 |
| 2340 | AUGAUGAC CUGAUGA GCCGUUAGGC GAA AGAAGUAG | 9016 | CUACUUCUU GUCAUCAU | 1874 |
| 2343 | AGGAUGAU CUGAUGA GCCGUUAGGC GAA ACAAGAAG | 9017 | CUUCUUGUC AUCAUCCU | 1875 |
| 2346 | CCUAGGAU CUGAUGA GCCGUUAGGC GAA AUGACAAG | 9018 | CUUGUCAUC AUCCUAGG | 1876 |
| 2349 | GUCCCUAG CUGAUGA GCCGUUAGGC GAA AUGAUGAC | 9019 | GUCAUCAUC CUAGGGAC | 1877 |
| 2352 | ACGGUCCC CUGAUGA GCCGUUAGGC GAA AGGAUGAU | 9020 | AUCAUCCUA GGGACCGU | 1878 |
| 2361 | GCCCGCUU CUGAUGA GCCGUUAGGC GAA ACGGUCCC | 9021 | GGGACCGUU AAGCGGGC | 1879 |
| 2362 | GGCCCGCU CUGAUGA GCCGUUAGGC GAA AACGGUCC | 9022 | GGACCGUUA AGCGGGCC | 1880 |
| 2396 | UGGACAAG CUGAUGA GCCGUUAGGC GAA AGCCUGUC | 9023 | GACAGGCUA CUUGUCCA | 1881 |
| 2399 | CGAUGGAC CUGAUGA GCCGUUAGGC GAA AGUAGCCU | 9024 | AGGCUACUU GUCCAUCG | 1882 |
| 2402 | UGACGAUG CUGAUGA GCCGUUAGGC GAA ACAAGUAG | 9025 | CUACUUGUC CAUCGUCA | 1883 |
| 2406 | UCCAUGAC CUGAUGA GCCGUUAGGC GAA AUGGACAA | 9026 | UUGUCCAUC GUCAUGGA | 1884 |
| 2409 | GGAUCCAU CUGAUGA GCCGUUAGGC GAA ACGAUGGA | 9027 | UCCAUCGUC AUGGAUCC | 1885 |
| 2416 | UUCAUCUG CUGAUGA GCCGUUAGGC GAA AUCCAUGA | 9028 | UCAUGGAUC CAGAUGAA | 1886 |

| | | | | |
|---|---|---|---|---|
| 2427 | UCCAAUGG CUGAUGA GCCGUUAGGC GAA AGUUCAUC | 9029 | GAUGAACUC CCAUUGGA | 1887 |
| 2432 | GUUCAUCC CUGAUGA GCCGUUAGGC GAA AUGGGAGU | 9030 | ACUCCCAUU GGAUGAAC | 1888 |
| 2443 | UCGUUCAC CUGAUGA GCCGUUAGGC GAA AUGUUCAU | 9031 | AUGAACAUU GUGAACGA | 1889 |
| 2458 | GGCAUCAU CUGAUGA GCCGUUAGGC GAA AGGCAGUC | 9032 | GACUGCCUU AUGAUGCC | 1890 |
| 2459 | UGGCAUCA CUGAUGA GCCGUUAGGC GAA AAGGCAGU | 9033 | ACUGCCUUA UGAUGCCA | 1891 |
| 2480 | CUCUGGGG CUGAUGA GCCGUUAGGC GAA AUUCCCAU | 9034 | AUGGGAAUU CCCCAGAG | 1892 |
| 2481 | UCUCUGGG CUGAUGA GCCGUUAGGC GAA AAUUCCCA | 9035 | UGGGAAUUC CCCAGAGA | 1893 |
| 2502 | GGCUUACC CUGAUGA GCCGUUAGGC GAA AGGUUCAG | 9036 | CUGAACCUA GGUAAGCC | 1894 |
| 2506 | AAGAGGCU CUGAUGA GCCGUUAGGC GAA ACCUAGGU | 9037 | ACCUAGGUA AGCCUCUU | 1895 |
| 2512 | ACGGCCAA CUGAUGA GCCGUUAGGC GAA AGGCUUAC | 9038 | GUAAGCCUC UUGGCCGU | 1896 |
| 2514 | CCACGGCC CUGAUGA GCCGUUAGGC GAA AGAGGCUU | 9039 | AAGCCUCUU GGCCGUGG | 1897 |
| 2528 | CUUGGCCA CUGAUGA GCCGUUAGGC GAA AGGCACCA | 9040 | UGGUGCCUU UGGCCAAG | 1898 |
| 2529 | UCUUGGCC CUGAUGA GCCGUUAGGC GAA AAGGCACC | 9041 | GGUGCCUUU GGCCAAGA | 1899 |
| 2541 | UCUGCUUC CUGAUGA GCCGUUAGGC GAA AUCUCUUG | 9042 | CAAGAGAUU GAAGCAGA | 1900 |
| 2555 | CAAUUCCA CUGAUGA GCCGUUAGGC GAA AGGCAUCU | 9043 | AGAUGCCUU UGGAAUUG | 1901 |
| 2556 | UCAAUUCC CUGAUGA GCCGUUAGGC GAA AAGGCAUC | 9044 | GAUGCCUUU GGAAUUGA | 1902 |
| 2562 | GUCUUGUC CUGAUGA GCCGUUAGGC GAA AUUCCAAA | 9045 | UUUGGAAUU GACAAGAC | 1903 |
| 2578 | UGUCCUGC CUGAUGA GCCGUUAGGC GAA AGUUGCUG | 9046 | CAGCAACUU GCAGGACA | 1904 |
| 2589 | UUGACUGC CUGAUGA GCCGUUAGGC GAA ACUGUCCU | 9047 | AGGACAGUA GCAGUCAA | 1905 |
| 2595 | AACAUUUU CUGAUGA GCCGUUAGGC GAA ACUGCUAC | 9048 | GUAGCAGUC AAAAUGUU | 1906 |
| 2603 | CUUCUUUC CUGAUGA GCCGUUAGGC GAA ACAUUUUG | 9049 | CAAAAUGUU GAAAGAAG | 1907 |
| 2632 | GAGAGCUC CUGAUGA GCCGUUAGGC GAA AUGCUCAC | 9050 | GUGAGCAUC GAGCUCUC | 1908 |
| 2638 | AGACAUGA CUGAUGA GCCGUUAGGC GAA AGCUCGAU | 9051 | AUCGAGCUC UCAUGUCU | 1909 |
| 2640 | UCAGACAU CUGAUGA GCCGUUAGGC GAA AGAGCUCG | 9052 | CGAGCUCUC AUGUCUGA | 1910 |
| 2645 | UGAGUUCA CUGAUGA GCCGUUAGGC GAA ACAUGAGA | 9053 | UCUCAUGUC UGAACUCA | 1911 |
| 2652 | AGGAUCUU CUGAUGA GCCGUUAGGC GAA AGUUCAGA | 9054 | UCUGAACUC AAGAUCCU | 1912 |
| 2658 | UGAAUGAG CUGAUGA GCCGUUAGGC GAA AUCUUGAG | 9055 | CUCAAGAUC CUCAUUCA | 1913 |
| 2661 | AUAUGAAU CUGAUGA GCCGUUAGGC GAA AGGAUCUU | 9056 | AAGAUCCUC AUUCAUAU | 1914 |
| 2664 | CCAAUAUG CUGAUGA GCCGUUAGGC GAA AUGAGGAU | 9057 | AUCCUCAUU CAUAUUGG | 1915 |
| 2665 | ACCAAUAU CUGAUGA GCCGUUAGGC GAA AAUGAGGA | 9058 | UCCUCAUUC AUAUUGGU | 1916 |
| 2668 | GUGACCAA CUGAUGA GCCGUUAGGC GAA AUGAAUGA | 9059 | UCAUUCAUA UUGGUCAC | 1917 |
| 2670 | UGGUGACC CUGAUGA GCCGUUAGGC GAA AUAUGAAU | 9060 | AUUCAUAUU GGUCACCA | 1918 |
| 2674 | GAGAUGGU CUGAUGA GCCGUUAGGC GAA ACCAAUAU | 9061 | AUAUUGGUC ACCAUCUC | 1919 |
| 2680 | CACAUUGA CUGAUGA GCCGUUAGGC GAA AUGGUGAC | 9062 | GUCACCAUC UCAAUGUG | 1920 |
| 2682 | ACCACAUU CUGAUGA GCCGUUAGGC GAA AGAUGGUG | 9063 | CACCAUCUC AAUGUGGU | 1921 |

132

| | | | | |
|---|---|---|---|---|
| 2691 | AGAAGGUU CUGAUGA GCCGUUAGGC GAA ACCACAUU | 9064 | AAUGUGGUC AACCUUCU | 1922 |
| 2697 | GCACCUAG CUGAUGA GCCGUUAGGC GAA AGGUUGAC | 9065 | GUCAACCUU CUAGGUGC | 1923 |
| 2698 | GGCACCUA CUGAUGA GCCGUUAGGC GAA AAGGUUGA | 9066 | UCAACCUUC UAGGUGCC | 1924 |
| 2700 | CAGGCACC CUGAUGA GCCGUUAGGC GAA AGAAGGUU | 9067 | AACCUUCUA GGUGCCUG | 1925 |
| 2710 | UGGCUUGG CUGAUGA GCCGUUAGGC GAA ACAGGCAC | 9068 | GUGCCUGUA CCAAGCCA | 1926 |
| 2730 | AUCACCAU CUGAUGA GCCGUUAGGC GAA AGUGGCCC | 9069 | GGGCCACUC AUGGUGAU | 1927 |
| 2739 | AAUUCCAC CUGAUGA GCCGUUAGGC GAA AUCACCAU | 9070 | AUGGUGAUU GUGGAAUU | 1928 |
| 2747 | AUUUGCAG CUGAUGA GCCGUUAGGC GAA AUUCCACA | 9071 | UGUGGAAUU CUGCAAAU | 1929 |
| 2748 | AAUUUGCA CUGAUGA GCCGUUAGGC GAA AAUUCCAC | 9072 | GUGGAAUUC UGCAAAUU | 1930 |
| 2756 | GGUUUCCA CUGAUGA GCCGUUAGGC GAA AUUUGCAG | 9073 | CUGCAAAUU UGGAAACC | 1931 |
| 2757 | AGGUUUCC CUGAUGA GCCGUUAGGC GAA AAUUUGCA | 9074 | UGCAAAUUU GGAAACCU | 1932 |
| 2768 | GGUAAGUG CUGAUGA GCCGUUAGGC GAA ACAGGUUU | 9075 | AAACCUGUC CACUUACC | 1933 |
| 2773 | CCUCAGGU CUGAUGA GCCGUUAGGC GAA AGUGGACA | 9076 | UGUCCACUU ACCUGAGG | 1934 |
| 2774 | UCCUCAGG CUGAUGA GCCGUUAGGC GAA AAGUGGAC | 9077 | GUCCACUUA CCUGAGGA | 1935 |
| 2798 | AGGGGACA CUGAUGA GCCGUUAGGC GAA AUUCAUUU | 9078 | AAAUGAAUU UGUCCCCU | 1936 |
| 2799 | UAGGGGAC CUGAUGA GCCGUUAGGC GAA AAUUCAUU | 9079 | AAUGAAUUU GUCCCCUA | 1937 |
| 2802 | UUGUAGGG CUGAUGA GCCGUUAGGC GAA ACAAAUUC | 9080 | GAAUUUGUC CCCUACAA | 1938 |
| 2807 | UGGUCUUG CUGAUGA GCCGUUAGGC GAA AGGGGACA | 9081 | UGUCCCCUA CAAGACCA | 1939 |
| 2828 | CUUGACGG CUGAUGA GCCGUUAGGC GAA AUCGUGCC | 9082 | GGCACGAUU CCGUCAAG | 1940 |
| 2829 | CCUUGACG CUGAUGA GCCGUUAGGC GAA AAUCGUGC | 9083 | GCACGAUUC CGUCAAGG | 1941 |
| 2833 | UUUCCCUU CUGAUGA GCCGUUAGGC GAA ACGGAAUC | 9084 | GAUUCCGUC AAGGGAAA | 1942 |
| 2846 | CUCCAACG CUGAUGA GCCGUUAGGC GAA AGUCUUUC | 9085 | GAAAGACUA CGUUGGAG | 1943 |
| 2850 | AUUGCUCC CUGAUGA GCCGUUAGGC GAA ACGUAGUC | 9086 | GACUACGUU GGAGCAAU | 1944 |
| 2859 | UCCACAGG CUGAUGA GCCGUUAGGC GAA AUUGCUCC | 9087 | GGAGCAAUC CCUGUGGA | 1945 |
| 2869 | CCGUUUCA CUGAUGA GCCGUUAGGC GAA AUCCACAG | 9088 | CUGUGGAUC UGAAACGG | 1946 |
| 2882 | UGCUGUCC CUGAUGA GCCGUUAGGC GAA AGCGCCGU | 9089 | ACGGCGCUU GGACAGCA | 1947 |
| 2892 | CUACUGGU CUGAUGA GCCGUUAGGC GAA AUGCUGUC | 9090 | GACAGCAUC ACCAGUAG | 1948 |
| 2899 | GCUCUGGC CUGAUGA GCCGUUAGGC GAA ACUGGUGA | 9091 | UCACCAGUA GCCAGAGC | 1949 |
| 2909 | AGCUGGCU CUGAUGA GCCGUUAGGC GAA AGCUCUGG | 9092 | CCAGAGCUC AGCCAGCU | 1950 |
| 2918 | CAAAUCCA CUGAUGA GCCGUUAGGC GAA AGCUGGCU | 9093 | AGCCAGCUC UGGAUUUG | 1951 |
| 2924 | CCUCCACA CUGAUGA GCCGUUAGGC GAA AUCCAGAG | 9094 | CUCUGGAUU UGUGGAGG | 1952 |
| 2925 | UCCUCCAC CUGAUGA GCCGUUAGGC GAA AAUCCAGA | 9095 | UCUGGAUUU GUGGAGGA | 1953 |
| 2939 | CACUGAGG CUGAUGA GCCGUUAGGC GAA ACUUCUCC | 9096 | GGAGAAGUC CCUCAGUG | 1954 |
| 2943 | ACAUCACU CUGAUGA GCCGUUAGGC GAA AGGGACUU | 9097 | AAGUCCCUC AGUGAUGU | 1955 |
| 2952 | UCUUCUUC CUGAUGA GCCGUUAGGC GAA ACAUCACU | 9098 | AGUGAUGUA GAAGAAGA | 1956 |

| | | | | |
|---|---|---|---|---|
| 2968 | AUCUUCAG CUGAUGA GCCGUUAGGC GAA AGCUUCCU | 9099 | AGGAAGCUC CUGAAGAU | 1957 |
| 2977 | CUUAUACA CUGAUGA GCCGUUAGGC GAA AUCUUCAG | 9100 | CUGAAGAUC UGUAUAAG | 1958 |
| 2981 | AGUCCUUA CUGAUGA GCCGUUAGGC GAA ACAGAUCU | 9101 | AGAUCUGUA UAAGGACU | 1959 |
| 2983 | GAAGUCCU CUGAUGA GCCGUUAGGC GAA AUACAGAU | 9102 | AUCUGUAUA AGGACUUC | 1960 |
| 2990 | AGGUCAGG CUGAUGA GCCGUUAGGC GAA AGUCCUUA | 9103 | UAAGGACUU CCUGACCU | 1961 |
| 2991 | AAGGUCAG CUGAUGA GCCGUUAGGC GAA AAGUCCUU | 9104 | AAGGACUUC CUGACCUU | 1962 |
| 2999 | GAUGCUCC CUGAUGA GCCGUUAGGC GAA AGGUCAGG | 9105 | CCUGACCUU GGAGCAUC | 1963 |
| 3007 | ACAGAUGA CUGAUGA GCCGUUAGGC GAA AUGCUCCA | 9106 | UGGAGCAUC UCAUCUGU | 1964 |
| 3009 | UAACAGAU CUGAUGA GCCGUUAGGC GAA AGAUGCUC | 9107 | GAGCAUCUC AUCUGUUA | 1965 |
| 3012 | CUGUAACA CUGAUGA GCCGUUAGGC GAA AUGAGAUG | 9108 | CAUCUCAUC UGUUACAG | 1966 |
| 3016 | GAAGCUGU CUGAUGA GCCGUUAGGC GAA ACAGAUGA | 9109 | UCAUCUGUU ACAGCUUC | 1967 |
| 3017 | GGAAGCUG CUGAUGA GCCGUUAGGC GAA AACAGAUG | 9110 | CAUCUGUUA CAGCUUCC | 1968 |
| 3023 | CCACUUGG CUGAUGA GCCGUUAGGC GAA AGCUGUAA | 9111 | UUACAGCUU CCAAGUGG | 1969 |
| 3024 | GCCACUUG CUGAUGA GCCGUUAGGC GAA AAGCUGUA | 9112 | UACAGCUUC CAAGUGGC | 1970 |
| 3034 | CAUGCCCU CUGAUGA GCCGUUAGGC GAA AGCCACUU | 9113 | AAGUGGCUA AGGGCAUG | 1971 |
| 3047 | AUGCCAAG CUGAUGA GCCGUUAGGC GAA ACUCCAUG | 9114 | CAUGGAGUU CUUGGCAU | 1972 |
| 3048 | GAUGCCAA CUGAUGA GCCGUUAGGC GAA AACUCCAU | 9115 | AUGGAGUUC UUGGCAUC | 1973 |
| 3050 | GCGAUGCC CUGAUGA GCCGUUAGGC GAA AGAACUCC | 9116 | GGAGUUCUU GGCAUCGC | 1974 |
| 3056 | ACUUUCGC CUGAUGA GCCGUUAGGC GAA AUGCCAAG | 9117 | CUUGGCAUC GCGAAAGU | 1975 |
| 3067 | CCUGUGGA CUGAUGA GCCGUUAGGC GAA ACACUUUC | 9118 | GAAAGUGUA UCCACAGG | 1976 |
| 3069 | UCCCUGUG CUGAUGA GCCGUUAGGC GAA AUACACUU | 9119 | AAGUGUAUC CACAGGGA | 1977 |
| 3094 | UAAGAGGA CUGAUGA GCCGUUAGGC GAA AUUUCGUG | 9120 | CACGAAAUA UCCUCUUA | 1978 |
| 3096 | GAUAAGAG CUGAUGA GCCGUUAGGC GAA AUAUUUCG | 9121 | CGAAAUAUC CUCUUAUC | 1979 |
| 3099 | UCCGAUAA CUGAUGA GCCGUUAGGC GAA AGGAUAUU | 9122 | AAUAUCCUC UUAUCGGA | 1980 |
| 3101 | UCUCCGAU CUGAUGA GCCGUUAGGC GAA AGAGGAUA | 9123 | UAUCCUCUU AUCGGAGA | 1981 |
| 3102 | UUCUCCGA CUGAUGA GCCGUUAGGC GAA AAGAGGAU | 9124 | AUCCUCUUA UCGGAGAA | 1982 |
| 3104 | UCUUCUCC CUGAUGA GCCGUUAGGC GAA AUAAGAGG | 9125 | CCUCUUAUC GGAGAAGA | 1983 |
| 3120 | CAGAUUUU CUGAUGA GCCGUUAGGC GAA ACCACGUU | 9126 | AACGUGGUU AAAAUCUG | 1984 |
| 3121 | ACAGAUUU CUGAUGA GCCGUUAGGC GAA AACCACGU | 9127 | ACGUGGUUA AAAUCUGU | 1985 |
| 3126 | AAGUCACA CUGAUGA GCCGUUAGGC GAA AUUUUAAC | 9128 | GUUAAAAUC UGUGACUU | 1986 |
| 3134 | CCAAGCCA CUGAUGA GCCGUUAGGC GAA AGUCACAG | 9129 | CUGUGACUU UGGCUUGG | 1987 |
| 3135 | GCCAAGCC CUGAUGA GCCGUUAGGC GAA AAGUCACA | 9130 | UGUGACUUU GGCUUGGC | 1988 |
| 3140 | CCCGGGCC CUGAUGA GCCGUUAGGC GAA AGCCAAAG | 9131 | CUUUGGCUU GGCCCGGG | 1989 |
| 3151 | UUUAUAAA CUGAUGA GCCGUUAGGC GAA AUCCCGGG | 9132 | CCCGGGAUA UUUAUAAA | 1990 |
| 3153 | UCUUUAUA CUGAUGA GCCGUUAGGC GAA AUAUCCCG | 9133 | CGGGAUAUU UAUAAAGA | 1991 |

134

| | | | | |
|---|---|---|---|---|
| 3154 | AUCUUUAU CUGAUGA GCCGUUAGGC GAA AAUAUCCC | 9134 | GGGAUAUUU AUAAAGAU | 1992 |
| 3155 | GAUCUUUA CUGAUGA GCCGUUAGGC GAA AAAUAUCC | 9135 | GGAUAUUUA UAAAGAUC | 1993 |
| 3157 | UGGAUCUU CUGAUGA GCCGUUAGGC GAA AUAAAUAU | 9136 | AUAUUUAUA AAGAUCCA | 1994 |
| 3163 | AUAAUCUG CUGAUGA GCCGUUAGGC GAA AUCUUUAU | 9137 | AUAAAGAUC CAGAUUAU | 1995 |
| 3169 | UCUGACAU CUGAUGA GCCGUUAGGC GAA AUCUGGAU | 9138 | AUCCAGAUU AUGUCAGA | 1996 |
| 3170 | UUCUGACA CUGAUGA GCCGUUAGGC GAA AAUCUGGA | 9139 | UCCAGAUUA UGUCAGAA | 1997 |
| 3174 | CCUUUUCU CUGAUGA GCCGUUAGGC GAA ACAUAAUC | 9140 | GAUUAUGUC AGAAAAGG | 1998 |
| 3190 | AGGGAGGC CUGAUGA GCCGUUAGGC GAA AGCAUCUC | 9141 | GAGAUGCUC GCCUCCCU | 1999 |
| 3195 | UUCAAAGG CUGAUGA GCCGUUAGGC GAA AGGCGAGC | 9142 | GCUCGCCUC CCUUUGAA | 2000 |
| 3199 | CCAUUUCA CUGAUGA GCCGUUAGGC GAA AGGGAGGC | 9143 | GCCUCCCUU UGAAAUGG | 2001 |
| 3200 | UCCAUUUC CUGAUGA GCCGUUAGGC GAA AAGGGAGG | 9144 | CCUCCCUUU GAAAUGGA | 2002 |
| 3225 | CUGUCAAA CUGAUGA GCCGUUAGGC GAA AUUGUUUC | 9145 | GAAACAAUU UUUGACAG | 2003 |
| 3226 | UCUGUCAA CUGAUGA GCCGUUAGGC GAA AAUUGUUU | 9146 | AAACAAUUU UUGACAGA | 2004 |
| 3227 | CUCUGUCA CUGAUGA GCCGUUAGGC GAA AAAUUGUU | 9147 | AACAAUUUU UGACAGAG | 2005 |
| 3228 | ACUCUGUC CUGAUGA GCCGUUAGGC GAA AAAAUUGU | 9148 | ACAAUUUUU GACAGAGU | 2006 |
| 3239 | GGAUUGUG CUGAUGA GCCGUUAGGC GAA ACACUCUG | 9149 | CAGAGUGUA CACAAUCC | 2007 |
| 3246 | UCACUCUG CUGAUGA GCCGUUAGGC GAA AUUGUGUA | 9150 | UACACAAUC CAGAGUGA | 2008 |
| 3258 | AAAGACCA CUGAUGA GCCGUUAGGC GAA ACGUCACU | 9151 | AGUGACGUC UGGUCUUU | 2009 |
| 3263 | CACCAAAA CUGAUGA GCCGUUAGGC GAA ACCAGACG | 9152 | CGUCUGGUC UUUUGGUG | 2010 |
| 3265 | AACACCAA CUGAUGA GCCGUUAGGC GAA AGACCAGA | 9153 | UCUGGUCUU UUGGUGUU | 2011 |
| 3266 | AAACACCA CUGAUGA GCCGUUAGGC GAA AAGACCAG | 9154 | CUGGUCUUU UGGUGUUU | 2012 |
| 3267 | AAAACACC CUGAUGA GCCGUUAGGC GAA AAAGACCA | 9155 | UGGUCUUUU GGUGUUUU | 2013 |
| 3273 | CACAGCAA CUGAUGA GCCGUUAGGC GAA ACACCAAA | 9156 | UUUGGUGUU UUGCUGUG | 2014 |
| 3274 | CCACAGCA CUGAUGA GCCGUUAGGC GAA AACACCAA | 9157 | UUGGUGUUU UGCUGUGG | 2015 |
| 3275 | CCCACAGC CUGAUGA GCCGUUAGGC GAA AAACACCA | 9158 | UGGUGUUUU GCUGUGGG | 2016 |
| 3288 | AAGGAAAA CUGAUGA GCCGUUAGGC GAA AUUUCCCA | 9159 | UGGGAAAUA UUUUCCUU | 2017 |
| 3290 | CUAAGGAA CUGAUGA GCCGUUAGGC GAA AUAUUUCC | 9160 | GGAAAUAUU UUCCUUAG | 2018 |
| 3291 | CCUAAGGA CUGAUGA GCCGUUAGGC GAA AAUAUUUC | 9161 | GAAAUAUUU UCCUUAGG | 2019 |
| 3292 | ACCUAAGG CUGAUGA GCCGUUAGGC GAA AAAUAUUU | 9162 | AAAUAUUUU CCUUAGGU | 2020 |
| 3293 | CACCUAAG CUGAUGA GCCGUUAGGC GAA AAAAUAUU | 9163 | AAUAUUUUC CUUAGGUG | 2021 |
| 3296 | AAGCACCU CUGAUGA GCCGUUAGGC GAA AGGAAAAU | 9164 | AUUUUCCUU AGGUGCUU | 2022 |
| 3297 | GAAGCACC CUGAUGA GCCGUUAGGC GAA AAGGAAAA | 9165 | UUUUCCUUA GGUGCUUC | 2023 |
| 3304 | AUAUGGAG CUGAUGA GCCGUUAGGC GAA AGCACCUA | 9166 | UAGGUGCUU CUCCAUAU | 2024 |
| 3305 | GAUAUGGA CUGAUGA GCCGUUAGGC GAA AAGCACCU | 9167 | AGGUGCUUC UCCAUAUC | 2025 |
| 3307 | AGGAUAUG CUGAUGA GCCGUUAGGC GAA AGAAGCAC | 9168 | GUGCUUCUC CAUAUCCU | 2026 |

135

| | | | | |
|---|---|---|---|---|
| 3311 | CCCCAGGA CUGAUGA GCCGUUAGGC GAA AUGGAGAA | 9169 | UUCUCCAUA UCCUGGGG | 2027 |
| 3313 | UACCCCAG CUGAUGA GCCGUUAGGC GAA AUAUGGAG | 9170 | CUCCAUAUC CUGGGGUA | 2028 |
| 3321 | UCAAUCUU CUGAUGA GCCGUUAGGC GAA ACCCCAGG | 9171 | CCUGGGGUA AAGAUUGA | 2029 |
| 3327 | UCUUCAUC CUGAUGA GCCGUUAGGC GAA AUCUUUAC | 9172 | GUAAAGAUU GAUGAAGA | 2030 |
| 3338 | GCCUACAA CUGAUGA GCCGUUAGGC GAA AUUCUUCA | 9173 | UGAAGAAUU UUGUAGGC | 2031 |
| 3339 | CGCCUACA CUGAUGA GCCGUUAGGC GAA AAUUCUUC | 9174 | GAAGAAUUU UGUAGGCG | 2032 |
| 3340 | UCGCCUAC CUGAUGA GCCGUUAGGC GAA AAAUUCUU | 9175 | AAGAAUUUU GUAGGCGA | 2033 |
| 3343 | CAAUCGCC CUGAUGA GCCGUUAGGC GAA ACAAAAUU | 9176 | AAUUUUGUA GGCGAUUG | 2034 |
| 3350 | CUUCUUUC CUGAUGA GCCGUUAGGC GAA AUCGCCUA | 9177 | UAGGCGAUU GAAAGAAG | 2035 |
| 3364 | CCUCAUUC CUGAUGA GCCGUUAGGC GAA AGUUCCUU | 9178 | AAGGAACUA GAAUGAGG | 2036 |
| 3382 | UGUAGUAU CUGAUGA GCCGUUAGGC GAA AUCAGGGG | 9179 | CCCCUGAUU AUACUACA | 2037 |
| 3383 | GUGUAGUA CUGAUGA GCCGUUAGGC GAA AAUCAGGG | 9180 | CCCUGAUUA UACUACAC | 2038 |
| 3385 | UGGUGUAG CUGAUGA GCCGUUAGGC GAA AUAAUCAG | 9181 | CUGAUUAUA CUACACCA | 2039 |
| 3388 | UUCUGGUG CUGAUGA GCCGUUAGGC GAA AGUAUAAU | 9182 | AUUAUACUA CACCAGAA | 2040 |
| 3401 | UGGUCUGG CUGAUGA GCCGUUAGGC GAA ACAUUUCU | 9183 | AGAAAUGUA CCAGACCA | 2041 |
| 3439 | GGGUCUCU CUGAUGA GCCGUUAGGC GAA ACUGGGCU | 9184 | AGCCCAGUC AGAGACCC | 2042 |
| 3452 | ACUCUGAA CUGAUGA GCCGUUAGGC GAA ACGUGGGU | 9185 | ACCCACGUU UUCAGAGU | 2043 |
| 3453 | AACUCUGA CUGAUGA GCCGUUAGGC GAA AACGUGGG | 9186 | CCCACGUUU UCAGAGUU | 2044 |
| 3454 | CAACUCUG CUGAUGA GCCGUUAGGC GAA AAACGUGG | 9187 | CCACGUUUU CAGAGUUG | 2045 |
| 3455 | CCAACUCU CUGAUGA GCCGUUAGGC GAA AAAACGUG | 9188 | CACGUUUUC AGAGUUGG | 2046 |
| 3461 | GUUCCACC CUGAUGA GCCGUUAGGC GAA ACUCUGAA | 9189 | UUCAGAGUU GGUGGAAC | 2047 |
| 3472 | AUUUCCCA CUGAUGA GCCGUUAGGC GAA AUGUUCCA | 9190 | UGGAACAUU UGGGAAAU | 2048 |
| 3473 | GAUUUCCC CUGAUGA GCCGUUAGGC GAA AAUGUUCC | 9191 | GGAACAUUU GGGAAAUC | 2049 |
| 3481 | UUGCAAGA CUGAUGA GCCGUUAGGC GAA AUUUCCCA | 9192 | UGGGAAAUC UCUUGCAA | 2050 |
| 3483 | GCUUGCAA CUGAUGA GCCGUUAGGC GAA AGAUUUCC | 9193 | GGAAAUCUC UUGCAAGC | 2051 |
| 3485 | UAGCUUGC CUGAUGA GCCGUUAGGC GAA AGAGAUUU | 9194 | AAAUCUCUU GCAAGCUA | 2052 |
| 3493 | CUGAGCAU CUGAUGA GCCGUUAGGC GAA AGCUUGCA | 9195 | UGCAAGCUA AUGCUCAG | 2053 |
| 3499 | AUCCUGCU CUGAUGA GCCGUUAGGC GAA AGCAUUAG | 9196 | CUAAUGCUC AGCAGGAU | 2054 |
| 3518 | GAACAAUG CUGAUGA GCCGUUAGGC GAA AGUCUUUG | 9197 | CAAAGACUA CAUUGUUC | 2055 |
| 3522 | GGAAGAAC CUGAUGA GCCGUUAGGC GAA AUGUAGUC | 9198 | GACUACAUU GUUCUUCC | 2056 |
| 3525 | AUCGGAAG CUGAUGA GCCGUUAGGC GAA ACAAUGUA | 9199 | UACAUUGUU CUUCCGAU | 2057 |
| 3526 | UAUCGGAA CUGAUGA GCCGUUAGGC GAA AACAAUGU | 9200 | ACAUUGUUC UUCCGAUA | 2058 |
| 3528 | GAUAUCGG CUGAUGA GCCGUUAGGC GAA AGAACAAU | 9201 | AUUGUUCUU CCGAUAUC | 2059 |
| 3529 | UGAUAUCG CUGAUGA GCCGUUAGGC GAA AAGAACAA | 9202 | UUGUUCUUC CGAUAUCA | 2060 |
| 3534 | GUCUCUGA CUGAUGA GCCGUUAGGC GAA AUCGGAAG | 9203 | CUUCCGAUA UCAGAGAC | 2061 |

136

| | | | | |
|---|---|---|---|---|
| 3536 | AAGUCUCU CUGAUGA GCCGUUAGGC GAA AUAUCGGA | 9204 | UCCGAUAUC AGAGACUU | 2062 |
| 3544 | CAUGCUCA CUGAUGA GCCGUUAGGC GAA AGUCUCUG | 9205 | CAGAGACUU UGAGCAUG | 2063 |
| 3545 | CCAUGCUC CUGAUGA GCCGUUAGGC GAA AAGUCUCU | 9206 | AGAGACUUU GAGCAUGG | 2064 |
| 3562 | GAGUCCAG CUGAUGA GCCGUUAGGC GAA AUCCUCUU | 9207 | AAGAGGAUU CUGGACUC | 2065 |
| 3563 | AGAGUCCA CUGAUGA GCCGUUAGGC GAA AAUCCUCU | 9208 | AGAGGAUUC UGGACUCU | 2066 |
| 3570 | GGCAGAGA CUGAUGA GCCGUUAGGC GAA AGUCCAGA | 9209 | UCUGGACUC UCUCUGCC | 2067 |
| 3572 | UAGGCAGA CUGAUGA GCCGUUAGGC GAA AGAGUCCA | 9210 | UGGACUCUC UCUGCCUA | 2068 |
| 3574 | GGUAGGCA CUGAUGA GCCGUUAGGC GAA AGAGAGUC | 9211 | GACUCUCUC UGCCUACC | 2069 |
| 3580 | AGGUGAGG CUGAUGA GCCGUUAGGC GAA AGGCAGAG | 9212 | CUCUGCCUA CCUCACCU | 2070 |
| 3584 | AAACAGGU CUGAUGA GCCGUUAGGC GAA AGGUAGGC | 9213 | GCCUACCUC ACCUGUUU | 2071 |
| 3591 | AUACAGGA CUGAUGA GCCGUUAGGC GAA ACAGGUGA | 9214 | UCACCUGUU UCCUGUAU | 2072 |
| 3592 | CAUACAGG CUGAUGA GCCGUUAGGC GAA AACAGGUG | 9215 | CACCUGUUU CCUGUAUG | 2073 |
| 3593 | CCAUACAG CUGAUGA GCCGUUAGGC GAA AAACAGGU | 9216 | ACCUGUUUC CUGUAUGG | 2074 |
| 3598 | CUCCUCCA CUGAUGA GCCGUUAGGC GAA ACAGGAAA | 9217 | UUUCCUGUA UGGAGGAG | 2075 |
| 3615 | GGGUCACA CUGAUGA GCCGUUAGGC GAA ACUUCCUC | 9218 | GAGGAAGUA UGUGACCC | 2076 |
| 3629 | CAUAAUGG CUGAUGA GCCGUUAGGC GAA AUUUGGGG | 9219 | CCCCAAAUU CCAUUAUG | 2077 |
| 3630 | UCAUAAUG CUGAUGA GCCGUUAGGC GAA AAUUUGGG | 9220 | CCCAAAUUC CAUUAUGA | 2078 |
| 3634 | GUUGUCAU CUGAUGA GCCGUUAGGC GAA AUGGAAUU | 9221 | AAUUCCAUU AUGACAAC | 2079 |
| 3635 | UGUUGUCA CUGAUGA GCCGUUAGGC GAA AAUGGAAU | 9222 | AUUCCAUUA UGACAACA | 2080 |
| 3654 | UACUGACU CUGAUGA GCCGUUAGGC GAA AUUCCUGC | 9223 | GCAGGAAUC AGUCAGUA | 2081 |
| 3658 | CAGAUACU CUGAUGA GCCGUUAGGC GAA ACUGAUUC | 9224 | GAAUCAGUC AGUAUCUG | 2082 |
| 3662 | UCUGCAGA CUGAUGA GCCGUUAGGC GAA ACUGACUG | 9225 | CAGUCAGUA UCUGCAGA | 2083 |
| 3664 | GUUCUGCA CUGAUGA GCCGUUAGGC GAA AUACUGAC | 9226 | GUCAGUAUC UGCAGAAC | 2084 |
| 3676 | CUUUCGCU CUGAUGA GCCGUUAGGC GAA ACUGUUCU | 9227 | AGAACAGUA AGCGAAAG | 2085 |
| 3702 | AAUGUUUU CUGAUGA GCCGUUAGGC GAA ACACUCAC | 9228 | GUGAGUGUA AAAACAUU | 2086 |
| 3710 | UAUCUUCA CUGAUGA GCCGUUAGGC GAA AUGUUUUU | 9229 | AAAAACAUU UGAAGAUA | 2087 |
| 3711 | AUAUCUUC CUGAUGA GCCGUUAGGC GAA AAUGUUUU | 9230 | AAAACAUUU GAAGAUAU | 2088 |
| 3718 | UAACGGGA CUGAUGA GCCGUUAGGC GAA AUCUUCAA | 9231 | UUGAAGAUA UCCCGUUA | 2089 |
| 3720 | UCUAACGG CUGAUGA GCCGUUAGGC GAA AUAUCUUC | 9232 | GAAGAUAUC CCGUUAGA | 2090 |
| 3725 | GUUCUUCU CUGAUGA GCCGUUAGGC GAA ACGGGAUA | 9233 | UAUCCCGUU AGAAGAAC | 2091 |
| 3726 | GGUUCUUC CUGAUGA GCCGUUAGGC GAA AACGGGAU | 9234 | AUCCCGUUA GAAGAACC | 2092 |
| 3741 | AUUACUUU CUGAUGA GCCGUUAGGC GAA ACUUCUGG | 9235 | CCAGAAGUA AAAGUAAU | 2093 |
| 3747 | UCUGGGAU CUGAUGA GCCGUUAGGC GAA ACUUUUAC | 9236 | GUAAAAGUA AUCCCAGA | 2094 |
| 3750 | UCAUCUGG CUGAUGA GCCGUUAGGC GAA AUUACUUU | 9237 | AAAGUAAUC CCAGAUGA | 2095 |
| 3778 | AAGAACCA CUGAUGA GCCGUUAGGC GAA ACCACUGU | 9238 | ACAGUGGUA UGGUUCUU | 2096 |

137

| | | | | |
|---|---|---|---|---|
| 3783 | GAGGCAAG CUGAUGA GCCGUUAGGC GAA ACCAUACC | 9239 | GGUAUGGUU CUUGCCUC | 2097 |
| 3784 | UGAGGCAA CUGAUGA GCCGUUAGGC GAA AACCAUAC | 9240 | GUAUGGUUC UUGCCUCA | 2098 |
| 3786 | UCUGAGGC CUGAUGA GCCGUUAGGC GAA AGAACCAU | 9241 | AUGGUUCUU GCCUCAGA | 2099 |
| 3791 | GCUCUUCU CUGAUGA GCCGUUAGGC GAA AGGCAAGA | 9242 | UCUUGCCUC AGAAGAGC | 2100 |
| 3808 | GUCUUCCA CUGAUGA GCCGUUAGGC GAA AGUUUUCA | 9243 | UGAAAACUU UGGAAGAC | 2101 |
| 3809 | UGUCUUCC CUGAUGA GCCGUUAGGC GAA AAGUUUUC | 9244 | GAAAACUUU GGAAGACA | 2102 |
| 3827 | AUGGAGAU CUGAUGA GCCGUUAGGC GAA AUUUGGUU | 9245 | AACCAAAUU AUCUCCAU | 2103 |
| 3828 | GAUGGAGA CUGAUGA GCCGUUAGGC GAA AAUUUGGU | 9246 | ACCAAAUUA UCUCCAUC | 2104 |
| 3830 | AAGAUGGA CUGAUGA GCCGUUAGGC GAA AUAAUUUG | 9247 | CAAAUUAUC UCCAUCUU | 2105 |
| 3832 | AAAAGAUG CUGAUGA GCCGUUAGGC GAA AGAUAAUU | 9248 | AAUUAUCUC CAUCUUUU | 2106 |
| 3836 | CACCAAAA CUGAUGA GCCGUUAGGC GAA AUGGAGAU | 9249 | AUCUCCAUC UUUUGGUG | 2107 |
| 3838 | UCCACCAA CUGAUGA GCCGUUAGGC GAA AGAUGGAG | 9250 | CUCCAUCUU UUGGUGGA | 2108 |
| 3839 | UUCCACCA CUGAUGA GCCGUUAGGC GAA AAGAUGGA | 9251 | UCCAUCUUU UGGUGGAA | 2109 |
| 3840 | AUUCCACC CUGAUGA GCCGUUAGGC GAA AAAGAUGG | 9252 | CCAUCUUUU GGUGGAAU | 2110 |
| 3872 | AUGCCACA CUGAUGA GCCGUUAGGC GAA ACUCCCUG | 9253 | CAGGGAGUC UGUGGCAU | 2111 |
| 3881 | AGCCUUCA CUGAUGA GCCGUUAGGC GAA AUGCCACA | 9254 | UGUGGCAUC UGAAGGCU | 2112 |
| 3890 | UCUGGUUU CUGAUGA GCCGUUAGGC GAA AGCCUUCA | 9255 | UGAAGGCUC AAACCAGA | 2113 |
| 3908 | CGGACUGG CUGAUGA GCCGUUAGGC GAA AGCCGCUU | 9256 | AAGCGGCUA CCAGUCCG | 2114 |
| 3914 | GAUAUCCG CUGAUGA GCCGUUAGGC GAA ACUGGUAG | 9257 | CUACCAGUC CGGAUAUC | 2115 |
| 3920 | CGGAGUGA CUGAUGA GCCGUUAGGC GAA AUCCGGAC | 9258 | GUCCGGAUA UCACUCCG | 2116 |
| 3922 | AUCGGAGU CUGAUGA GCCGUUAGGC GAA AUAUCCGG | 9259 | CCGGAUAUC ACUCCGAU | 2117 |
| 3926 | UGUCAUCG CUGAUGA GCCGUUAGGC GAA AGUGAUAU | 9260 | AUAUCACUC CGAUGACA | 2118 |
| 3950 | CACUGGAG CUGAUGA GCCGUUAGGC GAA ACACGGUG | 9261 | CACCGUGUA CUCCAGUG | 2119 |
| 3953 | CCUCACUG CUGAUGA GCCGUUAGGC GAA AGUACACG | 9262 | CGUGUACUC CAGUGAGG | 2120 |
| 3972 | AGCUUUAA CUGAUGA GCCGUUAGGC GAA AGUUCUGC | 9263 | GCAGAACUU UUAAAGCU | 2121 |
| 3973 | CAGCUUUA CUGAUGA GCCGUUAGGC GAA AAGUUCUG | 9264 | CAGAACUUU UAAAGCUG | 2122 |
| 3974 | UCAGCUUU CUGAUGA GCCGUUAGGC GAA AAAGUUCU | 9265 | AGAACUUUU AAAGCUGA | 2123 |
| 3975 | AUCAGCUU CUGAUGA GCCGUUAGGC GAA AAAAGUUC | 9266 | GAACUUUUA AAGCUGAU | 2124 |
| 3984 | CCAAUCUC CUGAUGA GCCGUUAGGC GAA AUCAGCUU | 9267 | AAGCUGAUA GAGAUUGG | 2125 |
| 3990 | UGCACUCC CUGAUGA GCCGUUAGGC GAA AUCUCUAU | 9268 | AUAGAGAUU GGAGUGCA | 2126 |
| 4006 | GGCUGUGC CUGAUGA GCCGUUAGGC GAA ACCGGUUU | 9269 | AAACCGGUA GCACAGCC | 2127 |
| 4020 | GGCUGGAG CUGAUGA GCCGUUAGGC GAA AUCUGGGC | 9270 | GCCCAGAUU CUCCAGCC | 2128 |
| 4021 | AGGCUGGA CUGAUGA GCCGUUAGGC GAA AAUCUGGG | 9271 | CCCAGAUUC UCCAGCCU | 2129 |
| 4023 | UCAGGCUG CUGAUGA GCCGUUAGGC GAA AGAAUCUG | 9272 | CAGAUUCUC CAGCCUGA | 2130 |
| 4052 | CAGGAGGA CUGAUGA GCCGUUAGGC GAA AGCUCAGU | 9273 | ACUGAGCUC UCCUCCUG | 2131 |

| | | | | |
|---|---|---|---|---|
| 4054 | AACAGGAG CUGAUGA GCCGUUAGGC GAA AGAGCUCA | 9274 | UGAGCUCUC CUCCUGUU | 2132 |
| 4057 | UUAAACAG CUGAUGA GCCGUUAGGC GAA AGGAGAGC | 9275 | GCUCUCCUC CUGUUUAA | 2133 |
| 4062 | UCCUUUUA CUGAUGA GCCGUUAGGC GAA ACAGGAGG | 9276 | CCUCCUGUU UAAAAGGA | 2134 |
| 4063 | UUCCUUUU CUGAUGA GCCGUUAGGC GAA AACAGGAG | 9277 | CUCCUGUUU AAAAGGAA | 2135 |
| 4064 | CUUCCUUU CUGAUGA GCCGUUAGGC GAA AAACAGGA | 9278 | UCCUGUUUA AAAGGAAG | 2136 |
| 4076 | GGGGUGUG CUGAUGA GCCGUUAGGC GAA AUGCUUCC | 9279 | GGAAGCAUC CACACCCC | 2137 |
| 4089 | AUGUCCGG CUGAUGA GCCGUUAGGC GAA AGUUGGGG | 9280 | CCCCAACUC CCGGACAU | 2138 |
| 4098 | UCUCAUGU CUGAUGA GCCGUUAGGC GAA AUGUCCGG | 9281 | CCGGACAUC ACAUGAGA | 2139 |
| 4110 | UCUGAGCA CUGAUGA GCCGUUAGGC GAA ACCUCUCA | 9282 | UGAGAGGUC UGCUCAGA | 2140 |
| 4115 | CAAAAUCU CUGAUGA GCCGUUAGGC GAA AGCAGACC | 9283 | GGUCUGCUC AGAUUUUG | 2141 |
| 4120 | CACUUCAA CUGAUGA GCCGUUAGGC GAA AUCUGAGC | 9284 | GCUCAGAUU UUGAAGUG | 2142 |
| 4121 | ACACUUCA CUGAUGA GCCGUUAGGC GAA AAUCUGAG | 9285 | CUCAGAUUU UGAAGUGU | 2143 |
| 4122 | AACACUUC CUGAUGA GCCGUUAGGC GAA AAAUCUGA | 9286 | UCAGAUUUU GAAGUGUU | 2144 |
| 4130 | GAAAGAAC CUGAUGA GCCGUUAGGC GAA ACACUUCA | 9287 | UGAAGUGUU GUUCUUUC | 2145 |
| 4133 | GUGGAAAG CUGAUGA GCCGUUAGGC GAA ACAACACU | 9288 | AGUGUUGUU CUUUCCAC | 2146 |
| 4134 | GGUGGAAA CUGAUGA GCCGUUAGGC GAA AACAACAC | 9289 | GUGUUGUUC UUUCCACC | 2147 |
| 4136 | CUGGUGGA CUGAUGA GCCGUUAGGC GAA AGAACAAC | 9290 | GUUGUUCUU UCCACCAG | 2148 |
| 4137 | GCUGGUGG CUGAUGA GCCGUUAGGC GAA AAGAACAA | 9291 | UUGUUCUUU CCACCAGC | 2149 |
| 4138 | UGCUGGUG CUGAUGA GCCGUUAGGC GAA AAAGAACA | 9292 | UGUUCUUUC CACCAGCA | 2150 |
| 4153 | AAUGCGGC CUGAUGA GCCGUUAGGC GAA ACUUCCUG | 9293 | CAGGAAGUA GCCGCAUU | 2151 |
| 4161 | GAAAAUCA CUGAUGA GCCGUUAGGC GAA AUGCGGCU | 9294 | AGCCGCAUU UGAUUUUC | 2152 |
| 4162 | UGAAAAUC CUGAUGA GCCGUUAGGC GAA AAUGCGGC | 9295 | GCCGCAUUU GAUUUUCA | 2153 |
| 4166 | GAAAUGAA CUGAUGA GCCGUUAGGC GAA AUCAAAUG | 9296 | CAUUUGAUU UUCAUUUC | 2154 |
| 4167 | CGAAAUGA CUGAUGA GCCGUUAGGC GAA AAUCAAAU | 9297 | AUUUGAUUU UCAUUUCG | 2155 |
| 4168 | UCGAAAUG CUGAUGA GCCGUUAGGC GAA AAAUCAAA | 9298 | UUUGAUUUU CAUUUCGA | 2156 |
| 4169 | GUCGAAAU CUGAUGA GCCGUUAGGC GAA AAAAUCAA | 9299 | UUGAUUUUC AUUUCGAC | 2157 |
| 4172 | GUUGUCGA CUGAUGA GCCGUUAGGC GAA AUGAAAAU | 9300 | AUUUUCAUU UCGACAAC | 2158 |
| 4173 | UGUUGUCG CUGAUGA GCCGUUAGGC GAA AAUGAAAA | 9301 | UUUUCAUUU CGACAACA | 2159 |
| 4174 | CUGUUGUC CUGAUGA GCCGUUAGGC GAA AAAUGAAA | 9302 | UUUCAUUUC GACAACAG | 2160 |
| 4194 | UGCAGUCC CUGAUGA GCCGUUAGGC GAA AGGUCCUU | 9303 | AAGGACCUC GGACUGCA | 2161 |
| 4214 | GCCUAGAA CUGAUGA GCCGUUAGGC GAA AGCUGGCU | 9304 | AGCCAGCUC UUCUAGGC | 2162 |
| 4216 | AAGCCUAG CUGAUGA GCCGUUAGGC GAA AGAGCUGG | 9305 | CCAGCUCUU CUAGGCUU | 2163 |
| 4217 | CAAGCCUA CUGAUGA GCCGUUAGGC GAA AAGAGCUG | 9306 | CAGCUCUUC UAGGCUUG | 2164 |
| 4219 | CACAAGCC CUGAUGA GCCGUUAGGC GAA AGAAGAGC | 9307 | GCUCUUCUA GGCUUGUG | 2165 |

Underlined region can be any X sequence or linker, as described herein.

139

Table V: Human KDR VEGF Receptor-Hairpin Ribozyme and Substrate Sequences 237.198

| nt. Position | Hairpin Ribozyme Sequence | Rz Seq ID No. | Substrate | Seq ID No. |
|---|---|---|---|---|
| 11 | CGACGGCC AGAA GCACCU ACCAGAGAAACACACGUUGUGGUACAUUACCUGGUA | 9308 | AGGUGCU GCU GGCCGUCG | 2166 |
| 18 | CACAGGGC AGAA GCCAGC ACCAGAGAAACACACGUUGUGGUACAUUACCUGGUA | 9309 | GCUGGCC GUC GCCCUGUG | 2167 |
| 51 | CCCACAGA AGAA GCCCGG ACCAGAGAAACACACGUUGUGGUACAUUACCUGGUA | 9310 | CCGGGCC GCC UCUGUGGG | 2168 |
| 86 | UGAGCCUG AGAA GAUCAA ACCAGAGAAACACACGUUGUGGUACAUUACCUGGUA | 9311 | UUGAUCU GCC CAGGCUCA | 2169 |
| 318 | GAGGCCAA AGAA GUUUCC ACCAGAGAAACACACGUUGUGGUACAUUACCUGGUA | 9312 | GGAAACU GAC UUGGCCUC | 2170 |
| 358 | AAAUGGAG AGAA GUAAUC ACCAGAGAAACACACGUUGUGGUACAUUACCUGGUA | 9313 | GAUUACA GAU CUCCAUUU | 2171 |
| 510 | CUGUUACC AGAA GGAACA ACCAGAGAAACACACGUUGUGGUACAUUACCUGGUA | 9314 | UGUUCCU GAU GGUAACAG | 2172 |
| 623 | ACAUAAUA AGAA GGUAAC ACCAGAGAAACACACGUUGUGGUACAUUACCUGGUA | 9315 | GUUACCA GUC UAUUAUGU | 2173 |
| 683 | UUCCAUGA AGAA GACUCA ACCAGAGAAACACACGUUGUGGUACAUUACCUGGUA | 9316 | UGAGUCC GUC UCAUGGAA | 2174 |
| 705 | UUUUCUCC AGAA GAUAGU ACCAGAGAAACACACGUUGUGGUACAUUACCUGGUA | 9317 | ACUAUCU GUU GGAGAAAA | 2175 |
| 833 | CACUCCCA AGAA GGGUUU ACCAGAGAAACACACGUUGUGGUACAUUACCUGGUA | 9318 | AAACCCA GUC UGGGAGUG | 2176 |
| 932 | UCUUGGUC AGAA GCCCAC ACCAGAGAAACACACGUUGUGGUACAUUACCUGGUA | 9319 | GUGGGCU GAU GACCAAGA | 2177 |
| 1142 | CCAUAAUC AGAA GUACAU ACCAGAGAAACACACGUUGUGGUACAUUACCUGGUA | 9320 | AUGUACU GAC GAUUAUGG | 2178 |
| 1259 | UCUCACCA AGAA GGGGUG ACCAGAGAAACACACGUUGUGGUACAUUACCUGGUA | 9321 | CACCCCA GAU UGGUGAGA | 2179 |
| 1332 | AUGGCAUA AGAA GUACAU ACCAGAGAAACACACGUUGUGGUACAUUACCUGGUA | 9322 | AUGUACG GUC UAUGCCAU | 2180 |
| 1376 | CUUCCUCC AGAA GCCAAU ACCAGAGAAACACACGUUGUGGUACAUUACCUGGUA | 9323 | AUUGGCA GUU GGAGGAAG | 2181 |
| 1413 | GUCACUGA AGAA GCUUGG ACCAGAGAAACACACGUUGUGGUACAUUACCUGGUA | 9324 | CCAAGCU GUC UCAGUGAC | 2182 |
| 1569 | UUGUACAA AGAA GACACA ACCAGAGAAACACACGUUGUGGUACAUUACCUGGUA | 9325 | UGUGUCA GCU UUGUACAA | 2183 |
| 1673 | GCUCAGUG AGAA GCAUGU ACCAGAGAAACACACGUUGUGGUACAUUACCUGGUA | 9326 | ACAUGCA GCC CACUGAGC | 2184 |
| 1717 | AAACGUAG AGAA GUCUGC ACCAGAGAAACACACGUUGUGGUACAUUACCUGGUA | 9327 | GCAGACA GAU CUACGUUU | 2185 |
| 1760 | UUGGCAGA AGAA GUGGGC ACCAGAGAAACACACGUUGUGGUACAUUACCUGGUA | 9328 | GCCCACA GCC UCUGCCAA | 2186 |
| 1797 | UUCUUGCA AGAA GGUGUG ACCAGAGAAACACACGUUGUGGUACAUUACCUGGUA | 9329 | CACACCU GUU UGCAAGAA | 2187 |
| 1918 | UUGAGCAA AGAA GACAUA ACCAGAGAAACACACGUUGUGGUACAUUACCUGGUA | 9330 | UAUGUCU GCC UUGCUCAA | 2188 |
| 1967 | GGACUGUG AGAA GCCUGA ACCAGAGAAACACACGUUGUGGUACAUUACCUGGUA | 9331 | UCAGGCA GCU CACAGUCC | 2189 |
| 1974 | CGCUCUAG AGAA GUGAGC ACCAGAGAAACACACGUUGUGGUACAUUACCUGGUA | 9332 | GCUCACA GUC CUAGAGCG | 2190 |
| 2021 | UACUUGUC AGAA GAUUCU ACCAGAGAAACACACGUUGUGGUACAUUACCUGGUA | 9333 | AGAAUCA GAC GACAAGUA | 2191 |
| 2084 | ACCACAUG AGAA GUGGAG ACCAGAGAAACACACGUUGUGGUACAUUACCUGGUA | 9334 | CUCCACA GAU CAUGUGGU | 2192 |
| 2418 | GGGAGUUC AGAA GGAUCC ACCAGAGAAACACACGUUGUGGUACAUUACCUGGUA | 9335 | GGAUCCA GAU GAACUCCC | 2193 |
| 2453 | CAUCAUAA AGAA GUCGUU ACCAGAGAAACACACGUUGUGGUACAUUACCUGGUA | 9336 | AACGACU GCC UUAUGAUG | 2194 |
| 2492 | CUAGGUUC AGAA GGUCUC ACCAGAGAAACACACGUUGUGGUACAUUACCUGGUA | 9337 | GAGACCG GCU GAACCUAG | 2195 |
| 2547 | CCAAAGGC AGAA GCUUCA ACCAGAGAAACACACGUUGUGGUACAUUACCUGGUA | 9338 | UGAAGCA GAU GCCUUUGG | 2196 |

| | | | | |
|---|---|---|---|---|
| 2765 | GGUAAGUG AGAA GGUUUC ACCAGAGAAACACACGUUGUGGUACAUUACCUGGUA | 9339 | GAAACCU GUC CACUUACC | 2197 |
| 2914 | AAAUCCAG AGAA GGCUGA ACCAGAGAAACACACGUUGUGGUACAUUACCUGGUA | 9340 | UCAGCCA GCU CUGGAUUU | 2198 |
| 2993 | GCUCCAAG AGAA GGAAGU ACCAGAGAAACACACGUUGUGGUACAUUACCUGGUA | 9341 | ACUUCCU GAC CUUGGAGC | 2199 |
| 3019 | CACUUGGA AGAA GUAACA ACCAGAGAAACACACGUUGUGGUACAUUACCUGGUA | 9342 | UGUUACA GCU UCCAAGUG | 2200 |
| 3165 | CUGACAUA AGAA GGAUCU ACCAGAGAAACACACGUUGUGGUACAUUACCUGGUA | 9343 | AGAUCCA GAU UAUGUCAG | 2201 |
| 3378 | GUAGUAUA AGAA GGGGCC ACCAGAGAAACACACGUUGUGGUACAUUACCUGGUA | 9344 | GGCCCCU GAU UAUACUAC | 2202 |
| 3404 | CCAGCAUG AGAA GGUACA ACCAGAGAAACACACGUUGUGGUACAUUACCUGGUA | 9345 | UGUACCA GAC CAUGCUGG | 2203 |
| 3418 | CCCGUGCC AGAA GUCCAG ACCAGAGAAACACACGUUGUGGUACAUUACCUGGUA | 9346 | CUGGACU GCU GGCACGGG | 2204 |
| 3575 | GUGAGGUA AGAA GAGAGA ACCAGAGAAACACACGUUGUGGUACAUUACCUGGUA | 9347 | UCUCUCU GCC UACCUCAC | 2205 |
| 3588 | AUACAGGA AGAA GGUGAG ACCAGAGAAACACACGUUGUGGUACAUUACCUGGUA | 9348 | CUCACCU GUU UCCUGUAU | 2206 |
| 3689 | CACUCACA AGAA GGCUCU ACCAGAGAAACACACGUUGUGGUACAUUACCUGGUA | 9349 | AGAGCCG GCC UGUGAGUG | 2207 |
| 3753 | UGGUUGUC AGAA GGGAUU ACCAGAGAAACACACGUUGUGGUACAUUACCUGGUA | 9350 | AAUCCCA GAU GACAACCA | 2208 |
| 3764 | CACUGUCC AGAA GGUUGU ACCAGAGAAACACACGUUGUGGUACAUUACCUGGUA | 9351 | ACAACCA GAC GGACAGUG | 2209 |
| 3911 | GAUAUCCG AGAA GGUAGC ACCAGAGAAACACACGUUGUGGUACAUUACCUGGUA | 9352 | GCUACCA GUC CGGAUAUC | 2210 |
| 3927 | UCUGUGUC AGAA GAGUGA ACCAGAGAAACACACGUUGUGGUACAUUACCUGGUA | 9353 | UCACUCC GAU GACACAGA | 2211 |
| 4011 | AGAAUCUG AGAA GUGCUA ACCAGAGAAACACACGUUGUGGUACAUUACCUGGUA | 9354 | UAGCACA GCC CAGAUUCU | 2212 |
| 4016 | GCUGGAGA AGAA GGGCUG ACCAGAGAAACACACGUUGUGGUACAUUACCUGGUA | 9355 | CAGCCCA GAU UCUCCAGC | 2213 |
| 4025 | CCGUGUCA AGAA GGAGAA ACCAGAGAAACACACGUUGUGGUACAUUACCUGGUA | 9356 | UUCUCCA GCC UGACACGG | 2214 |
| 4059 | UCCUUUUA AGAA GGAGGA ACCAGAGAAACACACGUUGUGGUACAUUACCUGGUA | 9357 | UCCUCCU GUU UAAAAGGA | 2215 |
| 4111 | AAAAUCUG AGAA GACCUC ACCAGAGAAACACACGUUGUGGUACAUUACCUGGUA | 9358 | GAGGUCU GCU CAGAUUUU | 2216 |
| 4116 | ACUUCAAA AGAA GAGCAG ACCAGAGAAACACACGUUGUGGUACAUUACCUGGUA | 9359 | CUGCUCA GAU UUUGAAGU | 2217 |
| 4195 | UCCCUGCA AGAA GAGGUC ACCAGAGAAACACACGUUGUGGUACAUUACCUGGUA | 9360 | GACCUCG GAC UGCAGGGA | 2218 |
| 4210 | CCUAGAAG AGAA GGCUCC ACCAGAGAAACACACGUUGUGGUACAUUACCUGGUA | 9361 | GGAGCCA GCU CUUCUAGG | 2219 |

Table VI: Mouse *flk*-1 VEGF Receptor-Hammerhead Ribozyme and Substrate sequence 237.198

| nt. Position | HH Ribozyme Sequence | Rz Seq ID No. | Substrate | Seq ID No. |
|---|---|---|---|---|
| 13 | CCGUACCC CUGAUGA GCCGUUAGGC GAA AUUCGCCC | 9362 | GGGCGAAUU GGGUACGG | 2220 |
| 18 | GGGUCCCG CUGAUGA GCCGUUAGGC GAA ACCCAAUU | 9363 | AAUUGGGUA CGGGACCC | 2221 |
| 31 | UCGACCUC CUGAUGA GCCGUUAGGC GAA AGGGGGGU | 9364 | ACCCCCCUC GAGGUCGA | 2222 |
| 37 | AUACCGUC CUGAUGA GCCGUUAGGC GAA ACCUCGAG | 9365 | CUCGAGGUC GACGGUAU | 2223 |
| 44 | CUUAUCGA CUGAUGA GCCGUUAGGC GAA ACCGUCGA | 9366 | UCGACGGUA UCGAUAAG | 2224 |
| 46 | AGCUUAUC CUGAUGA GCCGUUAGGC GAA AUACCGUC | 9367 | GACGGUAUC GAUAAGCU | 2225 |
| 50 | AUCAAGCU CUGAUGA GCCGUUAGGC GAA AUCGAUAC | 9368 | GUAUCGAUA AGCUUGAU | 2226 |
| 55 | UCGAUAUC CUGAUGA GCCGUUAGGC GAA AGCUUAUC | 9369 | GAUAAGCUU GAUAUCGA | 2227 |
| 59 | GAAUUCGA CUGAUGA GCCGUUAGGC GAA AUCAAGCU | 9370 | AGCUUGAUA UCGAAUUC | 2228 |
| 61 | CCGAAUUC CUGAUGA GCCGUUAGGC GAA AUAUCAAG | 9371 | CUUGAUAUC GAAUUCGG | 2229 |
| 66 | UGGGCCCG CUGAUGA GCCGUUAGGC GAA AUUCGAUA | 9372 | UAUCGAAUU CGGGCCCA | 2230 |
| 67 | CUGGGCCC CUGAUGA GCCGUUAGGC GAA AAUUCGAU | 9373 | AUCGAAUUC GGGCCCAG | 2231 |
| 83 | GGCUGCGG CUGAUGA GCCGUUAGGC GAA ACACAGUC | 9374 | GACUGUGUC CCGCAGCC | 2232 |
| 97 | AGCCAGGU CUGAUGA GCCGUUAGGC GAA AUCCCGGC | 9375 | GCCGGGAUA ACCUGGCU | 2233 |
| 114 | GUCCGCGG CUGAUGA GCCGUUAGGC GAA AUCGGGUC | 9376 | GACCCGAUU CCGCGGAC | 2234 |
| 115 | UGUCCGCG CUGAUGA GCCGUUAGGC GAA AAUCGGGU | 9377 | ACCCGAUUC CGCGGACA | 2235 |
| 169 | ACCGGGGA CUGAUGA GCCGUUAGGC GAA AGCGCGGG | 9378 | CCCGCGCUC UCCCCGGU | 2236 |
| 171 | AGACCGGG CUGAUGA GCCGUUAGGC GAA AGAGCGCG | 9379 | CGCGCUCUC CCCGGUCU | 2237 |
| 178 | CAGCGCAA CUGAUGA GCCGUUAGGC GAA ACCGGGGA | 9380 | UCCCCGGUC UUGCGCUG | 2238 |
| 180 | CGCAGCGC CUGAUGA GCCGUUAGGC GAA AGACCGGG | 9381 | CCCGGUCUU GCGCUGCG | 2239 |
| 197 | AGAGGCGG CUGAUGA GCCGUUAGGC GAA AUGGCCCC | 9382 | GGGGCCAUA CCGCCUCU | 2240 |
| 204 | AAGUCACA CUGAUGA GCCGUUAGGC GAA AGGCGGUA | 9383 | UACCGCCUC UGUGACUU | 2241 |
| 212 | CCGCAAAG CUGAUGA GCCGUUAGGC GAA AGUCACAG | 9384 | CUGUGACUU CUUUGCGG | 2242 |
| 213 | CCCGCAAA CUGAUGA GCCGUUAGGC GAA AAGUCACA | 9385 | UGUGACUUC UUUGCGGG | 2243 |
| 215 | GGCCCGCA CUGAUGA GCCGUUAGGC GAA AGAAGUCA | 9386 | UGACUUCUU UGCGGGCC | 2244 |
| 216 | UGGCCCGC CUGAUGA GCCGUUAGGC GAA AAGAAGUC | 9387 | GACUUCUUU GCGGGCCA | 2245 |
| 241 | CAGGCACA CUGAUGA GCCGUUAGGC GAA ACUCCUUC | 9388 | GAAGGAGUC UGUGCCUG | 2246 |
| 262 | UGGGCACA CUGAUGA GCCGUUAGGC GAA AGCCCAGU | 9389 | ACUGGGCUC UGUGCCCA | 2247 |
| 306 | GCGACAGC CUGAUGA GCCGUUAGGC GAA AGCAGCGC | 9390 | GCGCUGCUA GCUGUCGC | 2248 |
| 312 | CACAGAGC CUGAUGA GCCGUUAGGC GAA ACAGCUAG | 9391 | CUAGCUGUC GCUCUGUG | 2249 |
| 316 | GAACCACA CUGAUGA GCCGUUAGGC GAA AGCGACAG | 9392 | CUGUCGCUC UGUGGUUC | 2250 |
| 323 | CCACGCAG CUGAUGA GCCGUUAGGC GAA ACCACAGA | 9393 | UCUGUGGUU CUGCGUGG | 2251 |
| 324 | UCCACGCA CUGAUGA GCCGUUAGGC GAA AACCACAG | 9394 | CUGUGGUUC UGCGUGGA | 2252 |
| 347 | AACCCACA CUGAUGA GCCGUUAGGC GAA AGGCGGCU | 9395 | AGCCGCCUC UGUGGGUU | 2253 |
| 355 | GCCAGUCA CUGAUGA GCCGUUAGGC GAA ACCCACAG | 9396 | CUGUGGGUU UGACUGGC | 2254 |

142

| | | | | |
|---|---|---|---|---|
| 356 | CGCCAGUC CUGAUGA GCCGUUAGGC GAA AACCCACA | 9397 | UGUGGGUUU GACUGGCG | 2255 |
| 367 | AUGGAGAA CUGAUGA GCCGUUAGGC GAA AUCGCCAG | 9398 | CUGGCGAUU UUCUCCAU | 2256 |
| 368 | GAUGGAGA CUGAUGA GCCGUUAGGC GAA AAUCGCCA | 9399 | UGGCGAUUU UCUCCAUC | 2257 |
| 369 | GGAUGGAG CUGAUGA GCCGUUAGGC GAA AAAUCGCC | 9400 | GGCGAUUUU CUCCAUCC | 2258 |
| 370 | GGGAUGGA CUGAUGA GCCGUUAGGC GAA AAAAUCGC | 9401 | GCGAUUUUC UCCAUCCC | 2259 |
| 372 | GGGGGAUG CUGAUGA GCCGUUAGGC GAA AGAAAAUC | 9402 | GAUUUUCUC CAUCCCCC | 2260 |
| 376 | CUUGGGGG CUGAUGA GCCGUUAGGC GAA AUGGAGAA | 9403 | UUCUCCAUC CCCCCAAG | 2261 |
| 387 | UGUGUGCU CUGAUGA GCCGUUAGGC GAA AGCUUGGG | 9404 | CCCAAGCUC AGCACACA | 2262 |
| 405 | AUUGUCAG CUGAUGA GCCGUUAGGC GAA AUGUCUUU | 9405 | AAAGACAUA CUGACAAU | 2263 |
| 414 | UUUGCCAA CUGAUGA GCCGUUAGGC GAA AUUGUCAG | 9406 | CUGACAAUU UUGGCAAA | 2264 |
| 415 | AUUUGCCA CUGAUGA GCCGUUAGGC GAA AAUUGUCA | 9407 | UGACAAUUU UGGCAAAU | 2265 |
| 416 | UAUUUGCC CUGAUGA GCCGUUAGGC GAA AAAUUGUC | 9408 | GACAAUUUU GGCAAAUA | 2266 |
| 424 | AAGGGUUG CUGAUGA GCCGUUAGGC GAA AUUUGCCA | 9409 | UGGCAAAUA CAACCCUU | 2267 |
| 432 | GUAAUCUG CUGAUGA GCCGUUAGGC GAA AGGGUUGU | 9410 | ACAACCCUU CAGAUUAC | 2268 |
| 433 | AGUAAUCU CUGAUGA GCCGUUAGGC GAA AAGGGUUG | 9411 | CAACCCUUC AGAUUACU | 2269 |
| 438 | CUGCAAGU CUGAUGA GCCGUUAGGC GAA AUCUGAAG | 9412 | CUUCAGAUU ACUUGCAG | 2270 |
| 439 | CCUGCAAG CUGAUGA GCCGUUAGGC GAA AAUCUGAA | 9413 | UUCAGAUUA CUUGCAGG | 2271 |
| 442 | UCCCCUGC CUGAUGA GCCGUUAGGC GAA AGUAAUCU | 9414 | AGAUUACUU GCAGGGGA | 2272 |
| 471 | UUGGGCCA CUGAUGA GCCGUUAGGC GAA AGCCAGUC | 8676 | GACUGGCUU UGGCCCAA | 1534 |
| 472 | AUUGGGCC CUGAUGA GCCGUUAGGC GAA AAGCCAGU | 8677 | ACUGGCUUU GGCCCAAU | 1535 |
| 484 | AUCACGCU CUGAUGA GCCGUUAGGC GAA AGCAUUGG | 9415 | CCAAUGCUC AGCGUGAU | 2273 |
| 493 | UUCCUCAG CUGAUGA GCCGUUAGGC GAA AUCACGCU | 9416 | AGCGUGAUU CUGAGGAA | 2274 |
| 494 | UUUCCUCA CUGAUGA GCCGUUAGGC GAA AAUCACGC | 9417 | GCGUGAUUC UGAGGAAA | 2275 |
| 507 | GUCACCAA CUGAUGA GCCGUUAGGC GAA ACCCUUUC | 9418 | GAAAGGGUA UUGGUGAC | 2276 |
| 509 | CAGUCACC CUGAUGA GCCGUUAGGC GAA AUACCCUU | 9419 | AAGGGUAUU GGUGACUG | 2277 |
| 538 | GCAGAAGA CUGAUGA GCCGUUAGGC GAA ACUGUCAC | 9420 | GUGACAGUA UCUUCUGC | 2278 |
| 540 | UUGCAGAA CUGAUGA GCCGUUAGGC GAA AUACUGUC | 9421 | GACAGUAUC UUCUGCAA | 2279 |
| 542 | UUUUGCAG CUGAUGA GCCGUUAGGC GAA AGAUACUG | 9422 | CAGUAUCUU CUGCAAAA | 2280 |
| 543 | GUUUUGCA CUGAUGA GCCGUUAGGC GAA AAGAUACU | 9423 | AGUAUCUUC UGCAAAAC | 2281 |
| 555 | GGAAUGGU CUGAUGA GCCGUUAGGC GAA AGUGUUUU | 9424 | AAAACACUC ACCAUUCC | 2282 |
| 561 | ACCCUGGG CUGAUGA GCCGUUAGGC GAA AUGGUGAG | 9425 | CUCACCAUU CCCAGGGU | 2283 |
| 562 | CACCCUGG CUGAUGA GCCGUUAGGC GAA AAUGGUGA | 9426 | UCACCAUUC CCAGGGUG | 2284 |
| 573 | UCAUUUCC CUGAUGA GCCGUUAGGC GAA ACCACCCU | 9427 | AGGGUGGUU GGAAAUGA | 2285 |
| 583 | GGCUCCAG CUGAUGA GCCGUUAGGC GAA AUCAUUUC | 9428 | GAAAUGAUA CUGGAGCC | 2286 |
| 593 | AGCACUUG CUGAUGA GCCGUUAGGC GAA AGGCUCCA | 8688 | UGGAGCCUA CAAGUGCU | 1546 |
| 602 | CCCGGUAC CUGAUGA GCCGUUAGGC GAA AGCACUUG | 9429 | CAAGUGCUC GUACCGGG | 2287 |
| 605 | CGUCCCGG CUGAUGA GCCGUUAGGC GAA ACGAGCAC | 9430 | GUGCUCGUA CCGGGACG | 2288 |
| 615 | GCUAUGUC CUGAUGA GCCGUUAGGC GAA ACGUCCCG | 9431 | CGGGACGUC GACAUAGC | 2289 |
| 621 | GUGGAGGC CUGAUGA GCCGUUAGGC GAA AUGUCGAC | 9432 | GUCGACAUA GCCUCCAC | 2290 |

| | | | | |
|---|---|---|---|---|
| 626 | AAACAGUG CUGAUGA GCCGUUAGGC GAA AGGCUAUG | 9433 | CAUAGCCUC CACUGUUU | 2291 |
| 633 | UAGACAUA CUGAUGA GCCGUUAGGC GAA ACAGUGGA | 9434 | UCCACUGUU UAUGUCUA | 2292 |
| 634 | AUAGACAU CUGAUGA GCCGUUAGGC GAA AACAGUGG | 9435 | CCACUGUUU AUGUCUAU | 2293 |
| 635 | CAUAGACA CUGAUGA GCCGUUAGGC GAA AAACAGUG | 9436 | CACUGUUUA UGUCUAUG | 2294 |
| 639 | CGAACAUA CUGAUGA GCCGUUAGGC GAA ACAUAAAC | 9437 | GUUUAUGUC UAUGUUCG | 2295 |
| 641 | CUCGAACA CUGAUGA GCCGUUAGGC GAA AGACAUAA | 9438 | UUAUGUCUA UGUUCGAG | 2296 |
| 645 | UAAUCUCG CUGAUGA GCCGUUAGGC GAA ACAUAGAC | 9439 | GUCUAUGUU CGAGAUUA | 2297 |
| 646 | GUAAUCUC CUGAUGA GCCGUUAGGC GAA AACAUAGA | 9440 | UCUAUGUUC GAGAUUAC | 2298 |
| 652 | UGAUCUGU CUGAUGA GCCGUUAGGC GAA AUCUCGAA | 9441 | UUCGAGAUU ACAGAUCA | 2299 |
| 653 | GUGAUCUG CUGAUGA GCCGUUAGGC GAA AAUCUCGA | 9442 | UCGAGAUUA CAGAUCAC | 2300 |
| 659 | UGAAUGGU CUGAUGA GCCGUUAGGC GAA AUCUGUAA | 9443 | UUACAGAUC ACCAUUCA | 2301 |
| 665 | AGGCGAUG CUGAUGA GCCGUUAGGC GAA AUGGUGAU | 9444 | AUCACCAUU CAUCGCCU | 2302 |
| 666 | GAGGCGAU CUGAUGA GCCGUUAGGC GAA AAUGGUGA | 9445 | UCACCAUUC AUCGCCUC | 2303 |
| 669 | ACAGAGGC CUGAUGA GCCGUUAGGC GAA AUGAAUGG | 9446 | CCAUUCAUC GCCUCUGU | 2304 |
| 674 | CACUGACA CUGAUGA GCCGUUAGGC GAA AGGCGAUG | 9447 | CAUCGCCUC UGUCAGUG | 2305 |
| 678 | UGGUCACU CUGAUGA GCCGUUAGGC GAA ACAGAGGC | 9448 | GCCUCUGUC AGUGACCA | 2306 |
| 696 | AUGUACAC CUGAUGA GCCGUUAGGC GAA AUGCCAUG | 9449 | CAUGGCAUC GUGUACAU | 2307 |
| 701 | CGGUGAUG CUGAUGA GCCGUUAGGC GAA ACACGAUG | 9450 | CAUCGUGUA CAUCACCG | 2308 |
| 705 | UUCUCGGU CUGAUGA GCCGUUAGGC GAA AUGUACAC | 9451 | GUGUACAUC ACCGAGAA | 2309 |
| 735 | CGGCAGGG CUGAUGA GCCGUUAGGC GAA AUCACCAC | 9452 | GUGGUGAUC CCCUGCCG | 2310 |
| 749 | UUGAAAUC CUGAUGA GCCGUUAGGC GAA ACCCUCGG | 9453 | CCGAGGGUC GAUUUCAA | 2311 |
| 753 | AGGUUUGA CUGAUGA GCCGUUAGGC GAA AUCGACCC | 9454 | GGGUCGAUU UCAAACCU | 2312 |
| 754 | GAGGUUUG CUGAUGA GCCGUUAGGC GAA AAUCGACC | 9455 | GGUCGAUUU CAAACCUC | 2313 |
| 755 | UGAGGUUU CUGAUGA GCCGUUAGGC GAA AAAUCGAC | 9456 | GUCGAUUUC AAACCUCA | 2314 |
| 762 | GACACAUU CUGAUGA GCCGUUAGGC GAA AGGUUUGA | 9457 | UCAAACCUC AAUGUGUC | 2315 |
| 770 | CGCAAAGA CUGAUGA GCCGUUAGGC GAA ACACAUUG | 9458 | CAAUGUGUC UCUUUGCG | 2316 |
| 772 | AGCGCAAA CUGAUGA GCCGUUAGGC GAA AGACACAU | 9459 | AUGUGUCUC UUUGCGCU | 2317 |
| 774 | CUAGCGCA CUGAUGA GCCGUUAGGC GAA AGAGACAC | 9460 | GUGUCUCUU UGCGCUAG | 2318 |
| 775 | CCUAGCGC CUGAUGA GCCGUUAGGC GAA AAGAGACA | 9461 | UGUCUCUUU GCGCUAGG | 2319 |
| 781 | UGGAUACC CUGAUGA GCCGUUAGGC GAA AGCGCAAA | 9462 | UUUGCGCUA GGUAUCCA | 2320 |
| 785 | UUUCUGGA CUGAUGA GCCGUUAGGC GAA ACCUAGCG | 9463 | CGCUAGGUA UCCAGAAA | 2321 |
| 787 | CUUUUCUG CUGAUGA GCCGUUAGGC GAA AUACCUAG | 9464 | CUAGGUAUC CAGAAAAG | 2322 |
| 800 | CCGGAACA CUGAUGA GCCGUUAGGC GAA AUCUCUUU | 9465 | AAAGAGAUU UGUUCCGG | 2323 |
| 801 | UCCGGAAC CUGAUGA GCCGUUAGGC GAA AAUCUCUU | 9466 | AAGAGAUUU GUUCCGGA | 2324 |
| 804 | CCAUCCGG CUGAUGA GCCGUUAGGC GAA ACAAAUCU | 9467 | AGAUUUGUU CCGGAUGG | 2325 |
| 805 | UCCAUCCG CUGAUGA GCCGUUAGGC GAA AACAAAUC | 9468 | GAUUUGUUC CGGAUGGA | 2326 |
| 822 | UCCCAGGA CUGAUGA GCCGUUAGGC GAA AUUCUGUU | 8737 | AACAGAAUU UCCUGGGA | 1595 |
| 823 | GUCCCAGG CUGAUGA GCCGUUAGGC GAA AAUUCUGU | 8738 | ACAGAAUUU CCUGGGAC | 1596 |
| 824 | UGUCCCAG CUGAUGA GCCGUUAGGC GAA AAAUUCUG | 8739 | CAGAAUUUC CUGGGACA | 1597 |

144

| | | | | |
|---|---|---|---|---|
| 840 | GUAAAGCC CUGAUGA GCCGUUAGGC GAA AUCUCGCU | 9469 | AGCGAGAUA GGCUUUAC | 2327 |
| 845 | GGAGAGUA CUGAUGA GCCGUUAGGC GAA AGCCUAUC | 9470 | GAUAGGCUU UACUCUCC | 2328 |
| 846 | GGGAGAGU CUGAUGA GCCGUUAGGC GAA AAGCCUAU | 9471 | AUAGGCUUU ACUCUCCC | 2329 |
| 847 | GGGGAGAG CUGAUGA GCCGUUAGGC GAA AAAGCCUA | 9472 | UAGGCUUUA CUCUCCCC | 2330 |
| 850 | ACUGGGGA CUGAUGA GCCGUUAGGC GAA AGUAAAGC | 9473 | GCUUUACUC UCCCCAGU | 2331 |
| 852 | UAACUGGG CUGAUGA GCCGUUAGGC GAA AGAGUAAA | 9474 | UUUACUCUC CCCAGUUA | 2332 |
| 859 | GAUCAUGU CUGAUGA GCCGUUAGGC GAA ACUGGGGA | 9475 | UCCCCAGUU ACAUGAUC | 2333 |
| 860 | UGAUCAUG CUGAUGA GCCGUUAGGC GAA AACUGGGG | 9476 | CCCCAGUUA CAUGAUCA | 2334 |
| 867 | GCAUAGCU CUGAUGA GCCGUUAGGC GAA AUCAUGUA | 8747 | UACAUGAUC AGCUAUGC | 1605 |
| 872 | UGCCGGCA CUGAUGA GCCGUUAGGC GAA AGCUGAUC | 9477 | GAUCAGCUA UGCCGGCA | 2335 |
| 885 | UCACAGAA CUGAUGA GCCGUUAGGC GAA ACCAUGCC | 8749 | GGCAUGGUC UUCUGUGA | 1607 |
| 887 | CCUCACAG CUGAUGA GCCGUUAGGC GAA AGACCAUG | 9478 | CAUGGUCUU CUGUGAGG | 2336 |
| 888 | GCCUCACA CUGAUGA GCCGUUAGGC GAA AAGACCAU | 9479 | AUGGUCUUC UGUGAGGC | 2337 |
| 903 | UCAUCAUU CUGAUGA GCCGUUAGGC GAA AUCUUUGC | 9480 | GCAAAGAUC AAUGAUGA | 2338 |
| 917 | UAGACUGA CUGAUGA GCCGUUAGGC GAA AGGUUUCA | 9481 | UGAAACCUA UCAGUCUA | 2339 |
| 919 | GAUAGACU CUGAUGA GCCGUUAGGC GAA AUAGGUUU | 9482 | AAACCUAUC AGUCUAUC | 2340 |
| 923 | ACAUGAUA CUGAUGA GCCGUUAGGC GAA ACUGAUAG | 9483 | CUAUCAGUC UAUCAUGU | 2341 |
| 925 | GUACAUGA CUGAUGA GCCGUUAGGC GAA AGACUGAU | 9484 | AUCAGUCUA UCAUGUAC | 2342 |
| 927 | AUGUACAU CUGAUGA GCCGUUAGGC GAA AUAGACUG | 8758 | CAGUCUAUC AUGUACAU | 2343 |
| 932 | CAACUAUG CUGAUGA GCCGUUAGGC GAA ACAUGAUA | 9485 | UAUCAUGUA CAUAGUUG | 2344 |
| 936 | ACCACAAC CUGAUGA GCCGUUAGGC GAA AUGUACAU | 9486 | AUGUACAUA GUUGUGGU | 2345 |
| 939 | ACAACCAC CUGAUGA GCCGUUAGGC GAA ACUAUGUA | 9487 | UACAUAGUU GUGGUUGU | 2346 |
| 945 | UAUCCUAC CUGAUGA GCCGUUAGGC GAA ACCACAAC | 9488 | GUUGUGGUU GUAGGAUA | 2347 |
| 948 | CUAUAUCC CUGAUGA GCCGUUAGGC GAA ACAACCAC | 9489 | GUGGUUGUA GGAUAUAG | 2348 |
| 953 | AAAUCCUA CUGAUGA GCCGUUAGGC GAA AUCCUACA | 9490 | UGUAGGAUA UAGGAUUU | 2349 |
| 955 | AUAAAUCC CUGAUGA GCCGUUAGGC GAA AUAUCCUA | 9491 | UAGGAUAUA GGAUUUAU | 2350 |
| 960 | ACAUCAUA CUGAUGA GCCGUUAGGC GAA AUCCUAUA | 8768 | UAUAGGAUU UAUGAUGU | 1626 |
| 961 | CACAUCAU CUGAUGA GCCGUUAGGC GAA AAUCCUAU | 8769 | AUAGGAUUU AUGAUGUG | 1627 |
| 962 | UCACAUCA CUGAUGA GCCGUUAGGC GAA AAAUCCUA | 9492 | UAGGAUUUA UGAUGUGA | 2351 |
| 972 | GGGCUCAG CUGAUGA GCCGUUAGGC GAA AUCACAUC | 9493 | GAUGUGAUU CUGAGCCC | 2352 |
| 973 | GGGGCUCA CUGAUGA GCCGUUAGGC GAA AAUCACAU | 9494 | AUGUGAUUC UGAGCCCC | 2353 |
| 993 | GAUAGCUC CUGAUGA GCCGUUAGGC GAA AUUUCAUG | 9495 | CAUGAAAUU GAGCUAUC | 2354 |
| 999 | CCGGCAGA CUGAUGA GCCGUUAGGC GAA AGCUCAAU | 9496 | AUUGAGCUA UCUGCCGG | 2355 |
| 1001 | CUCCGGCA CUGAUGA GCCGUUAGGC GAA AUAGCUCA | 9497 | UGAGCUAUC UGCCGGAG | 2356 |
| 1017 | UUUAAGAC CUGAUGA GCCGUUAGGC GAA AGUUUUUC | 9498 | GAAAAACUU GUCUUAAA | 2357 |
| 1020 | CAAUUUAA CUGAUGA GCCGUUAGGC GAA ACAAGUUU | 9499 | AAACUUGUC UUAAAUUG | 2358 |
| 1022 | UACAAUUU CUGAUGA GCCGUUAGGC GAA AGACAAGU | 9500 | ACUUGUCUU AAAUUGUA | 2359 |
| 1023 | GUACAAUU CUGAUGA GCCGUUAGGC GAA AAGACAAG | 8783 | CUUGUCUUA AAUUGUAC | 1641 |
| 1027 | CGCUGUAC CUGAUGA GCCGUUAGGC GAA AUUUAAGA | 9501 | UCUUAAAUU GUACAGCG | 2360 |

145

| | | | | |
|---|---|---|---|---|
| 1030 | UCUCGCUG CUGAUGA GCCGUUAGGC GAA ACAAUUUA | 9502 | UAAAUUGUA CAGCGAGA | 2361 |
| 1047 | CCCACAUU CUGAUGA GCCGUUAGGC GAA AGCUCUGU | 9503 | ACAGAGCUC AAUGUGGG | 2362 |
| 1059 | GUGAAAUC CUGAUGA GCCGUUAGGC GAA AGCCCCAC | 9504 | GUGGGGCUU GAUUUCAC | 2363 |
| 1063 | CCAGGUGA CUGAUGA GCCGUUAGGC GAA AUCAAGCC | 9505 | GGCUUGAUU UCACCUGG | 2364 |
| 1064 | GCCAGGUG CUGAUGA GCCGUUAGGC GAA AAUCAAGC | 9506 | GCUUGAUUU CACCUGGC | 2365 |
| 1065 | UGCCAGGU CUGAUGA GCCGUUAGGC GAA AAAUCAAG | 9507 | CUUGAUUUC ACCUGGCA | 2366 |
| 1076 | AAGGUGGA CUGAUGA GCCGUUAGGC GAA AGUGCCAG | 9508 | CUGGCACUC UCCACCUU | 2367 |
| 1078 | UGAAGGUG CUGAUGA GCCGUUAGGC GAA AGAGUGCC | 9509 | GGCACUCUC CACCUUCA | 2368 |
| 1084 | AGACUUUG CUGAUGA GCCGUUAGGC GAA AGGUGGAG | 9510 | CUCCACCUU CAAAGUCU | 2369 |
| 1085 | GAGACUUU CUGAUGA GCCGUUAGGC GAA AAGGUGGA | 9511 | UCCACCUUC AAAGUCUC | 2370 |
| 1091 | UAUGAUGA CUGAUGA GCCGUUAGGC GAA ACUUUGAA | 9512 | UUCAAAGUC UCAUCAUA | 2371 |
| 1093 | CUUAUGAU CUGAUGA GCCGUUAGGC GAA AGACUUUG | 9513 | CAAAGUCUC AUCAUAAG | 2372 |
| 1096 | CUUCUUAU CUGAUGA GCCGUUAGGC GAA AUGAGACU | 9514 | AGUCUCAUC AUAAGAAG | 2373 |
| 1099 | AAUCUUCU CUGAUGA GCCGUUAGGC GAA AUGAUGAG | 9515 | CUCAUCAUA AGAAGAUU | 2374 |
| 1107 | CGGUUUAC CUGAUGA GCCGUUAGGC GAA AUCUUCUU | 9516 | AAGAAGAUU GUAAACCG | 2375 |
| 1110 | UCCCGGUU CUGAUGA GCCGUUAGGC GAA ACAAUCUU | 9517 | AAGAUUGUA AACCGGGA | 2376 |
| 1130 | UCCCAGGA CUGAUGA GCCGUUAGGC GAA AGGGUUUC | 9518 | GAAACCCUU UCCUGGGA | 2377 |
| 1131 | GUCCCAGG CUGAUGA GCCGUUAGGC GAA AAGGGUUU | 9519 | AAACCCUUU CCUGGGAC | 2378 |
| 1132 | AGUCCCAG CUGAUGA GCCGUUAGGC GAA AAAGGGUU | 9520 | AACCCUUUC CUGGGACU | 2379 |
| 1154 | UGCUCAAA CUGAUGA GCCGUUAGGC GAA ACAUCUUC | 9521 | GAAGAUGUU UUUGAGCA | 2380 |
| 1155 | GUGCUCAA CUGAUGA GCCGUUAGGC GAA AACAUCUU | 9522 | AAGAUGUUU UUGAGCAC | 2381 |
| 1156 | GGUGCUCA CUGAUGA GCCGUUAGGC GAA AAACAUCU | 9523 | AGAUGUUUU UGAGCACC | 2382 |
| 1157 | AGGUGCUC CUGAUGA GCCGUUAGGC GAA AAAACAUC | 9524 | GAUGUUUUU GAGCACCU | 2383 |
| 1166 | CUAUUGUC CUGAUGA GCCGUUAGGC GAA AGGUGCUC | 9525 | GAGCACCUU GACAAUAG | 2384 |
| 1173 | ACACUUUC CUGAUGA GCCGUUAGGC GAA AUUGUCAA | 9526 | UUGACAAUA GAAAGUGU | 2385 |
| 1205 | CACAGGUG CUGAUGA GCCGUUAGGC GAA AUUCCCCU | 9527 | AGGGGAAUA CACCUGUG | 2386 |
| 1215 | CUGGACGC CUGAUGA GCCGUUAGGC GAA ACACAGGU | 9528 | ACCUGUGUA GCGUCCAG | 2387 |
| 1220 | GUCCACUG CUGAUGA GCCGUUAGGC GAA ACGCUACA | 9529 | UGUAGCGUC CAGUGGAC | 2388 |
| 1236 | UUUCUCUU CUGAUGA GCCGUUAGGC GAA AUCAUCCG | 9530 | CGGAUGAUC AAGAGAAA | 2389 |
| 1246 | AAAUGUUC CUGAUGA GCCGUUAGGC GAA AUUUCUCU | 9531 | AGAGAAAUA GAACAUUU | 2390 |
| 1253 | CUCGGACA CUGAUGA GCCGUUAGGC GAA AUGUUCUA | 9532 | UAGAACAUU UGUCCGAG | 2391 |
| 1254 | ACUCGGAC CUGAUGA GCCGUUAGGC GAA AAUGUUCU | 9533 | AGAACAUUU GUCCGAGU | 2392 |
| 1257 | UGAACUCG CUGAUGA GCCGUUAGGC GAA ACAAAUGU | 9534 | ACAUUUGUC CGAGUUCA | 2393 |
| 1263 | UUUGUGUG CUGAUGA GCCGUUAGGC GAA ACUCGGAC | 9535 | GUCCGAGUU CACACAAA | 2394 |
| 1264 | CUUUGUGU CUGAUGA GCCGUUAGGC GAA AACUCGGA | 9536 | UCCGAGUUC ACACAAAG | 2395 |
| 1276 | AGCAAUAA CUGAUGA GCCGUUAGGC GAA AGGCUUUG | 9537 | CAAAGCCUU UUAUUGCU | 2396 |
| 1277 | AAGCAAUA CUGAUGA GCCGUUAGGC GAA AAGGCUUU | 9538 | AAAGCCUUU UAUUGCUU | 2397 |
| 1278 | AAAGCAAU CUGAUGA GCCGUUAGGC GAA AAAGGCUU | 9539 | AAGCCUUUU AUUGCUUU | 2398 |
| 1279 | GAAAGCAA CUGAUGA GCCGUUAGGC GAA AAAAGGCU | 9540 | AGCCUUUUA UUGCUUUC | 2399 |

| | | | | |
|---|---|---|---|---|
| 1281 | CCGAAAGC CUGAUGA GCCGUUAGGC GAA AUAAAAGG | 9541 | CCUUUUAUU GCUUUCGG | 2400 |
| 1285 | ACUACCGA CUGAUGA GCCGUUAGGC GAA AGCAAUAA | 9542 | UUAUUGCUU UCGGUAGU | 2401 |
| 1286 | CACUACCG CUGAUGA GCCGUUAGGC GAA AAGCAAUA | 9543 | UAUUGCUUU CGGUAGUG | 2402 |
| 1287 | CCACUACC CUGAUGA GCCGUUAGGC GAA AAAGCAAU | 9544 | AUUGCUUUC GGUAGUGG | 2403 |
| 1291 | CAUCCCAC CUGAUGA GCCGUUAGGC GAA ACCGAAAG | 9545 | CUUUCGGUA GUGGGAUG | 2404 |
| 1304 | CCACCAAA CUGAUGA GCCGUUAGGC GAA AUUUCAUC | 9546 | GAUGAAAUC UUUGGUGG | 2405 |
| 1306 | UUCCACCA CUGAUGA GCCGUUAGGC GAA AGAUUUCA | 9547 | UGAAAUCUU UGGUGGAA | 2406 |
| 1307 | CUUCCACC CUGAUGA GCCGUUAGGC GAA AAGAUUUC | 9548 | GAAAUCUUU GGUGGAAG | 2407 |
| 1330 | UCGGACUU CUGAUGA GCCGUUAGGC GAA ACUGCCCA | 9549 | UGGGCAGUC AAGUCCGA | 2408 |
| 1335 | GGGAUUCG CUGAUGA GCCGUUAGGC GAA ACUUGACU | 9550 | AGUCAAGUC CGAAUCCC | 2409 |
| 1341 | UUCACAGG CUGAUGA GCCGUUAGGC GAA AUUCGGAC | 9551 | GUCCGAAUC CCUGUGAA | 2410 |
| 1352 | AACUGAGA CUGAUGA GCCGUUAGGC GAA ACUUCACA | 9552 | UGUGAAGUA UCUCAGUU | 2411 |
| 1354 | GUAACUGA CUGAUGA GCCGUUAGGC GAA AUACUUCA | 9553 | UGAAGUAUC UCAGUUAC | 2412 |
| 1356 | GGGUAACU CUGAUGA GCCGUUAGGC GAA AGAUACUU | 9554 | AAGUAUCUC AGUUACCC | 2413 |
| 1360 | AGCUGGGU CUGAUGA GCCGUUAGGC GAA ACUGAGAU | 9555 | AUCUCAGUU ACCCAGCU | 2414 |
| 1361 | GAGCUGGG CUGAUGA GCCGUUAGGC GAA AACUGAGA | 9556 | UCUCAGUUA CCCAGCUC | 2415 |
| 1369 | GAUAUCAG CUGAUGA GCCGUUAGGC GAA AGCUGGGU | 9557 | ACCCAGCUC CUGAUAUC | 2416 |
| 1375 | CCAUUUGA CUGAUGA GCCGUUAGGC GAA AUCAGGAG | 9558 | CUCCUGAUA UCAAAUGG | 2417 |
| 1377 | UACCAUUU CUGAUGA GCCGUUAGGC GAA AUAUCAGG | 9559 | CCUGAUAUC AAAUGGUA | 2418 |
| 1385 | CAUUUCUG CUGAUGA GCCGUUAGGC GAA ACCAUUUG | 9560 | CAAAUGGUA CAGAAAUG | 2419 |
| 1404 | UUGGACUC CUGAUGA GCCGUUAGGC GAA AUGGGCCU | 9561 | AGGCCCAUU GAGUCCAA | 2420 |
| 1409 | UGUAGUUG CUGAUGA GCCGUUAGGC GAA ACUCAAUG | 9562 | CAUUGAGUC CAACUACA | 2421 |
| 1415 | UCAUUGUG CUGAUGA GCCGUUAGGC GAA AGUUGGAC | 9563 | GUCCAACUA CACAAUGA | 2422 |
| 1425 | UCGCCAAC CUGAUGA GCCGUUAGGC GAA AUCAUUGU | 9564 | ACAAUGAUU GUUGGCGA | 2423 |
| 1428 | UCAUCGCC CUGAUGA GCCGUUAGGC GAA ACAAUCAU | 9565 | AUGAUUGUU GGCGAUGA | 2424 |
| 1440 | AUGAUGGU CUGAUGA GCCGUUAGGC GAA AGUUCAUC | 9566 | GAUGAACUC ACCAUCAU | 2425 |
| 1446 | ACUUCCAU CUGAUGA GCCGUUAGGC GAA AUGGUGAG | 9567 | CUCACCAUC AUGGAAGU | 2426 |
| 1478 | UGACCGUG CUGAUGA GCCGUUAGGC GAA AGUUUCCU | 9568 | AGGAAACUA CACGGUCA | 2427 |
| 1485 | GUGAGGAU CUGAUGA GCCGUUAGGC GAA ACCGUGUA | 9569 | UACACGGUC AUCCUCAC | 2428 |
| 1488 | UUGGUGAG CUGAUGA GCCGUUAGGC GAA AUGACCGU | 9570 | ACGGUCAUC CUCACCAA | 2429 |
| 1491 | GGGUUGGU CUGAUGA GCCGUUAGGC GAA AGGAUGAC | 9571 | GUCAUCCUC ACCAACCC | 2430 |
| 1503 | UCCAUUGA CUGAUGA GCCGUUAGGC GAA AUGGGGUU | 9572 | AACCCCAUU UCAAUGGA | 2431 |
| 1504 | CUCCAUUG CUGAUGA GCCGUUAGGC GAA AAUGGGGU | 9573 | ACCCCAUUU CAAUGGAG | 2432 |
| 1505 | UCUCCAUU CUGAUGA GCCGUUAGGC GAA AAAUGGGG | 9574 | CCCCAUUUC AAUGGAGA | 2433 |
| 1530 | ACCAGAGA CUGAUGA GCCGUUAGGC GAA ACCAUGUG | 9575 | CACAUGGUC UCUCUGGU | 2434 |
| 1532 | CAACCAGA CUGAUGA GCCGUUAGGC GAA AGACCAUG | 9576 | CAUGGUCUC UCUGGUUG | 2435 |
| 1534 | CACAACCA CUGAUGA GCCGUUAGGC GAA AGAGACCA | 8856 | UGGUCUCUC UGGUUGUG | 1714 |
| 1539 | ACAUUCAC CUGAUGA GCCGUUAGGC GAA ACCAGAGA | 9577 | UCUCUGGUU GUGAAUGU | 2436 |
| 1548 | UGGGGUGG CUGAUGA GCCGUUAGGC GAA ACAUUCAC | 9578 | GUGAAUGUC CCACCCCA | 2437 |

147

| | | | | |
|---|---|---|---|---|
| 1560 | UUCUCACC CUGAUGA GCCGUUAGGC GAA AUCUGGGG | 8860 | CCCCAGAUC GGUGAGAA | 2438 |
| 1574 | GCGAGAUC CUGAUGA GCCGUUAGGC GAA AGGCUUUC | 9579 | GAAAGCCUU GAUCUCGC | 2439 |
| 1578 | AUAGGCGA CUGAUGA GCCGUUAGGC GAA AUCAAGGC | 9580 | GCCUUGAUC UCGCCUAU | 2440 |
| 1580 | CCAUAGGC CUGAUGA GCCGUUAGGC GAA AGAUCAAG | 9581 | CUUGAUCUC GCCUAUGG | 2441 |
| 1585 | GGAAUCCA CUGAUGA GCCGUUAGGC GAA AGGCGAGA | 9582 | UCUCGCCUA UGGAUUCC | 2442 |
| 1591 | CUGGUAGG CUGAUGA GCCGUUAGGC GAA AUCCAUAG | 9583 | CUAUGGAUU CCUACCAG | 2443 |
| 1592 | ACUGGUAG CUGAUGA GCCGUUAGGC GAA AAUCCAUA | 9584 | UAUGGAUUC CUACCAGU | 2444 |
| 1595 | CAUACUGG CUGAUGA GCCGUUAGGC GAA AGGAAUCC | 9585 | GGAUUCCUA CCAGUAUG | 2445 |
| 1601 | UGGUCCCA CUGAUGA GCCGUUAGGC GAA ACUGGUAG | 9586 | CUACCAGUA UGGGACCA | 2446 |
| 1619 | UGCAUGUC CUGAUGA GCCGUUAGGC GAA AUGUCUGC | 9587 | GCAGACAUU GACAUGCA | 2447 |
| 1632 | UUGGCGUA CUGAUGA GCCGUUAGGC GAA ACUGUGCA | 9588 | UGCACAGUC UACGCCAA | 2448 |
| 1634 | GGUUGGCG CUGAUGA GCCGUUAGGC GAA AGACUGUG | 9589 | CACAGUCUA CGCCAACC | 2449 |
| 1645 | GUGCAGGG CUGAUGA GCCGUUAGGC GAA AGGGUUGG | 9590 | CCAACCCUC CCCUGCAC | 2450 |
| 1659 | UACCACUG CUGAUGA GCCGUUAGGC GAA AUGUGGUG | 9591 | CACCACAUC CAGUGGUA | 2451 |
| 1667 | GCUGCCAG CUGAUGA GCCGUUAGGC GAA ACCACUGG | 9592 | CCAGUGGUA CUGGCAGC | 2452 |
| 1677 | GCUUCUUC CUGAUGA GCCGUUAGGC GAA AGCUGCCA | 9593 | UGGCAGCUA GAAGAAGC | 2453 |
| 1691 | GUCUGUAG CUGAUGA GCCGUUAGGC GAA AGCAGGCU | 9594 | AGCCUGCUC CUACAGAC | 2454 |
| 1694 | CGGGUCUG CUGAUGA GCCGUUAGGC GAA AGGAGCAG | 9595 | CUGCUCCUA CAGACCCG | 2455 |
| 1718 | UACAAGCA CUGAUGA GCCGUUAGGC GAA ACGGGCUU | 9596 | AAGCCCGUA UGCUUGUA | 2456 |
| 1723 | UUCUUUAC CUGAUGA GCCGUUAGGC GAA AGCAUACG | 9597 | CGUAUGCUU GUAAAGAA | 2457 |
| 1726 | CCAUUCUU CUGAUGA GCCGUUAGGC GAA ACAAGCAU | 9598 | AUGCUUGUA AAGAAUGG | 2458 |
| 1750 | CCCCUGGA CUGAUGA GCCGUUAGGC GAA AUCCUCCA | 9599 | UGGAGGAUU UCCAGGGG | 2459 |
| 1751 | CCCCCUGG CUGAUGA GCCGUUAGGC GAA AAUCCUCC | 9600 | GGAGGAUUU CCAGGGGG | 2460 |
| 1752 | CCCCCCUG CUGAUGA GCCGUUAGGC GAA AAAUCCUC | 9601 | GAGGAUUUC CAGGGGGG | 2461 |
| 1770 | GUGACUUC CUGAUGA GCCGUUAGGC GAA AUCUUGUU | 9602 | AACAAGAUC GAAGUCAC | 2462 |
| 1776 | UUUUUGGU CUGAUGA GCCGUUAGGC GAA ACUUCGAU | 9603 | AUCGAAGUC ACCAAAAA | 2463 |
| 1790 | UCAGGGCA CUGAUGA GCCGUUAGGC GAA AUUGGUUU | 9604 | AAACCAAUA UGCCCUGA | 2464 |
| 1800 | UUUCCUUC CUGAUGA GCCGUUAGGC GAA AUCAGGGC | 9605 | GCCCUGAUU GAAGGAAA | 2465 |
| 1821 | AGCGUACU CUGAUGA GCCGUUAGGC GAA ACAGUUUU | 9606 | AAAACUGUA AGUACGCU | 2466 |
| 1825 | GACCAGCG CUGAUGA GCCGUUAGGC GAA ACUUACAG | 9607 | CUGUAAGUA CGCUGGUC | 2467 |
| 1833 | GCUUGGAU CUGAUGA GCCGUUAGGC GAA ACCAGCGU | 9608 | ACGCUGGUC AUCCAAGC | 2468 |
| 1836 | GCAGCUUG CUGAUGA GCCGUUAGGC GAA AUGACCAG | 9609 | CUGGUCAUC CAAGCUGC | 2469 |
| 1853 | ACAACGCU CUGAUGA GCCGUUAGGC GAA ACACGUUG | 9610 | CAACGUGUC AGCGUUGU | 2470 |
| 1859 | AUUUGUAC CUGAUGA GCCGUUAGGC GAA ACGCUGAC | 9611 | GUCAGCGUU GUACAAAU | 2471 |
| 1862 | CACAUUUG CUGAUGA GCCGUUAGGC GAA ACAACGCU | 9612 | AGCGUUGUA CAAAUGUG | 2472 |
| 1878 | GCUUUGUU CUGAUGA GCCGUUAGGC GAA AUGGCUUC | 9613 | GAAGCCAUC AACAAAGC | 2473 |
| 1905 | AAGGAGAU CUGAUGA GCCGUUAGGC GAA ACCCUCUC | 9614 | GAGAGGGUC AUCUCCUU | 2474 |
| 1908 | UGGAAGGA CUGAUGA GCCGUUAGGC GAA AUGACCCU | 9615 | AGGGUCAUC UCCUUCCA | 2475 |
| 1910 | CAUGGAAG CUGAUGA GCCGUUAGGC GAA AGAUGACC | 9616 | GGUCAUCUC CUUCCAUG | 2476 |

148

| | | | | |
|---|---|---|---|---|
| 1913 | UCACAUGG CUGAUGA GCCGUUAGGC GAA AGGAGAUG | 9617 | CAUCUCCUU CCAUGUGA | 2477 |
| 1914 | AUCACAUG CUGAUGA GCCGUUAGGC GAA AAGGAGAU | 9618 | AUCUCCUUC CAUGUGAU | 2478 |
| 1923 | GGACCCCU CUGAUGA GCCGUUAGGC GAA AUCACAUG | 9619 | CAUGUGAUC AGGGGUCC | 2479 |
| 1930 | AAUUUCAG CUGAUGA GCCGUUAGGC GAA ACCCCUGA | 9620 | UCAGGGGUC CUGAAAUU | 2480 |
| 1938 | UGCACAGU CUGAUGA GCCGUUAGGC GAA AUUUCAGG | 9621 | CCUGAAAUU ACUGUGCA | 2481 |
| 1939 | UUGCACAG CUGAUGA GCCGUUAGGC GAA AAUUUCAG | 9622 | CUGAAAUUA CUGUGCAA | 2482 |
| 1982 | ACAACAGG CUGAUGA GCCGUUAGGC GAA ACACACUC | 9623 | GAGUGUGUC CCUGUUGU | 2483 |
| 1988 | CAGUGCAC CUGAUGA GCCGUUAGGC GAA ACAGGGAC | 9624 | GUCCCUGUU GUGCACUG | 2484 |
| 2008 | CUCAAACG CUGAUGA GCCGUUAGGC GAA AUUUCUGU | 9625 | ACAGAAAUA CGUUUGAG | 2485 |
| 2012 | GGUUCUCA CUGAUGA GCCGUUAGGC GAA ACGUAUUU | 9626 | AAAUACGUU UGAGAACC | 2486 |
| 2013 | AGGUUCUC CUGAUGA GCCGUUAGGC GAA AACGUAUU | 9627 | AAUACGUUU GAGAACCU | 2487 |
| 2022 | UACCACGU CUGAUGA GCCGUUAGGC GAA AGGUUCUC | 9628 | GAGAACCUC ACGUGGUA | 2488 |
| 2030 | CAAGCUUG CUGAUGA GCCGUUAGGC GAA ACCACGUG | 9629 | CACGUGGUA CAAGCUUG | 2489 |
| 2037 | UGUGAGCC CUGAUGA GCCGUUAGGC GAA AGCUUGUA | 9630 | UACAAGCUU GGCUCACA | 2490 |
| 2042 | UUGCCUGU CUGAUGA GCCGUUAGGC GAA AGCCAAGC | 9631 | GCUUGGCUC ACAGGCAA | 2491 |
| 2054 | UGUGGACC CUGAUGA GCCGUUAGGC GAA AUGUUGCC | 9632 | GGCAACAUC GGUCCACA | 2492 |
| 2058 | CCCAUGUG CUGAUGA GCCGUUAGGC GAA ACCGAUGU | 9633 | ACAUCGGUC CACAUGGG | 2493 |
| 2072 | GUGUGAGU CUGAUGA GCCGUUAGGC GAA AUUCGCCC | 9634 | GGGCGAAUC ACUCACAC | 2494 |
| 2076 | ACUGGUGU CUGAUGA GCCGUUAGGC GAA AGUGAUUC | 9635 | GAAUCACUC ACACCAGU | 2495 |
| 2085 | UUCUUGCA CUGAUGA GCCGUUAGGC GAA ACUGGUGU | 9636 | ACACCAGUU UGCAAGAA | 2496 |
| 2086 | GUUCUUGC CUGAUGA GCCGUUAGGC GAA AACUGGUG | 9637 | CACCAGUUU GCAAGAAC | 2497 |
| 2096 | GAGCAUCC CUGAUGA GCCGUUAGGC GAA AGUUCUUG | 9638 | CAAGAACUU GGAUGCUC | 2498 |
| 2104 | UUUCCAAA CUGAUGA GCCGUUAGGC GAA AGCAUCCA | 9639 | UGGAUGCUC UUUGGAAA | 2499 |
| 2106 | AGUUUCCA CUGAUGA GCCGUUAGGC GAA AGAGCAUC | 9640 | GAUGCUCUU UGGAAACU | 2500 |
| 2107 | CAGUUUCC CUGAUGA GCCGUUAGGC GAA AAGAGCAU | 9641 | AUGCUCUUU GGAAACUG | 2501 |
| 2129 | UGUUAGAA CUGAUGA GCCGUUAGGC GAA ACAUGGUG | 9642 | CACCAUGUU UUCUAACA | 2502 |
| 2130 | CUGUUAGA CUGAUGA GCCGUUAGGC GAA AACAUGGU | 9643 | ACCAUGUUU UCUAACAG | 2503 |
| 2131 | GCUGUUAG CUGAUGA GCCGUUAGGC GAA AAACAUGG | 9644 | CCAUGUUUU CUAACAGC | 2504 |
| 2132 | UGCUGUUA CUGAUGA GCCGUUAGGC GAA AAAACAUG | 9645 | CAUGUUUUC UAACAGCA | 2505 |
| 2134 | UGUGCUGU CUGAUGA GCCGUUAGGC GAA AGAAAACA | 9646 | UGUUUUCUA ACAGCACA | 2506 |
| 2151 | ACAAUCAA CUGAUGA GCCGUUAGGC GAA AUGUCAUU | 9647 | AAUGACAUC UUGAUUGU | 2507 |
| 2153 | CCACAAUC CUGAUGA GCCGUUAGGC GAA AGAUGUCA | 9648 | UGACAUCUU GAUUGUGG | 2508 |
| 2157 | AAUGCCAC CUGAUGA GCCGUUAGGC GAA AUCAAGAU | 9649 | AUCUUGAUU GUGGCAUU | 2509 |
| 2165 | CAUUCUGA CUGAUGA GCCGUUAGGC GAA AUGCCACA | 9650 | UGUGGCAUU UCAGAAUG | 2510 |
| 2166 | GCAUUCUG CUGAUGA GCCGUUAGGC GAA AAUGCCAC | 9651 | GUGGCAUUU CAGAAUGC | 2511 |
| 2167 | GGCAUUCU CUGAUGA GCCGUUAGGC GAA AAAUGCCA | 9652 | UGGCAUUUC AGAAUGCC | 2512 |
| 2177 | CCUGCAGA CUGAUGA GCCGUUAGGC GAA AGGCAUUC | 9653 | GAAUGCCUC UCUGCAGG | 2513 |
| 2179 | GUCCUGCA CUGAUGA GCCGUUAGGC GAA AGAGGCAU | 9654 | AUGCCUCUC UGCAGGAC | 2514 |
| 2198 | AGCAAACA CUGAUGA GCCGUUAGGC GAA AGUCGCCU | 9655 | AGGCGACUA UGUUUGCU | 2515 |

| | | | | |
|---|---|---|---|---|
| 2202 | GCAGAGCA CUGAUGA GCCGUUAGGC GAA ACAUAGUC | 9656 | GACUAUGUU UGCUCUGC | 2516 |
| 2203 | AGCAGAGC CUGAUGA GCCGUUAGGC GAA AACAUAGU | 9657 | ACUAUGUUU GCUCUGCU | 2517 |
| 2207 | CUUGAGCA CUGAUGA GCCGUUAGGC GAA AGCAAACA | 9658 | UGUUUGCUC UGCUCAAG | 2518 |
| 2212 | CUUAUCUU CUGAUGA GCCGUUAGGC GAA AGCAGAGC | 9659 | GCUCUGCUC AAGAUAAG | 2519 |
| 2218 | GGUCUUCU CUGAUGA GCCGUUAGGC GAA AUCUUGAG | 9660 | CUCAAGAUA AGAAGACC | 2520 |
| 2239 | GACCAGGC CUGAUGA GCCGUUAGGC GAA AUGUCUUU | 9661 | AAAGACAUU GCCUGGUC | 2521 |
| 2247 | AGCUGUUU CUGAUGA GCCGUUAGGC GAA ACCAGGCA | 9662 | UGCCUGGUC AAACAGCU | 2522 |
| 2256 | AGGAUGAU CUGAUGA GCCGUUAGGC GAA AGCUGUUU | 9663 | AAACAGCUC AUCAUCCU | 2523 |
| 2259 | UCUAGGAU CUGAUGA GCCGUUAGGC GAA AUGAGCUG | 9664 | CAGCUCAUC AUCCUAGA | 2524 |
| 2262 | CGCUCUAG CUGAUGA GCCGUUAGGC GAA AUGAUGAG | 9665 | CUCAUCAUC CUAGAGCG | 2525 |
| 2265 | AUGCGCUC CUGAUGA GCCGUUAGGC GAA AGGAUGAU | 9666 | AUCAUCCUA GAGCGCAU | 2526 |
| 2286 | UUUCCGGU CUGAUGA GCCGUUAGGC GAA AUCAUGGG | 9667 | CCCAUGAUC ACCGGAAA | 2527 |
| 2296 | AUUCUCCA CUGAUGA GCCGUUAGGC GAA AUUUCCGG | 9668 | CCGGAAAUC UGGAGAAU | 2528 |
| 2305 | UGUUGUCU CUGAUGA GCCGUUAGGC GAA AUUCUCCA | 9669 | UGGAGAAUC AGACAACA | 2529 |
| 2319 | GUCUCGCC CUGAUGA GCCGUUAGGC GAA AUGGUUGU | 9670 | ACAACCAUU GGCGAGAC | 2530 |
| 2331 | GUCACUUC CUGAUGA GCCGUUAGGC GAA AUGGUCUC | 9671 | GAGACCAUU GAAGUGAC | 2531 |
| 2341 | UGCUGGGC CUGAUGA GCCGUUAGGC GAA AGUCACUU | 9672 | AAGUGACUU GCCCAGCA | 2532 |
| 2351 | GAUUUCCA CUGAUGA GCCGUUAGGC GAA AUGCUGGG | 9673 | CCCAGCAUC UGGAAAUC | 2533 |
| 2359 | UGGGGUAG CUGAUGA GCCGUUAGGC GAA AUUUCCAG | 9674 | CUGGAAAUC CUACCCCA | 2534 |
| 2362 | GUGUGGGG CUGAUGA GCCGUUAGGC GAA AGGAUUUC | 9675 | GAAAUCCUA CCCCACAC | 2535 |
| 2373 | AACCAUGU CUGAUGA GCCGUUAGGC GAA AUGUGUGG | 9676 | CCACACAUU ACAUGGUU | 2536 |
| 2374 | GAACCAUG CUGAUGA GCCGUUAGGC GAA AAUGUGUG | 9677 | CACACAUUA CAUGGUUC | 2537 |
| 2381 | UGUCUUUG CUGAUGA GCCGUUAGGC GAA ACCAUGUA | 9678 | UACAUGGUU CAAAGACA | 2538 |
| 2382 | UUGUCUUU CUGAUGA GCCGUUAGGC GAA AACCAUGU | 9679 | ACAUGGUUC AAAGACAA | 2539 |
| 2403 | GAAUCUUC CUGAUGA GCCGUUAGGC GAA ACCAGGGU | 9680 | ACCCUGGUA GAAGAUUC | 2540 |
| 2410 | AAUGCCUG CUGAUGA GCCGUUAGGC GAA AUCUUCUA | 9681 | UAGAAGAUU CAGGCAUU | 2541 |
| 2411 | CAAUGCCU CUGAUGA GCCGUUAGGC GAA AAUCUUCU | 9682 | AGAAGAUUC AGGCAUUG | 2542 |
| 2418 | CUCAGUAC CUGAUGA GCCGUUAGGC GAA AUGCCUGA | 9683 | UCAGGCAUU GUACUGAG | 2543 |
| 2421 | UCUCUCAG CUGAUGA GCCGUUAGGC GAA ACAAUGCC | 9684 | GGCAUUGUA CUGAGAGA | 2544 |
| 2449 | CCUGCGGA CUGAUGA GCCGUUAGGC GAA AGUCAGGU | 9685 | ACCUGACUA UCCGCAGG | 2545 |
| 2451 | ACCCUGCG CUGAUGA GCCGUUAGGC GAA AUAGUCAG | 9686 | CUGACUAUC CGCAGGGU | 2546 |
| 2481 | CAGGUGUA CUGAUGA GCCGUUAGGC GAA AGGCCUCC | 9687 | GGAGGCCUC UACACCUG | 2547 |
| 2483 | GGCAGGUG CUGAUGA GCCGUUAGGC GAA AGAGGCCU | 8989 | AGGCCUCUA CACCUGCC | 1847 |
| 2505 | CAGCCAAG CUGAUGA GCCGUUAGGC GAA ACAUUGCA | 9688 | UGCAAUGUC CUUGGCUG | 2548 |
| 2508 | GCACAGCC CUGAUGA GCCGUUAGGC GAA AGGACAUU | 9689 | AAUGUCCUU GGCUGUGC | 2549 |
| 2532 | AUUAUGAA CUGAUGA GCCGUUAGGC GAA AGCGUCUC | 9690 | GAGACGCUC UUCAUAAU | 2550 |
| 2534 | CUAUUAUG CUGAUGA GCCGUUAGGC GAA AGAGCGUC | 9691 | GACGCUCUU CAUAAUAG | 2551 |
| 2535 | UCUAUUAU CUGAUGA GCCGUUAGGC GAA AAGAGCGU | 9692 | ACGCUCUUC AUAAUAGA | 2552 |
| 2538 | CCUUCUAU CUGAUGA GCCGUUAGGC GAA AUGAAGAG | 9693 | CUCUUCAUA AUAGAAGG | 2553 |

| | | | | |
|---|---|---|---|---|
| 2541 | GCACCUUC CUGAUGA GCCGUUAGGC GAA AUUAUGAA | 8999 | UUCAUAAUA GAAGGUGC | 1857 |
| 2567 | UGACUUCC CUGAUGA GCCGUUAGGC GAA AGUUGGUC | 9694 | GACCAACUU GGAAGUCA | 2554 |
| 2574 | AGGAUAAU CUGAUGA GCCGUUAGGC GAA ACUUCCAA | 9695 | UUGGAAGUC AUUAUCCU | 2555 |
| 2577 | ACGAGGAU CUGAUGA GCCGUUAGGC GAA AUGACUUC | 9696 | GAAGUCAUU AUCCUCGU | 2556 |
| 2578 | GACGAGGA CUGAUGA GCCGUUAGGC GAA AAUGACUU | 9697 | AAGUCAUUA UCCUCGUC | 2557 |
| 2580 | CCGACGAG CUGAUGA GCCGUUAGGC GAA AUAAUGAC | 9698 | GUCAUUAUC CUCGUCGG | 2558 |
| 2583 | GUGCCGAC CUGAUGA GCCGUUAGGC GAA AGGAUAAU | 9699 | AUUAUCCUC GUCGGCAC | 2559 |
| 2586 | GCAGUGCC CUGAUGA GCCGUUAGGC GAA ACGAGGAU | 9700 | AUCCUCGUC GGCACUGC | 2560 |
| 2601 | AACAUGGC CUGAUGA GCCGUUAGGC GAA AUCACUGC | 9701 | GCAGUGAUU GCCAUGUU | 2561 |
| 2609 | GCCAGAAG CUGAUGA GCCGUUAGGC GAA ACAUGGCA | 9009 | UGCCAUGUU CUUCUGGC | 1867 |
| 2610 | AGCCAGAA CUGAUGA GCCGUUAGGC GAA AACAUGGC | 9010 | GCCAUGUUC UUCUGGCU | 1868 |
| 2612 | GGAGCCAG CUGAUGA GCCGUUAGGC GAA AGAACAUG | 9702 | CAUGUUCUU CUGGCUCC | 2562 |
| 2613 | AGGAGCCA CUGAUGA GCCGUUAGGC GAA AAGAACAU | 9703 | AUGUUCUUC UGGCUCCU | 2563 |
| 2619 | ACAAGAAG CUGAUGA GCCGUUAGGC GAA AGCCAGAA | 9013 | UUCUGGCUC CUUCUUGU | 2564 |
| 2622 | AUGACAAG CUGAUGA GCCGUUAGGC GAA AGGAGCCA | 9704 | UGGCUCCUU CUUGUCAU | 2565 |
| 2623 | AAUGACAA CUGAUGA GCCGUUAGGC GAA AAGGAGCC | 9705 | GGCUCCUUC UUGUCAUU | 2566 |
| 2625 | ACAAUGAC CUGAUGA GCCGUUAGGC GAA AGAAGGAG | 9706 | CUCCUUCUU GUCAUUGU | 2567 |
| 2628 | AGGACAAU CUGAUGA GCCGUUAGGC GAA ACAAGAAG | 9707 | CUUCUUGUC AUUGUCCU | 2568 |
| 2631 | CGUAGGAC CUGAUGA GCCGUUAGGC GAA AUGACAAG | 9708 | CUUGUCAUU GUCCUACG | 2569 |
| 2634 | GUCCGUAG CUGAUGA GCCGUUAGGC GAA ACAAUGAC | 9709 | GUCAUUGUC CUACGGAC | 2570 |
| 2637 | ACGGUCCG CUGAUGA GCCGUUAGGC GAA AGGACAAU | 9710 | AUUGUCCUA CGGACCGU | 2571 |
| 2646 | GCCCGCUU CUGAUGA GCCGUUAGGC GAA ACGGUCCG | 9711 | CGGACCGUU AAGCGGGC | 2572 |
| 2647 | GGCCCGCU CUGAUGA GCCGUUAGGC GAA AACGGUCC | 9022 | GGACCGUUA AGCGGGCC | 1880 |
| 2681 | UAGACAAG CUGAUGA GCCGUUAGGC GAA AGCCUGUC | 9712 | GACAGGCUA CUUGUCUA | 2573 |
| 2684 | CAAUAGAC CUGAUGA GCCGUUAGGC GAA AGUAGCCU | 9713 | AGGCUACUU GUCUAUUG | 2574 |
| 2687 | UGACAAUA CUGAUGA GCCGUUAGGC GAA ACAAGUAG | 9714 | CUACUUGUC UAUUGUCA | 2575 |
| 2689 | CAUGACAA CUGAUGA GCCGUUAGGC GAA AGACAAGU | 9715 | ACUUGUCUA UUGUCAUG | 2576 |
| 2691 | UCCAUGAC CUGAUGA GCCGUUAGGC GAA AUAGACAA | 9716 | UUGUCUAUU GUCAUGGA | 2577 |
| 2694 | GGAUCCAU CUGAUGA GCCGUUAGGC GAA ACAAUAGA | 9717 | UCUAUUGUC AUGGAUCC | 2578 |
| 2701 | UUCAUCUG CUGAUGA GCCGUUAGGC GAA AUCCAUGA | 9028 | UCAUGGAUC CAGAUGAA | 1886 |
| 2711 | CCAAGGGC CUGAUGA GCCGUUAGGC GAA AUUCAUCU | 9718 | AGAUGAAUU GCCCUUGG | 2579 |
| 2717 | GCUCAUCC CUGAUGA GCCGUUAGGC GAA AGGGCAAU | 9719 | AUUGCCCUU GGAUGAGC | 2580 |
| 2738 | CAUAAGGC CUGAUGA GCCGUUAGGC GAA AGCGUUCA | 9720 | UGAACGCUU GCCUUAUG | 2581 |
| 2743 | GGCAUCAU CUGAUGA GCCGUUAGGC GAA AGGCAAGC | 9721 | GCUUGCCUU AUGAUGCC | 2582 |
| 2744 | UGGCAUCA CUGAUGA GCCGUUAGGC GAA AAGGCAAG | 9722 | CUUGCCUUA UGAUGCCA | 2583 |
| 2765 | CCCUGGGG CUGAUGA GCCGUUAGGC GAA AUUCCCAC | 9723 | GUGGGAAUU CCCCAGGG | 2584 |
| 2766 | UCCCUGGG CUGAUGA GCCGUUAGGC GAA AAUUCCCA | 9724 | UGGGAAUUC CCCAGGGA | 2585 |
| 2787 | GGUUUUCC CUGAUGA GCCGUUAGGC GAA AGUUUCAG | 9725 | CUGAAACUA GGAAAACC | 2586 |
| 2797 | GCGGCCAA CUGAUGA GCCGUUAGGC GAA AGGUUUUC | 9726 | GAAAACCUC UUGGCCGC | 2587 |

| | | | | |
|---|---|---|---|---|
| 2799 | CCGCGGCC CUGAUGA GCCGUUAGGC GAA AGAGGUUU | 9727 | AAACCUCUU GGCCGCGG | 2588 |
| 2813 | CUUGGCCG CUGAUGA GCCGUUAGGC GAA AGGCACCG | 9728 | CGGUGCCUU CGGCCAAG | 2589 |
| 2814 | ACUUGGCC CUGAUGA GCCGUUAGGC GAA AAGGCACC | 9729 | GGUGCCUUC GGCCAAGU | 2590 |
| 2826 | UCUGCCUC CUGAUGA GCCGUUAGGC GAA AUCACUUG | 9730 | CAAGUGAUU GAGGCAGA | 2591 |
| 2839 | AAUUCCAA CUGAUGA GCCGUUAGGC GAA AGCGUCUG | 9731 | CAGACGCUU UUGGAAUU | 2592 |
| 2840 | CAAUUCCA CUGAUGA GCCGUUAGGC GAA AAGCGUCU | 9732 | AGACGCUUU UGGAAUUG | 2593 |
| 2841 | UCAAUUCC CUGAUGA GCCGUUAGGC GAA AAAGCGUC | 9733 | GACGCUUUU GGAAUUGA | 2594 |
| 2847 | GUCUUGUC CUGAUGA GCCGUUAGGC GAA AUUCCAAA | 9045 | UUUGGAAUU GACAAGAC | 1903 |
| 2863 | UGUUUUGC CUGAUGA GCCGUUAGGC GAA AGUCGCUG | 9734 | CAGCGACUU GCAAAACA | 2595 |
| 2874 | UUGACGGC CUGAUGA GCCGUUAGGC GAA ACUGUUUU | 9735 | AAAACAGUA GCCGUCAA | 2596 |
| 2880 | AACAUCUU CUGAUGA GCCGUUAGGC GAA ACGGCUAC | 9736 | GUAGCCGUC AAGAUGUU | 2597 |
| 2888 | CUUCUUUC CUGAUGA GCCGUUAGGC GAA ACAUCUUG | 9737 | CAAGAUGUU GAAAGAAG | 2598 |
| 2917 | GAGGGCUC CUGAUGA GCCGUUAGGC GAA AUGCUCGC | 9738 | GCGAGCAUC GAGCCCUC | 2599 |
| 2925 | UCAGACAU CUGAUGA GCCGUUAGGC GAA AGGGCUCG | 9739 | CGAGCCCUC AUGUCUGA | 2600 |
| 2930 | UGAGUUCA CUGAUGA GCCGUUAGGC GAA ACAUGAGG | 9740 | CCUCAUGUC UGAACUCA | 2601 |
| 2937 | AGGAUCUU CUGAUGA GCCGUUAGGC GAA AGUUCAGA | 9054 | UCUGAACUC AAGAUCCU | 1912 |
| 2943 | UGGAUGAG CUGAUGA GCCGUUAGGC GAA AUCUUGAG | 9741 | CUCAAGAUC CUCAUCCA | 2602 |
| 2946 | AUGUGGAU CUGAUGA GCCGUUAGGC GAA AGGAUCUU | 9742 | AAGAUCCUC AUCCACAU | 2603 |
| 2949 | CCAAUGUG CUGAUGA GCCGUUAGGC GAA AUGAGGAU | 9743 | AUCCUCAUC CACAUUGG | 2604 |
| 2955 | UGGUGACC CUGAUGA GCCGUUAGGC GAA AUGUGGAU | 9744 | AUCCACAUU GGUCACCA | 2605 |
| 2959 | GAGAUGGU CUGAUGA GCCGUUAGGC GAA ACCAAUGU | 9745 | ACAUUGGUC ACCAUCUC | 2606 |
| 2965 | CACAUUGA CUGAUGA GCCGUUAGGC GAA AUGGUGAC | 9062 | GUCACCAUC UCAAUGUG | 1920 |
| 2967 | ACCACAUU CUGAUGA GCCGUUAGGC GAA AGAUGGUG | 9063 | CACCAUCUC AAUGUGGU | 1921 |
| 2982 | GCGCCUAG CUGAUGA GCCGUUAGGC GAA AGGUUCAC | 9746 | GUGAACCUC CUAGGCGC | 2607 |
| 2985 | CAGGCGCC CUGAUGA GCCGUUAGGC GAA AGGAGGUU | 9747 | AACCUCCUA GGCGCCUG | 2608 |
| 3013 | CACCAUGA CUGAUGA GCCGUUAGGC GAA AGGCCCUC | 9748 | GAGGGCCUC UCAUGGUG | 2609 |
| 3015 | AUCACCAU CUGAUGA GCCGUUAGGC GAA AGAGGCCC | 9749 | GGGCCUCUC AUGGUGAU | 2610 |
| 3024 | AAUUCCAC CUGAUGA GCCGUUAGGC GAA AUCACCAU | 9070 | AUGGUGAUU GUGGAAUU | 1928 |
| 3032 | ACUUGCAG CUGAUGA GCCGUUAGGC GAA AUUCCACA | 9750 | UGUGGAAUU CUGCAAGU | 2611 |
| 3033 | AACUUGCA CUGAUGA GCCGUUAGGC GAA AAUUCCAC | 9751 | GUGGAAUUC UGCAAGUU | 2612 |
| 3041 | GGUUUCCA CUGAUGA GCCGUUAGGC GAA ACUUGCAG | 9752 | CUGCAAGUU UGGAAACC | 2613 |
| 3042 | AGGUUUCC CUGAUGA GCCGUUAGGC GAA AACUUGCA | 9753 | UGCAAGUUU GGAAACCU | 2614 |
| 3051 | UAAGUUGA CUGAUGA GCCGUUAGGC GAA AGGUUUCC | 9754 | GGAAACCUA UCAACUUA | 2615 |
| 3053 | AGUAAGUU CUGAUGA GCCGUUAGGC GAA AUAGGUUU | 9755 | AAACCUAUC AACUUACU | 2616 |
| 3058 | CCGUAAGU CUGAUGA GCCGUUAGGC GAA AGUUGAUA | 9756 | UAUCAACUU ACUUACGG | 2617 |
| 3059 | CCCGUAAG CUGAUGA GCCGUUAGGC GAA AAGUUGAU | 9757 | AUCAACUUA CUUACGGG | 2618 |
| 3062 | UGCCCCGU CUGAUGA GCCGUUAGGC GAA AGUAAGUU | 9758 | AACUUACUU ACGGGGCA | 2619 |
| 3063 | UUGCCCCG CUGAUGA GCCGUUAGGC GAA AAGUAAGU | 9759 | ACUUACUUA CGGGGCAA | 2620 |
| 3083 | AGGGAACA CUGAUGA GCCGUUAGGC GAA AUUCAUUU | 9760 | AAAUGAAUU UGUUCCCU | 2621 |

| | | | | |
|---|---|---|---|---|
| 3084 | UAGGGAAC CUGAUGA GCCGUUAGGC GAA AAUUCAUU | 9761 | AAUGAAUUU GUUCCCUA | 2622 |
| 3087 | UUAUAGGG CUGAUGA GCCGUUAGGC GAA ACAAAUUC | 9762 | GAAUUUGUU CCCUAUAA | 2623 |
| 3088 | CUUAUAGG CUGAUGA GCCGUUAGGC GAA AACAAAUU | 9763 | AAUUUGUUC CCUAUAAG | 2624 |
| 3092 | UGCUCUUA CUGAUGA GCCGUUAGGC GAA AGGGAACA | 9764 | UGUUCCCUA UAAGAGCA | 2625 |
| 3094 | UUUGCUCU CUGAUGA GCCGUUAGGC GAA AUAGGGAA | 9765 | UUCCCUAUA AGAGCAAA | 2626 |
| 3113 | CCUGGCGG CUGAUGA GCCGUUAGGC GAA AGCGUGCC | 9766 | GGCACGCUU CCGCCAGG | 2627 |
| 3114 | CCCUGGCG CUGAUGA GCCGUUAGGC GAA AAGCGUGC | 9767 | GCACGCUUC CGCCAGGG | 2628 |
| 3131 | CCCCAACG CUGAUGA GCCGUUAGGC GAA AGUCCUUG | 9768 | CAAGGACUA CGUUGGGG | 2629 |
| 3135 | AGCUCCCC CUGAUGA GCCGUUAGGC GAA ACGUAGUC | 9769 | GACUACGUU GGGGAGCU | 2630 |
| 3144 | UCCACGGA CUGAUGA GCCGUUAGGC GAA AGCUCCCC | 9770 | GGGGAGCUC UCCGUGGA | 2631 |
| 3146 | GAUCCACG CUGAUGA GCCGUUAGGC GAA AGAGCUCC | 9771 | GGAGCUCUC CGUGGAUC | 2632 |
| 3154 | UCUUUUCA CUGAUGA GCCGUUAGGC GAA AUCCACGG | 9772 | CCGUGGAUC UGAAAAGA | 2633 |
| 3167 | UGCUGUCC CUGAUGA GCCGUUAGGC GAA AGCGUCUU | 9773 | AAGACGCUU GGACAGCA | 2634 |
| 3177 | CUGCUGGU CUGAUGA GCCGUUAGGC GAA AUGCUGUC | 9774 | GACAGCAUC ACCAGCAG | 2635 |
| 3194 | AGCUGGCA CUGAUGA GCCGUUAGGC GAA AGCUCUGG | 9775 | CCAGAGCUC UGCCAGCU | 2636 |
| 3203 | CAAAGCCU CUGAUGA GCCGUUAGGC GAA AGCUGGCA | 9776 | UGCCAGCUC AGGCUUUG | 2637 |
| 3209 | CCUCAACA CUGAUGA GCCGUUAGGC GAA AGCCUGAG | 9777 | CUCAGGCUU UGUUGAGG | 2638 |
| 3210 | UCCUCAAC CUGAUGA GCCGUUAGGC GAA AAGCCUGA | 9778 | UCAGGCUUU GUUGAGGA | 2639 |
| 3213 | UUCUCCUC CUGAUGA GCCGUUAGGC GAA ACAAAGCC | 9779 | GGCUUUGUU GAGGAGAA | 2640 |
| 3224 | CACUGAGC CUGAUGA GCCGUUAGGC GAA AUUUCUCC | 9780 | GGAGAAAUC GCUCAGUG | 2641 |
| 3228 | ACAUCACU CUGAUGA GCCGUUAGGC GAA AGCGAUUU | 9781 | AAAUCGCUC AGUGAUGU | 2642 |
| 3237 | UCUUCCUC CUGAUGA GCCGUUAGGC GAA ACAUCACU | 7644 | AGUGAUGUA GAGGAAGA | 2643 |
| 3253 | UUCUUCAG CUGAUGA GCCGUUAGGC GAA AGCUUCUU | 9782 | AAGAAGCUU CUGAAGAA | 2644 |
| 3254 | GUUCUUCA CUGAUGA GCCGUUAGGC GAA AAGCUUCU | 9783 | AGAAGCUUC UGAAGAAC | 2645 |
| 3266 | AGUCCUUG CUGAUGA GCCGUUAGGC GAA ACAGUUCU | 9784 | AGAACUGUA CAAGGACU | 2646 |
| 3275 | AGGUCAGG CUGAUGA GCCGUUAGGC GAA AGUCCUUG | 9785 | CAAGGACUU CCUGACCU | 2647 |
| 3276 | AAGGUCAG CUGAUGA GCCGUUAGGC GAA AAGUCCUU | 9104 | AAGGACUUC CUGACCUU | 1962 |
| 3284 | GAUGCUCC CUGAUGA GCCGUUAGGC GAA AGGUCAGG | 9105 | CCUGACCUU GGAGCAUC | 1963 |
| 3292 | ACAGAUGA CUGAUGA GCCGUUAGGC GAA AUGCUCCA | 9106 | UGGAGCAUC UCAUCUGU | 1964 |
| 3294 | UAACAGAU CUGAUGA GCCGUUAGGC GAA AGAUGCUC | 9107 | GAGCAUCUC AUCUGUUA | 1965 |
| 3297 | CUGUAACA CUGAUGA GCCGUUAGGC GAA AUGAGAUG | 9108 | CAUCUCAUC UGUUACAG | 1966 |
| 3301 | GAAGCUGU CUGAUGA GCCGUUAGGC GAA ACAGAUGA | 9109 | UCAUCUGUU ACAGCUUC | 1967 |
| 3302 | GGAAGCUG CUGAUGA GCCGUUAGGC GAA AACAGAUG | 9110 | CAUCUGUUA CAGCUUCC | 1968 |
| 3308 | CCACUUGG CUGAUGA GCCGUUAGGC GAA AGCUGUAA | 9111 | UUACAGCUU CCAAGUGG | 1969 |
| 3309 | GCCACUUG CUGAUGA GCCGUUAGGC GAA AAGCUGUA | 9112 | UACAGCUUC CAAGUGGC | 1970 |
| 3319 | CAUGCCCU CUGAUGA GCCGUUAGGC GAA AGCCACUU | 9113 | AAGUGGCUA AGGGCAUG | 1971 |
| 3332 | AUGCCAAG CUGAUGA GCCGUUAGGC GAA ACUCCAUG | 9114 | CAUGGAGUU CUUGGCAU | 1972 |
| 3333 | GAUGCCAA CUGAUGA GCCGUUAGGC GAA AACUCCAU | 9115 | AUGGAGUUC UUGGCAUC | 1973 |
| 3335 | UUGAUGCC CUGAUGA GCCGUUAGGC GAA AGAACUCC | 9786 | GGAGUUCUU GGCAUCAA | 2648 |

153

| | | | | |
|---|---|---|---|---|
| 3341 | ACUUCCUU CUGAUGA GCCGUUAGGC GAA AUGCCAAG | 9787 | CUUGGCAUC AAGGAAGU | 2649 |
| 3352 | CCUGUGGA CUGAUGA GCCGUUAGGC GAA ACACUUCC | 9788 | GGAAGUGUA UCCACAGG | 2650 |
| 3354 | UCCCUGUG CUGAUGA GCCGUUAGGC GAA AUACACUU | 9119 | AAGUGUAUC CACAGGGA | 1977 |
| 3381 | GAUAGGAG CUGAUGA GCCGUUAGGC GAA AUGUUUCG | 9789 | CGAAACAUU CUCCUAUC | 2651 |
| 3382 | CGAUAGGA CUGAUGA GCCGUUAGGC GAA AAUGUUUC | 9790 | GAAACAUUC UCCUAUCG | 2652 |
| 3384 | UCCGAUAG CUGAUGA GCCGUUAGGC GAA AGAAUGUU | 9791 | AACAUUCUC CUAUCGGA | 2653 |
| 3387 | UUCUCCGA CUGAUGA GCCGUUAGGC GAA AGGAGAAU | 9792 | AUUCUCCUA UCGGAGAA | 2654 |
| 3389 | UCUUCUCC CUGAUGA GCCGUUAGGC GAA AUAGGAGA | 9793 | UCUCCUAUC GGAGAAGA | 2655 |
| 3405 | CAGAUCUU CUGAUGA GCCGUUAGGC GAA ACCACAUU | 9794 | AAUGUGGUU AAGAUCUG | 2656 |
| 3406 | ACAGAUCU CUGAUGA GCCGUUAGGC GAA AACCACAU | 9795 | AUGUGGUUA AGAUCUGU | 2657 |
| 3411 | AAGUCACA CUGAUGA GCCGUUAGGC GAA AUCUUAAC | 9796 | GUUAAGAUC UGUGACUU | 2658 |
| 3419 | CCAAGCCG CUGAUGA GCCGUUAGGC GAA AGUCACAG | 9797 | CUGUGACUU CGGCUUGG | 2659 |
| 3420 | GCCAAGCC CUGAUGA GCCGUUAGGC GAA AAGUCACA | 9130 | UGUGACUUC GGCUUGGC | 2660 |
| 3425 | CCCGGGCC CUGAUGA GCCGUUAGGC GAA AGCCGAAG | 9798 | CUUCGGCUU GGCCCGGG | 2661 |
| 3438 | UCUUUAUA CUGAUGA GCCGUUAGGC GAA AUGUCCCG | 9799 | CGGGACAUU UAUAAAGA | 2662 |
| 3439 | GUCUUUAU CUGAUGA GCCGUUAGGC GAA AAUGUCCC | 9800 | GGGACAUUU AUAAAGAC | 2663 |
| 3440 | GGUCUUUA CUGAUGA GCCGUUAGGC GAA AAAUGUCC | 9801 | GGACAUUUA UAAAGACC | 2664 |
| 3442 | CGGGUCUU CUGAUGA GCCGUUAGGC GAA AUAAAUGU | 9802 | ACAUUUAUA AAGACCCG | 2665 |
| 3454 | UCUGACAU CUGAUGA GCCGUUAGGC GAA AUCCGGGU | 9803 | ACCCGGAUU AUGUCAGA | 2666 |
| 3455 | UUCUGACA CUGAUGA GCCGUUAGGC GAA AAUCCGGG | 9804 | CCCGGAUUA UGUCAGAA | 2667 |
| 3459 | CCUUUUCU CUGAUGA GCCGUUAGGC GAA ACAUAAUC | 9140 | GAUUAUGUC AGAAAAGG | 1998 |
| 3480 | UUCAAAGG CUGAUGA GCCGUUAGGC GAA AGUCGGGC | 9805 | GCCCGACUC CCUUUGAA | 2668 |
| 3484 | CCACUUCA CUGAUGA GCCGUUAGGC GAA AGGGAGUC | 9806 | GACUCCCUU UGAAGUGG | 2669 |
| 3485 | UCCACUUC CUGAUGA GCCGUUAGGC GAA AAGGGAGU | 9807 | ACUCCCUUU GAAGUGGA | 2670 |
| 3510 | CUGUCAAA CUGAUGA GCCGUUAGGC GAA AUGGUUUC | 9808 | GAAACCAUU UUUGACAG | 2671 |
| 3511 | UCUGUCAA CUGAUGA GCCGUUAGGC GAA AAUGGUUU | 9809 | AAACCAUUU UUGACAGA | 2672 |
| 3512 | CUCUGUCA CUGAUGA GCCGUUAGGC GAA AAAUGGUU | 9810 | AACCAUUUU UGACAGAG | 2673 |
| 3513 | ACUCUGUC CUGAUGA GCCGUUAGGC GAA AAAAUGGU | 9811 | ACCAUUUUU GACAGAGU | 2674 |
| 3522 | AUUGUGUA CUGAUGA GCCGUUAGGC GAA ACUCUGUC | 9812 | GACAGAGUA UACACAAU | 2675 |
| 3524 | GAAUUGUG CUGAUGA GCCGUUAGGC GAA AUACUCUG | 9813 | CAGAGUAUA CACAAUUC | 2676 |
| 3531 | UCGCUCUG CUGAUGA GCCGUUAGGC GAA AUUGUGUA | 9814 | UACACAAUU CAGAGCGA | 2677 |
| 3532 | AUCGCUCU CUGAUGA GCCGUUAGGC GAA AAUUGUGU | 9815 | ACACAAUUC AGAGCGAU | 2678 |
| 3548 | CACCGAAA CUGAUGA GCCGUUAGGC GAA ACCACACA | 9816 | UGUGUGGUC UUUCGGUG | 2679 |
| 3550 | CACACCGA CUGAUGA GCCGUUAGGC GAA AGACCACA | 9817 | UGUGGUCUU UCGGUGUG | 2680 |
| 3551 | ACACACCG CUGAUGA GCCGUUAGGC GAA AAGACCAC | 9818 | GUGGUCUUU CGGUGUGU | 2681 |
| 3552 | AACACACC CUGAUGA GCCGUUAGGC GAA AAAGACCA | 9819 | UGGUCUUUC GGUGUGUU | 2682 |
| 3560 | CCCAGAGC CUGAUGA GCCGUUAGGC GAA ACACACCG | 9820 | CGGUGUGUU GCUCUGGG | 2683 |
| 3564 | AUUUCCCA CUGAUGA GCCGUUAGGC GAA AGCAACAC | 9821 | GUGUUGCUC UGGGAAAU | 2684 |
| 3573 | AAGGAAAA CUGAUGA GCCGUUAGGC GAA AUUUCCCA | 9159 | UGGGAAAUA UUUUCCUU | 2017 |

154

| | | | | |
|---|---|---|---|---|
| 3575 | CUAAGGAA CUGAUGA GCCGUUAGGC GAA AUAUUUCC | 9160 | GGAAAUAUU UUCCUUAG | 2018 |
| 3576 | CCUAAGGA CUGAUGA GCCGUUAGGC GAA AAUAUUUC | 9161 | GAAAUAUUU UCCUUAGG | 2019 |
| 3577 | ACCUAAGG CUGAUGA GCCGUUAGGC GAA AAAUAUUU | 9162 | AAAUAUUUU CCUUAGGU | 2020 |
| 3578 | CACCUAAG CUGAUGA GCCGUUAGGC GAA AAAAUAUU | 9163 | AAUAUUUUC CUUAGGUG | 2021 |
| 3581 | AGGCACCU CUGAUGA GCCGUUAGGC GAA AGGAAAAU | 9822 | AUUUUCCUU AGGUGCCU | 2685 |
| 3582 | GAGGCACC CUGAUGA GCCGUUAGGC GAA AAGGAAAA | 9823 | UUUUCCUUA GGUGCCUC | 2686 |
| 3590 | GGUAUGGG CUGAUGA GCCGUUAGGC GAA AGGCACCU | 9824 | AGGUGCCUC CCCAUACC | 2687 |
| 3596 | CCCCAGGG CUGAUGA GCCGUUAGGC GAA AUGGGGAG | 9825 | CUCCCCAUA CCCUGGGG | 2688 |
| 3606 | UCAAUCUU CUGAUGA GCCGUUAGGC GAA ACCCCAGG | 9171 | CCUGGGGUC AAGAUUGA | 2689 |
| 3612 | UCUUCAUC CUGAUGA GCCGUUAGGC GAA AUCUUGAC | 9826 | GUCAAGAUU GAUGAAGA | 2690 |
| 3623 | UCCUACAA CUGAUGA GCCGUUAGGC GAA AUUCUUCA | 9827 | UGAAGAAUU UUGUAGGA | 2691 |
| 3624 | CUCCUACA CUGAUGA GCCGUUAGGC GAA AAUUCUUC | 9828 | GAAGAAUUU UGUAGGAG | 2692 |
| 3625 | UCUCCUAC CUGAUGA GCCGUUAGGC GAA AAAUUCUU | 9829 | AAGAAUUUU GUAGGAGA | 2693 |
| 3628 | CAAUCUCC CUGAUGA GCCGUUAGGC GAA ACAAAAUU | 9830 | AAUUUUGUA GGAGAUUG | 2694 |
| 3635 | CUUCUUUC CUGAUGA GCCGUUAGGC GAA AUCUCCUA | 9831 | UAGGAGAUU GAAAGAAG | 2695 |
| 3649 | CCGCAUUC CUGAUGA GCCGUUAGGC GAA AGUUCCUU | 9832 | AAGGAACUA GAAUGCGG | 2696 |
| 3661 | GUAGUCAG CUGAUGA GCCGUUAGGC GAA AGCCCGCA | 9833 | UGCGGGCUC CUGACUAC | 2697 |
| 3668 | GGGUAGUG CUGAUGA GCCGUUAGGC GAA AGUCAGGA | 9834 | UCCUGACUA CACUACCC | 2698 |
| 3673 | UUCUGGGG CUGAUGA GCCGUUAGGC GAA AGUGUAGU | 9835 | ACUACACUA CCCCAGAA | 2699 |
| 3686 | UGGUCUGG CUGAUGA GCCGUUAGGC GAA ACAUUUCU | 9183 | AGAAAUGUA CCAGACCA | 2041 |
| 3734 | CUGAAAAC CUGAUGA GCCGUUAGGC GAA AGGGUCUC | 9836 | GAGACCCUC GUUUUCAG | 2700 |
| 3737 | ACUCUGAA CUGAUGA GCCGUUAGGC GAA ACGAGGGU | 9837 | ACCCUCGUU UUCAGAGU | 2701 |
| 3738 | AACUCUGA CUGAUGA GCCGUUAGGC GAA AACGAGGG | 9838 | CCCUCGUUU UCAGAGUU | 2702 |
| 3739 | CAACUCUG CUGAUGA GCCGUUAGGC GAA AAACGAGG | 9839 | CCUCGUUUU CAGAGUUG | 2703 |
| 3740 | CCAACUCU CUGAUGA GCCGUUAGGC GAA AAAACGAG | 9840 | CUCGUUUUC AGAGUUGG | 2704 |
| 3746 | GCUCCACC CUGAUGA GCCGUUAGGC GAA ACUCUGAA | 9841 | UUCAGAGUU GGUGGAGC | 2705 |
| 3757 | GUUUCCCA CUGAUGA GCCGUUAGGC GAA AUGCUCCA | 9842 | UGGAGCAUU UGGGAAAC | 2706 |
| 3758 | GGUUUCCC CUGAUGA GCCGUUAGGC GAA AAUGCUCC | 9843 | GGAGCAUUU GGGAAACC | 2707 |
| 3768 | GCUUGCAG CUGAUGA GCCGUUAGGC GAA AGGUUUCC | 9844 | GGAAACCUC CUGCAAGC | 2708 |
| 3803 | GAACAAUA CUGAUGA GCCGUUAGGC GAA AGUCUUUG | 9845 | CAAAGACUA UAUUGUUC | 2709 |
| 3805 | AAGAACAA CUGAUGA GCCGUUAGGC GAA AUAGUCUU | 9846 | AAGACUAUA UUGUUCUU | 2710 |
| 3807 | GGAAGAAC CUGAUGA GCCGUUAGGC GAA AUAUAGUC | 9847 | GACUAUAUU GUUCUUCC | 2711 |
| 3810 | AUUGGAAG CUGAUGA GCCGUUAGGC GAA ACAAUAUA | 9848 | UAUAUUGUU CUUCCAAU | 2712 |
| 3811 | CAUUGGAA CUGAUGA GCCGUUAGGC GAA AACAAUAU | 9849 | AUAUUGUUC UUCCAAUG | 2713 |
| 3813 | GACAUUGG CUGAUGA GCCGUUAGGC GAA AGAACAAU | 9850 | AUUGUUCUU CCAAUGUC | 2714 |
| 3814 | UGACAUUG CUGAUGA GCCGUUAGGC GAA AAGAACAA | 9851 | UUGUUCUUC CAAUGUCA | 2715 |
| 3821 | GUGUCUCU CUGAUGA GCCGUUAGGC GAA ACAUUGGA | 9852 | UCCAAUGUC AGAGACAC | 2716 |
| 3847 | GAGUCCAG CUGAUGA GCCGUUAGGC GAA AUCCUCUU | 9207 | AAGAGGAUU CUGGACUC | 2065 |
| 3848 | AGAGUCCA CUGAUGA GCCGUUAGGC GAA AAUCCUCU | 9208 | AGAGGAUUC UGGACUCU | 2066 |

155

| | | | | |
|---|---|---|---|---|
| 3855 | GGCAGGGA CUGAUGA GCCGUUAGGC GAA AGUCCAGA | 9853 | UCUGGACUC UCCCUGCC | 2717 |
| 3857 | UAGGCAGG CUGAUGA GCCGUUAGGC GAA AGAGUCCA | 9854 | UGGACUCUC CCUGCCUA | 2718 |
| 3865 | AGGUGAGG CUGAUGA GCCGUUAGGC GAA AGGCAGGG | 9855 | CCCUGCCUA CCUCACCU | 2719 |
| 3869 | AAACAGGU CUGAUGA GCCGUUAGGC GAA AGGUAGGC | 9213 | GCCUACCUC ACCUGUUU | 2071 |
| 3876 | AUACAGGA CUGAUGA GCCGUUAGGC GAA ACAGGUGA | 9214 | UCACCUGUU UCCUGUAU | 2072 |
| 3877 | CAUACAGG CUGAUGA GCCGUUAGGC GAA AACAGGUG | 9215 | CACCUGUUU CCUGUAUG | 2073 |
| 3878 | CCAUACAG CUGAUGA GCCGUUAGGC GAA AAACAGGU | 9216 | ACCUGUUUC CUGUAUGG | 2074 |
| 3883 | UUCCUCCA CUGAUGA GCCGUUAGGC GAA ACAGGAAA | 9856 | UUUCCUGUA UGGAGGAA | 2720 |
| 3914 | CAUAAUGG CUGAUGA GCCGUUAGGC GAA AUUUGGGG | 9219 | CCCCAAAUU CCAUUAUG | 2077 |
| 3915 | UCAUAAUG CUGAUGA GCCGUUAGGC GAA AAUUUGGG | 9220 | CCCAAAUUC CAUUAUGA | 2078 |
| 3919 | GUUGUCAU CUGAUGA GCCGUUAGGC GAA AUGGAAUU | 9221 | AAUUCCAUU AUGACAAC | 2079 |
| 3920 | UGUUGUCA CUGAUGA GCCGUUAGGC GAA AAUGGAAU | 9222 | AUUCCAUUA UGACAACA | 2080 |
| 3939 | UAAUGACU CUGAUGA GCCGUUAGGC GAA AUUCCUGC | 9857 | GCAGGAAUC AGUCAUUA | 2721 |
| 3943 | GAGAUAAU CUGAUGA GCCGUUAGGC GAA ACUGAUUC | 9858 | GAAUCAGUC AUUAUCUC | 2722 |
| 3946 | CUGGAGAU CUGAUGA GCCGUUAGGC GAA AUGACUGA | 9859 | UCAGUCAUU AUCUCCAG | 2723 |
| 3947 | UCUGGAGA CUGAUGA GCCGUUAGGC GAA AAUGACUG | 9860 | CAGUCAUUA UCUCCAGA | 2724 |
| 3949 | GUUCUGGA CUGAUGA GCCGUUAGGC GAA AUAAUGAC | 9861 | GUCAUUAUC UCCAGAAC | 2725 |
| 3951 | CUGUUCUG CUGAUGA GCCGUUAGGC GAA AGAUAAUG | 9862 | CAUUAUCUC CAGAACAG | 2726 |
| 3961 | CUUUCGCU CUGAUGA GCCGUUAGGC GAA ACUGUUCU | 9227 | AGAACAGUA AGCGAAAG | 2085 |
| 3987 | AAUGUUUU CUGAUGA GCCGUUAGGC GAA ACACUCAC | 9228 | GUGAGUGUA AAAACAUU | 2086 |
| 3995 | UAUCUUCA CUGAUGA GCCGUUAGGC GAA AUGUUUUU | 9229 | AAAAACAUU UGAAGAUA | 2087 |
| 3996 | AUAUCUUC CUGAUGA GCCGUUAGGC GAA AAUGUUUU | 9230 | AAAACAUUU GAAGAUAU | 2088 |
| 4003 | CAAUGGGA CUGAUGA GCCGUUAGGC GAA AUCUUCAA | 9863 | UUGAAGAUA UCCCAUUG | 2727 |
| 4005 | UCCAAUGG CUGAUGA GCCGUUAGGC GAA AUAUCUUC | 9864 | GAAGAUAUC CCAUUGGA | 2728 |
| 4010 | GUUCCUCC CUGAUGA GCCGUUAGGC GAA AUGGGAUA | 9865 | UAUCCCAUU GGAGGAAC | 2729 |
| 4026 | AUCACUUU CUGAUGA GCCGUUAGGC GAA ACUUCUGG | 9866 | CCAGAAGUA AAAGUGAU | 2730 |
| 4035 | UCAUCUGG CUGAUGA GCCGUUAGGC GAA AUCACUUU | 9867 | AAAGUGAUC CCAGAUGA | 2731 |
| 4068 | GAUGCAAG CUGAUGA GCCGUUAGGC GAA ACCAUCCC | 9868 | GGGAUGGUC CUUGCAUC | 2732 |
| 4071 | UCUGAUGC CUGAUGA GCCGUUAGGC GAA AGGACCAU | 9869 | AUGGUCCUU GCAUCAGA | 2733 |
| 4076 | GCUCUUCU CUGAUGA GCCGUUAGGC GAA AUGCAAGG | 9870 | CCUUGCAUC AGAAGAGC | 2734 |
| 4093 | GUCUUCCA CUGAUGA GCCGUUAGGC GAA AGUUUUCA | 9243 | UGAAAACUC UGGAAGAC | 2735 |
| 4112 | AUGGAGAU CUGAUGA GCCGUUAGGC GAA AUUUGUUC | 9871 | GAACAAAUU AUCUCCAU | 2736 |
| 4113 | GAUGGAGA CUGAUGA GCCGUUAGGC GAA AAUUUGUU | 9872 | AACAAAUUA UCUCCAUC | 2737 |
| 4115 | AAGAUGGA CUGAUGA GCCGUUAGGC GAA AUAAUUUG | 9247 | CAAAUUAUC UCCAUCUU | 2105 |
| 4117 | AAAAGAUG CUGAUGA GCCGUUAGGC GAA AGAUAAUU | 9248 | AAUUAUCUC CAUCUUUU | 2106 |
| 4121 | CACCAAAA CUGAUGA GCCGUUAGGC GAA AUGGAGAU | 9249 | AUCUCCAUC UUUUGGUG | 2107 |
| 4123 | UCCACCAA CUGAUGA GCCGUUAGGC GAA AGAUGGAG | 9250 | CUCCAUCUU UUGGUGGA | 2108 |
| 4124 | UUCCACCA CUGAUGA GCCGUUAGGC GAA AAGAUGGA | 9251 | UCCAUCUUU UGGUGGAA | 2109 |
| 4125 | AUUCCACC CUGAUGA GCCGUUAGGC GAA AAAGAUGG | 9252 | CCAUCUUUU GGUGGAAU | 2110 |

| | | | | |
|---|---|---|---|---|
| 4144 | CCUGCUUU CUGAUGA GCCGUUAGGC GAA ACUGGGCA | 9873 | UGCCCAGUA AAAGCAGG | 2738 |
| 4157 | AGGCCACA CUGAUGA GCCGUUAGGC GAA ACUCCCUG | 9874 | CAGGGAGUC UGUGGCCU | 2739 |
| 4166 | AGCCUUCC CUGAUGA GCCGUUAGGC GAA AGGCCACA | 9875 | UGUGGCCUC GGAAGGCU | 2740 |
| 4175 | UCUGGUUG CUGAUGA GCCGUUAGGC GAA AGCCUUCC | 9876 | GGAAGGCUC CAACCAGA | 2741 |
| 4193 | CAGACUGG CUGAUGA GCCGUUAGGC GAA AGCCACUG | 9877 | CAGUGGCUA CCAGUCUG | 2742 |
| 4199 | GAUACCCA CUGAUGA GCCGUUAGGC GAA ACUGGUAG | 9878 | CUACCAGUC UGGGUAUC | 2743 |
| 4205 | CUGAGUGA CUGAUGA GCCGUUAGGC GAA ACCCAGAC | 9879 | GUCUGGGUA UCACUCAG | 2744 |
| 4207 | AUCUGAGU CUGAUGA GCCGUUAGGC GAA AUACCCAG | 9880 | CUGGGUAUC ACUCAGAU | 2745 |
| 4211 | UGUCAUCU CUGAUGA GCCGUUAGGC GAA AGUGAUAC | 9881 | GUAUCACUC AGAUGACA | 2746 |
| 4235 | CGCUGGAG CUGAUGA GCCGUUAGGC GAA ACACGGUG | 9882 | CACCGUGUA CUCCAGCG | 2747 |
| 4238 | CGUCGCUG CUGAUGA GCCGUUAGGC GAA AGUACACG | 9883 | CGUGUACUC CAGCGACG | 2748 |
| 4257 | AUCUUUAA CUGAUGA GCCGUUAGGC GAA AGUCCUGC | 9884 | GCAGGACUU UUAAAGAU | 2749 |
| 4258 | CAUCUUUA CUGAUGA GCCGUUAGGC GAA AAGUCCUG | 9885 | CAGGACUUU UAAAGAUG | 2750 |
| 4259 | CCAUCUUU CUGAUGA GCCGUUAGGC GAA AAAGUCCU | 9886 | AGGACUUUU AAAGAUGG | 2751 |
| 4260 | ACCAUCUU CUGAUGA GCCGUUAGGC GAA AAAAGUCC | 9887 | GGACUUUUA AAGAUGGU | 2752 |
| 4281 | UCAGCGUG CUGAUGA GCCGUUAGGC GAA ACUGCAGC | 9888 | GCUGCAGUU CACGCUGA | 2753 |
| 4282 | GUCAGCGU CUGAUGA GCCGUUAGGC GAA AACUGCAG | 9889 | CUGCAGUUC ACGCUGAC | 2754 |
| 4292 | UGGUCCCU CUGAUGA GCCGUUAGGC GAA AGUCAGCG | 9890 | CGCUGACUC AGGGACCA | 2755 |
| 4311 | CAGGAGGU CUGAUGA GCCGUUAGGC GAA AGCUGCAG | 9891 | CUGCAGCUC ACCUCCUG | 2756 |
| 4316 | UUAAACAG CUGAUGA GCCGUUAGGC GAA AGGUGAGC | 9892 | GCUCACCUC CUGUUUAA | 2757 |
| 4321 | UCCAUUUA CUGAUGA GCCGUUAGGC GAA ACAGGAGG | 9893 | CCUCCUGUU UAAAUGGA | 2758 |
| 4322 | UUCCAUUU CUGAUGA GCCGUUAGGC GAA AACAGGAG | 9894 | CUCCUGUUU AAAUGGAA | 2759 |
| 4323 | CUUCCAUU CUGAUGA GCCGUUAGGC GAA AAACAGGA | 9895 | UCCUGUUUA AAUGGAAG | 2760 |
| 4336 | CGGGACAG CUGAUGA GCCGUUAGGC GAA ACCACUUC | 9896 | GAAGUGGUC CUGUCCCG | 2761 |
| 4341 | GGAGCCGG CUGAUGA GCCGUUAGGC GAA ACAGGACC | 9897 | GGUCCUGUC CCGGCUCC | 2762 |
| 4348 | UGGGGGCG CUGAUGA GCCGUUAGGC GAA AGCCGGGA | 9898 | UCCCGGCUC CGCCCCCA | 2763 |
| 4360 | AUUUCCAG CUGAUGA GCCGUUAGGC GAA AGUUGGGG | 9899 | CCCCAACUC CUGGAAAU | 2764 |
| 4369 | UCUCUCGU CUGAUGA GCCGUUAGGC GAA AUUUCCAG | 9900 | CUGGAAAUC ACGAGAGA | 2765 |
| 4387 | GAAAAUCU CUGAUGA GCCGUUAGGC GAA AGCAGCAC | 9901 | GUGCUGCUU AGAUUUUC | 2766 |
| 4388 | UGAAAAUC CUGAUGA GCCGUUAGGC GAA AAGCAGCA | 9902 | UGCUGCUUA GAUUUUCA | 2767 |
| 4392 | CACUUGAA CUGAUGA GCCGUUAGGC GAA AUCUAAGC | 9903 | GCUUAGAUU UUCAAGUG | 2768 |
| 4393 | ACACUUGA CUGAUGA GCCGUUAGGC GAA AAUCUAAG | 9904 | CUUAGAUUU UCAAGUGU | 2769 |
| 4394 | AACACUUG CUGAUGA GCCGUUAGGC GAA AAAUCUAA | 9905 | UUAGAUUUU CAAGUGUU | 2770 |
| 4395 | CAACACUU CUGAUGA GCCGUUAGGC GAA AAAAUCUA | 9906 | UAGAUUUUC AAGUGUUG | 2771 |
| 4402 | GAAAGAAC CUGAUGA GCCGUUAGGC GAA ACACUUGA | 9907 | UCAAGUGUU GUUCUUUC | 2772 |
| 4405 | GUGGAAAG CUGAUGA GCCGUUAGGC GAA ACAACACU | 9288 | AGUGUUGUU CUUUCCAC | 2146 |
| 4406 | GGUGGAAA CUGAUGA GCCGUUAGGC GAA AACAACAC | 9289 | GUGUUGUUC UUUCCACC | 2147 |
| 4408 | GUGGUGGA CUGAUGA GCCGUUAGGC GAA AGAACAAC | 9908 | GUUGUUCUU UCCACCAC | 2773 |
| 4409 | GGUGGUGG CUGAUGA GCCGUUAGGC GAA AAGAACAA | 9909 | UUGUUCUUU CCACCACC | 2774 |

157

| | | | | |
|---|---|---|---|---|
| 4410 | GGGUGGUG CUGAUGA GCCGUUAGGC GAA AAAGAACA | 9910 | UGUUCUUUC CACCACCC | 2775 |
| 4425 | AAUGUGGC CUGAUGA GCCGUUAGGC GAA ACUUCCGG | 9911 | CCGGAAGUA GCCACAUU | 2776 |
| 4433 | GAAAAUCA CUGAUGA GCCGUUAGGC GAA AUGUGGCU | 9912 | AGCCACAUU UGAUUUUC | 2777 |
| 4434 | UGAAAAUC CUGAUGA GCCGUUAGGC GAA AAUGUGGC | 9913 | GCCACAUUU GAUUUUCA | 2778 |
| 4438 | AAAAUGAA CUGAUGA GCCGUUAGGC GAA AUCAAAUG | 9914 | CAUUUGAUU UUCAUUUU | 2779 |
| 4439 | AAAAAUGA CUGAUGA GCCGUUAGGC GAA AAUCAAAU | 9915 | AUUUGAUUU UCAUUUUU | 2780 |
| 4440 | CAAAAAUG CUGAUGA GCCGUUAGGC GAA AAAUCAAA | 9916 | UUUGAUUUU CAUUUUUG | 2781 |
| 4441 | CCAAAAAU CUGAUGA GCCGUUAGGC GAA AAAAUCAA | 9917 | UUGAUUUUC AUUUUUGG | 2782 |
| 4444 | CCUCCAAA CUGAUGA GCCGUUAGGC GAA AUGAAAAU | 9918 | AUUUUCAUU UUUGGAGG | 2783 |
| 4445 | UCCUCCAA CUGAUGA GCCGUUAGGC GAA AAUGAAAA | 9919 | UUUUCAUUU UUGGAGGA | 2784 |
| 4446 | CUCCUCCA CUGAUGA GCCGUUAGGC GAA AAAUGAAA | 9920 | UUUCAUUUU UGGAGGAG | 2785 |
| 4447 | CCUCCUCC CUGAUGA GCCGUUAGGC GAA AAAAUGAA | 9921 | UUCAUUUUU GGAGGAGG | 2786 |
| 4461 | UGCAGUCU CUGAUGA GCCGUUAGGC GAA AGGUCCCU | 9922 | AGGGACCUC AGACUGCA | 2787 |
| 4477 | CUGAGGAC CUGAUGA GCCGUUAGGC GAA AGCUCCUU | 9923 | AAGGAGCUU GUCCUCAG | 2788 |
| 4480 | GCCCUGAG CUGAUGA GCCGUUAGGC GAA ACAAGCUC | 9924 | GAGCUUGUC CUCAGGGC | 2789 |
| 4483 | AAUGCCCU CUGAUGA GCCGUUAGGC GAA AGGACAAG | 9925 | CUUGUCCUC AGGGCAUU | 2790 |
| 4491 | UCUCUGGA CUGAUGA GCCGUUAGGC GAA AUGCCCUG | 9926 | CAGGGCAUU UCCAGAGA | 2791 |
| 4492 | UUCUCUGG CUGAUGA GCCGUUAGGC GAA AAUGCCCU | 9927 | AGGGCAUUU CCAGAGAA | 2792 |
| 4493 | CUUCUCUG CUGAUGA GCCGUUAGGC GAA AAAUGCCC | 9928 | GGGCAUUUC CAGAGAAG | 2793 |
| 4525 | GUAGAGUC CUGAUGA GCCGUUAGGC GAA ACACAUUC | 9929 | GAAUGUGUU GACUCUAC | 2794 |
| 4530 | AGAGAGUA CUGAUGA GCCGUUAGGC GAA AGUCAACA | 9930 | UGUUGACUC UACUCUCU | 2795 |
| 4532 | AAAGAGAG CUGAUGA GCCGUUAGGC GAA AGAGUCAA | 9931 | UUGACUCUA CUCUCUUU | 2796 |
| 4535 | GGAAAAGA CUGAUGA GCCGUUAGGC GAA AGUAGAGU | 9932 | ACUCUACUC UCUUUUCC | 2797 |
| 4537 | AUGGAAAA CUGAUGA GCCGUUAGGC GAA AGAGUAGA | 9933 | UCUACUCUC UUUUCCAU | 2798 |
| 4539 | GAAUGGAA CUGAUGA GCCGUUAGGC GAA AGAGAGUA | 9934 | UACUCUCUU UUCCAUUC | 2799 |
| 4540 | UGAAUGGA CUGAUGA GCCGUUAGGC GAA AAGAGAGU | 9935 | ACUCUCUUU UCCAUUCA | 2800 |
| 4541 | AUGAAUGG CUGAUGA GCCGUUAGGC GAA AAAGAGAG | 9936 | CUCUCUUUU CCAUUCAU | 2801 |
| 4542 | AAUGAAUG CUGAUGA GCCGUUAGGC GAA AAAAGAGA | 9937 | UCUCUUUUC CAUUCAUU | 2802 |
| 4546 | UUUAAAUG CUGAUGA GCCGUUAGGC GAA AUGGAAAA | 9938 | UUUUCCAUU CAUUUAAA | 2803 |
| 4547 | UUUUAAAU CUGAUGA GCCGUUAGGC GAA AAUGGAAA | 9939 | UUUCCAUUC AUUUAAAA | 2804 |
| 4550 | GACUUUUA CUGAUGA GCCGUUAGGC GAA AUGAAUGG | 9940 | CCAUUCAUU UAAAAGUC | 2805 |
| 4551 | GGACUUUU CUGAUGA GCCGUUAGGC GAA AAUGAAUG | 9941 | CAUUCAUUU AAAAGUCC | 2806 |
| 4552 | AGGACUUU CUGAUGA GCCGUUAGGC GAA AAAUGAAU | 9942 | AUUCAUUUA AAAGUCCU | 2807 |
| 4558 | UUAUAUAG CUGAUGA GCCGUUAGGC GAA ACUUUUAA | 9943 | UUAAAAGUC CUAUAUAA | 2808 |
| 4561 | ACAUUAUA CUGAUGA GCCGUUAGGC GAA AGGACUUU | 9944 | AAAGUCCUA UAUAAUGU | 2809 |
| 4563 | GCACAUUA CUGAUGA GCCGUUAGGC GAA AUAGGACU | 9945 | AGUCCUAUA UAAUGUGC | 2810 |
| 4565 | GGGCACAU CUGAUGA GCCGUUAGGC GAA AUAUAGGA | 9946 | UCCUAUAUA AUGUGCCC | 2811 |
| 4583 | GGUAGUGA CUGAUGA GCCGUUAGGC GAA ACCACAGC | 9947 | GCUGUGGUC UCACUACC | 2812 |
| 4585 | CUGGUAGU CUGAUGA GCCGUUAGGC GAA AGACCACA | 9948 | UGUGGUCUC ACUACCAG | 2813 |

158

| | | | | |
|---|---|---|---|---|
| 4589 | UUAACUGG CUGAUGA GCCGUUAGGC GAA AGUGAGAC | 9949 | GUCUCACUA CCAGUUAA | 2814 |
| 4595 | UUUGCUUU CUGAUGA GCCGUUAGGC GAA ACUGGUAG | 9950 | CUACCAGUU AAAGCAAA | 2815 |
| 4596 | UUUUGCUU CUGAUGA GCCGUUAGGC GAA AACUGGUA | 9951 | UACCAGUUA AAGCAAAA | 2816 |
| 4609 | GUGUUUGA CUGAUGA GCCGUUAGGC GAA AGUCUUUU | 9952 | AAAAGACUU UCAAACAC | 2817 |
| 4610 | CGUGUUUG CUGAUGA GCCGUUAGGC GAA AAGUCUUU | 9953 | AAAGACUUU CAAACACG | 2818 |
| 4611 | ACGUGUUU CUGAUGA GCCGUUAGGC GAA AAAGUCUU | 9954 | AAGACUUUC AAACACGU | 2819 |
| 4625 | GGAGGACA CUGAUGA GCCGUUAGGC GAA AGUCCACG | 9955 | CGUGGACUC UGUCCUCC | 2820 |
| 4629 | UCUUGGAG CUGAUGA GCCGUUAGGC GAA ACAGAGUC | 9956 | GACUCUGUC CUCCAAGA | 2821 |
| 4632 | ACUUCUUG CUGAUGA GCCGUUAGGC GAA AGGACAGA | 9957 | UCUGUCCUC CAAGAAGU | 2822 |
| 4654 | GUUUCACA CUGAUGA GCCGUUAGGC GAA AGGUGCCG | 9958 | CGGCACCUC UGUGAAAC | 2823 |
| 4668 | GCCCAUUC CUGAUGA GCCGUUAGGC GAA AUCCAGUU | 9959 | AACUGGAUC GAAUGGGC | 2824 |
| 4683 | AACACACA CUGAUGA GCCGUUAGGC GAA AGCAUUGC | 9960 | GCAAUGCUU UGUGUGUU | 2825 |
| 4684 | CAACACAC CUGAUGA GCCGUUAGGC GAA AAGCAUUG | 9961 | CAAUGCUUU GUGUGUUG | 2826 |
| 4691 | CCAUCCUC CUGAUGA GCCGUUAGGC GAA ACACACAA | 9962 | UUGUGUGUU GAGGAUGG | 2827 |
| 4709 | GGCCCUGG CUGAUGA GCCGUUAGGC GAA ACAUCUCA | 9963 | UGAGAUGUC CCAGGGCC | 2828 |
| 4722 | GGUAGACA CUGAUGA GCCGUUAGGC GAA ACUCGGCC | 9964 | GGCCGAGUC UGUCUACC | 2829 |
| 4726 | CCAAGGUA CUGAUGA GCCGUUAGGC GAA ACAGACUC | 9965 | GAGUCUGUC UACCUUGG | 2830 |
| 4728 | CUCCAAGG CUGAUGA GCCGUUAGGC GAA AGACAGAC | 9966 | GUCUGUCUA CCUUGGAG | 2831 |
| 4732 | AAGCCUCC CUGAUGA GCCGUUAGGC GAA AGGUAGAC | 9967 | GUCUACCUU GGAGGCUU | 2832 |
| 4740 | CCUCCACA CUGAUGA GCCGUUAGGC GAA AGCCUCCA | 9968 | UGGAGGCUU UGUGGAGG | 2833 |
| 4741 | UCCUCCAC CUGAUGA GCCGUUAGGC GAA AAGCCUCC | 9969 | GGAGGCUUU GUGGAGGA | 2834 |
| 4758 | UUGGCUCA CUGAUGA GCCGUUAGGC GAA AGCCCGCA | 9970 | UGCGGGCUA UGAGCCAA | 2835 |
| 4771 | CCACACUU CUGAUGA GCCGUUAGGC GAA ACACUUGG | 9971 | CCAAGUGUU AAGUGUGG | 2836 |
| 4772 | CCCACACU CUGAUGA GCCGUUAGGC GAA AACACUUG | 9972 | CAAGUGUUA AGUGUGGG | 2837 |
| 4811 | CUCCGAGC CUGAUGA GCCGUUAGGC GAA ACUUGCGC | 9973 | GCGCAAGUC GCUCGGAG | 2838 |
| 4815 | CGCUCUCC CUGAUGA GCCGUUAGGC GAA AGCGACUU | 9974 | AAGUCGCUC GGAGAGCG | 2839 |
| 4826 | CAGGCUCC CUGAUGA GCCGUUAGGC GAA ACCGCUCU | 9975 | AGAGCGGUU GGAGCCUG | 2840 |
| 4844 | GCCAGCAC CUGAUGA GCCGUUAGGC GAA AUGCAUCU | 9976 | AGAUGCAUU GUGCUGGC | 2841 |
| 4854 | CUCCACCA CUGAUGA GCCGUUAGGC GAA AGCCAGCA | 9977 | UGCUGGCUC UGGUGGAG | 2842 |
| 4870 | CAGGCCAC CUGAUGA GCCGUUAGGC GAA AGCCCACC | 9978 | GGUGGGCUU GUGGCCUG | 2843 |
| 4880 | CGUUUCCU CUGAUGA GCCGUUAGGC GAA ACAGGCCA | 9979 | UGGCCUGUC AGGAAACG | 2844 |
| 4908 | CAAAACCA CUGAUGA GCCGUUAGGC GAA ACCCUGCC | 9980 | GGCAGGGUU UGGUUUUG | 2845 |
| 4909 | CCAAAACC CUGAUGA GCCGUUAGGC GAA AACCCUGC | 9981 | GCAGGGUUU GGUUUUGG | 2846 |
| 4913 | CCUUCCAA CUGAUGA GCCGUUAGGC GAA ACCAAACC | 9982 | GGUUUGGUU UUGGAAGG | 2847 |
| 4914 | ACCUUCCA CUGAUGA GCCGUUAGGC GAA AACCAAAC | 9983 | GUUUGGUUU UGGAAGGU | 2848 |
| 4915 | AACCUUCC CUGAUGA GCCGUUAGGC GAA AAACCAAA | 9984 | UUUGGUUUU GGAAGGUU | 2849 |
| 4923 | AGCACGCA CUGAUGA GCCGUUAGGC GAA ACCUUCCA | 9985 | UGGAAGGUU UGCGUGCU | 2850 |
| 4924 | GAGCACGC CUGAUGA GCCGUUAGGC GAA AACCUUCC | 9986 | GGAAGGUUU GCGUGCUC | 2851 |
| 4932 | ACUGUGAA CUGAUGA GCCGUUAGGC GAA AGCACGCA | 9987 | UGCGUGCUC UUCACAGU | 2852 |

| | | | | |
|---|---|---|---|---|
| 4934 | CGACUGUG CUGAUGA GCCGUUAGGC GAA AGAGCACG | 9988 | CGUGCUCUU CACAGUCG | 2853 |
| 4935 | CCGACUGU CUGAUGA GCCGUUAGGC GAA AAGAGCAC | 9989 | GUGCUCUUC ACAGUCGG | 2854 |
| 4941 | UGUAACCC CUGAUGA GCCGUUAGGC GAA ACUGUGAA | 9990 | UUCACAGUC GGGUUACA | 2855 |
| 4946 | UCGCCUGU CUGAUGA GCCGUUAGGC GAA ACCCGACU | 9991 | AGUCGGGUU ACAGGCGA | 2856 |
| 4947 | CUCGCCUG CUGAUGA GCCGUUAGGC GAA AACCCGAC | 9992 | GUCGGGUUA CAGGCGAG | 2857 |
| 4957 | CCACAGGG CUGAUGA GCCGUUAGGC GAA ACUCGCCU | 9993 | AGGCGAGUU CCCUGUGG | 2858 |
| 4958 | GCCACAGG CUGAUGA GCCGUUAGGC GAA AACUCGCC | 9994 | GGCGAGUUC CCUGUGGC | 2859 |
| 4969 | GAGUAGGA CUGAUGA GCCGUUAGGC GAA ACGCCACA | 9995 | UGUGGCGUU UCCUACUC | 2860 |
| 4970 | GGAGUAGG CUGAUGA GCCGUUAGGC GAA AACGCCAC | 9996 | GUGGCGUUU CCUACUCC | 2861 |
| 4971 | AGGAGUAG CUGAUGA GCCGUUAGGC GAA AAACGCCA | 9997 | UGGCGUUUC CUACUCCU | 2862 |
| 4974 | AUUAGGAG CUGAUGA GCCGUUAGGC GAA AGGAAACG | 9998 | CGUUUCCUA CUCCUAAU | 2863 |
| 4977 | CUCAUUAG CUGAUGA GCCGUUAGGC GAA AGUAGGAA | 9999 | UUCCUACUC CUAAUGAG | 2864 |
| 4980 | ACUCUCAU CUGAUGA GCCGUUAGGC GAA AGGAGUAG | 10000 | CUACUCCUA AUGAGAGU | 2865 |
| 4989 | CCGGAAGG CUGAUGA GCCGUUAGGC GAA ACUCUCAU | 10001 | AUGAGAGUU CCUUCCGG | 2866 |
| 4990 | UCCGGAAG CUGAUGA GCCGUUAGGC GAA AACUCUCA | 10002 | UGAGAGUUC CUUCCGGA | 2867 |
| 4993 | GAGUCCGG CUGAUGA GCCGUUAGGC GAA AGGAACUC | 10003 | GAGUUCCUU CCGGACUC | 2868 |
| 4994 | AGAGUCCG CUGAUGA GCCGUUAGGC GAA AAGGAACU | 10004 | AGUUCCUUC CGGACUCU | 2869 |
| 5001 | ACACGUAA CUGAUGA GCCGUUAGGC GAA AGUCCGGA | 10005 | UCCGGACUC UUACGUGU | 2870 |
| 5003 | AGACACGU CUGAUGA GCCGUUAGGC GAA AGAGUCCG | 10006 | CGGACUCUU ACGUGUCU | 2871 |
| 5004 | GAGACACG CUGAUGA GCCGUUAGGC GAA AAGAGUCC | 10007 | GGACUCUUA CGUGUCUC | 2872 |
| 5010 | GGCCAGGA CUGAUGA GCCGUUAGGC GAA ACACGUAA | 10008 | UUACGUGUC UCCUGGCC | 2873 |
| 5012 | CAGGCCAG CUGAUGA GCCGUUAGGC GAA AGACACGU | 10009 | ACGUGUCUC CUGGCCUG | 2874 |
| 5046 | GAAGGAGC CUGAUGA GCCGUUAGGC GAA AGCUGCAU | 10010 | AUGCAGCUU GCUCCUUC | 2875 |
| 5050 | UGAGGAAG CUGAUGA GCCGUUAGGC GAA AGCAAGCU | 10011 | AGCUUGCUC CUUCCUCA | 2876 |
| 5053 | AGAUGAGG CUGAUGA GCCGUUAGGC GAA AGGAGCAA | 10012 | UUGCUCCUU CCUCAUCU | 2877 |
| 5054 | GAGAUGAG CUGAUGA GCCGUUAGGC GAA AAGGAGCA | 10013 | UGCUCCUUC CUCAUCUC | 2878 |
| 5057 | UGAGAGAU CUGAUGA GCCGUUAGGC GAA AGGAAGGA | 10014 | UCCUUCCUC AUCUCUCA | 2879 |
| 5060 | GCCUGAGA CUGAUGA GCCGUUAGGC GAA AUGAGGAA | 10015 | UUCCUCAUC UCUCAGGC | 2880 |
| 5062 | CAGCCUGA CUGAUGA GCCGUUAGGC GAA AGAUGAGG | 10016 | CCUCAUCUC UCAGGCUG | 2881 |
| 5064 | CACAGCCU CUGAUGA GCCGUUAGGC GAA AGAGAUGA | 10017 | UCAUCUCUC AGGCUGUG | 2882 |
| 5076 | UCUGAAUU CUGAUGA GCCGUUAGGC GAA AGGCACAG | 10018 | CUGUGCCUU AAUUCAGA | 2883 |
| 5077 | UUCUGAAU CUGAUGA GCCGUUAGGC GAA AAGGCACA | 10019 | UGUGCCUUA AUUCAGAA | 2884 |
| 5080 | GUGUUCUG CUGAUGA GCCGUUAGGC GAA AUUAAGGC | 10020 | GCCUUAAUU CAGAACAC | 2885 |
| 5081 | GGUGUUCU CUGAUGA GCCGUUAGGC GAA AAUUAAGG | 10021 | CCUUAAUUC AGAACACC | 2886 |
| 5105 | CCUCUGCC CUGAUGA GCCGUUAGGC GAA ACGUUCCU | 10022 | AGGAACGUC GGCAGAGG | 2887 |
| 5116 | CCCGUCAG CUGAUGA GCCGUUAGGC GAA AGCCUCUG | 10023 | CAGAGGCUC CUGACGGG | 2888 |
| 5135 | GUUCUCAC CUGAUGA GCCGUUAGGC GAA AUUCUUCG | 10024 | CGAAGAAUU GUGAGAAC | 2889 |
| 5156 | GAAACCCU CUGAUGA GCCGUUAGGC GAA AGUUUCUG | 10025 | CAGAAACUC AGGGUUUC | 2890 |
| 5162 | CCAGCAGA CUGAUGA GCCGUUAGGC GAA ACCCUGAG | 10026 | CUCAGGGUU UCUGCUGG | 2891 |

160

| | | | | |
|---|---|---|---|---|
| 5163 | CCCAGCAG CUGAUGA GCCGUUAGGC GAA AACCCUGA | 10027 | UCAGGGUUU CUGCUGGG | 2892 |
| 5164 | ACCCAGCA CUGAUGA GCCGUUAGGC GAA AAACCCUG | 10028 | CAGGGUUUC UGCUGGGU | 2893 |
| 5203 | AACCCUCA CUGAUGA GCCGUUAGGC GAA ACCUGCCA | 10029 | UGGCAGGUC UGAGGGUU | 2894 |
| 5211 | UGACAGAG CUGAUGA GCCGUUAGGC GAA ACCCUCAG | 10030 | CUGAGGGUU CUCUGUCA | 2895 |
| 5212 | UUGACAGA CUGAUGA GCCGUUAGGC GAA AACCCUCA | 10031 | UGAGGGUUC UCUGUCAA | 2896 |
| 5214 | ACUUGACA CUGAUGA GCCGUUAGGC GAA AGAACCCU | 10032 | AGGGUUCUC UGUCAAGU | 2897 |
| 5218 | CGCCACUU CUGAUGA GCCGUUAGGC GAA ACAGAGAA | 10033 | UUCUCUGUC AAGUGGCG | 2898 |
| 5229 | UGAGCCUU CUGAUGA GCCGUUAGGC GAA ACCGCCAC | 10034 | GUGGCGGUA AAGGCUCA | 2899 |
| 5236 | ACCAGCCU CUGAUGA GCCGUUAGGC GAA AGCCUUUA | 10035 | UAAAGGCUC AGGCUGGU | 2900 |
| 5247 | AGAGGAAG CUGAUGA GCCGUUAGGC GAA ACACCAGC | 10036 | GCUGGUGUU CUUCCUCU | 2901 |
| 5248 | UAGAGGAA CUGAUGA GCCGUUAGGC GAA AACACCAG | 10037 | CUGGUGUUC UUCCUCUA | 2902 |
| 5250 | GAUAGAGG CUGAUGA GCCGUUAGGC GAA AGAACACC | 10038 | GGUGUUCUU CCUCUAUC | 2903 |
| 5251 | AGAUAGAG CUGAUGA GCCGUUAGGC GAA AAGAACAC | 10039 | GUGUUCUUC CUCUAUCU | 2904 |
| 5254 | UGGAGAUA CUGAUGA GCCGUUAGGC GAA AGGAAGAA | 10040 | UUCUUCCUC UAUCUCCA | 2905 |
| 5256 | AGUGGAGA CUGAUGA GCCGUUAGGC GAA AGAGGAAG | 10041 | CUUCCUCUA UCUCCACU | 2906 |
| 5258 | GGAGUGGA CUGAUGA GCCGUUAGGC GAA AUAGAGGA | 10042 | UCCUCUAUC UCCACUCC | 2907 |
| 5260 | CAGGAGUG CUGAUGA GCCGUUAGGC GAA AGAUAGAG | 10043 | CUCUAUCUC CACUCCUG | 2908 |
| 5265 | CCUGACAG CUGAUGA GCCGUUAGGC GAA AGUGGAGA | 10044 | UCUCCACUC CUGUCAGG | 2909 |
| 5270 | GGGGGCCU CUGAUGA GCCGUUAGGC GAA ACAGGAGU | 10045 | ACUCCUGUC AGGCCCCC | 2910 |
| 5283 | AUACUGAG CUGAUGA GCCGUUAGGC GAA ACUUGGGG | 10046 | CCCCAAGUC CUCAGUAU | 2911 |
| 5286 | AAAAUACU CUGAUGA GCCGUUAGGC GAA AGGACUUG | 10047 | CAAGUCCUC AGUAUUUU | 2912 |
| 5290 | AGCUAAAA CUGAUGA GCCGUUAGGC GAA ACUGAGGA | 10048 | UCCUCAGUA UUUUAGCU | 2913 |
| 5292 | AAAGCUAA CUGAUGA GCCGUUAGGC GAA AUACUGAG | 10049 | CUCAGUAUU UUAGCUUU | 2914 |
| 5293 | CAAAGCUA CUGAUGA GCCGUUAGGC GAA AAUACUGA | 10050 | UCAGUAUUU UAGCUUUG | 2915 |
| 5294 | ACAAAGCU CUGAUGA GCCGUUAGGC GAA AAAUACUG | 10051 | CAGUAUUUU AGCUUUGU | 2916 |
| 5295 | CACAAAGC CUGAUGA GCCGUUAGGC GAA AAAAUACU | 10052 | AGUAUUUUA GCUUUGUG | 2917 |
| 5299 | AAGCCACA CUGAUGA GCCGUUAGGC GAA AGCUAAAA | 10053 | UUUUAGCUU UGUGGCUU | 2918 |
| 5300 | GAAGCCAC CUGAUGA GCCGUUAGGC GAA AAGCUAAA | 10054 | UUUAGCUUU GUGGCUUC | 2919 |
| 5307 | CCAUCAGG CUGAUGA GCCGUUAGGC GAA AGCCACAA | 10055 | UUGUGGCUU CCUGAUGG | 2920 |
| 5308 | GCCAUCAG CUGAUGA GCCGUUAGGC GAA AAGCCACA | 10056 | UGUGGCUUC CUGAUGGC | 2921 |
| 5325 | CCAAUUAA CUGAUGA GCCGUUAGGC GAA AUUUUUCU | 10057 | AGAAAAAUC UUAAUUGG | 2922 |
| 5327 | AACCAAUU CUGAUGA GCCGUUAGGC GAA AGAUUUUU | 10058 | AAAAAUCUU AAUUGGUU | 2923 |
| 5328 | CAACCAAU CUGAUGA GCCGUUAGGC GAA AAGAUUUU | 10059 | AAAAUCUUA AUUGGUUG | 2924 |
| 5331 | AACCAACC CUGAUGA GCCGUUAGGC GAA AUUAAGAU | 10060 | AUCUUAAUU GGUUGGUU | 2925 |
| 5335 | AGCAAACC CUGAUGA GCCGUUAGGC GAA ACCAAUUA | 10061 | UAAUUGGUU GGUUUGCU | 2926 |
| 5339 | GGAGAGCA CUGAUGA GCCGUUAGGC GAA ACCAACCA | 10062 | UGGUUGGUU UGCUCUCC | 2927 |
| 5340 | UGGAGAGC CUGAUGA GCCGUUAGGC GAA AACCAACC | 10063 | GGUUGGUUU GCUCUCCA | 2928 |
| 5344 | UAUCUGGA CUGAUGA GCCGUUAGGC GAA AGCAAACC | 10064 | GGUUUGCUC UCCAGAUA | 2929 |
| 5346 | AUUAUCUG CUGAUGA GCCGUUAGGC GAA AGAGCAAA | 10065 | UUUGCUCUC CAGAUAAU | 2930 |

161

| | | | | |
|---|---|---|---|---|
| 5352 | CUAGUGAU CUGAUGA GCCGUUAGGC GAA AUCUGGAG | 10066 | CUCCAGAUA AUCACUAG | 2931 |
| 5355 | UGGCUAGU CUGAUGA GCCGUUAGGC GAA AUUAUCUG | 10067 | CAGAUAAUC ACUAGCCA | 2932 |
| 5359 | AAUCUGGC CUGAUGA GCCGUUAGGC GAA AGUGAUUA | 10068 | UAAUCACUA GCCAGAUU | 2933 |
| 5367 | AAUUUCGA CUGAUGA GCCGUUAGGC GAA AUCUGGCU | 10069 | AGCCAGAUU UCGAAAUU | 2934 |
| 5368 | UAAUUUCG CUGAUGA GCCGUUAGGC GAA AAUCUGGC | 10070 | GCCAGAUUU CGAAAUUA | 2935 |
| 5369 | GUAAUUUC CUGAUGA GCCGUUAGGC GAA AAAUCUGG | 10071 | CCAGAUUUC GAAAUUAC | 2936 |
| 5375 | UAAAAAGU CUGAUGA GCCGUUAGGC GAA AUUUCGAA | 10072 | UUCGAAAUU ACUUUUUA | 2937 |
| 5376 | CUAAAAAG CUGAUGA GCCGUUAGGC GAA AAUUUCGA | 10073 | UCGAAAUUA CUUUUUAG | 2938 |
| 5379 | CGGCUAAA CUGAUGA GCCGUUAGGC GAA AGUAAUUU | 10074 | AAAUUACUU UUUAGCCG | 2939 |
| 5380 | UCGGCUAA CUGAUGA GCCGUUAGGC GAA AAGUAAUU | 10075 | AAUUACUUU UUAGCCGA | 2940 |
| 5381 | CUCGGCUA CUGAUGA GCCGUUAGGC GAA AAAGUAAU | 10076 | AUUACUUUU UAGCCGAG | 2941 |
| 5382 | CCUCGGCU CUGAUGA GCCGUUAGGC GAA AAAAGUAA | 10077 | UUACUUUUU AGCCGAGG | 2942 |
| 5383 | ACCUCGGC CUGAUGA GCCGUUAGGC GAA AAAAAGUA | 10078 | UACUUUUUA GCCGAGGU | 2943 |
| 5392 | GUUAUCAU CUGAUGA GCCGUUAGGC GAA ACCUCGGC | 10079 | GCCGAGGUU AUGAUAAC | 2944 |
| 5393 | UGUUAUCA CUGAUGA GCCGUUAGGC GAA AACCUCGG | 10080 | CCGAGGUUA UGAUAACA | 2945 |
| 5398 | GUAGAUGU CUGAUGA GCCGUUAGGC GAA AUCAUAAC | 10081 | GUUAUGAUA ACAUCUAC | 2946 |
| 5403 | AUACAGUA CUGAUGA GCCGUUAGGC GAA AUGUUAUC | 10082 | GAUAACAUC UACUGUAU | 2947 |
| 5405 | GGAUACAG CUGAUGA GCCGUUAGGC GAA AGAUGUUA | 10083 | UAACAUCUA CUGUAUCC | 2948 |
| 5410 | CUAAAGGA CUGAUGA GCCGUUAGGC GAA ACAGUAGA | 10084 | UCUACUGUA UCCUUUAG | 2949 |
| 5412 | UUCUAAAG CUGAUGA GCCGUUAGGC GAA AUACAGUA | 10085 | UACUGUAUC CUUUAGAA | 2950 |
| 5415 | AAAUUCUA CUGAUGA GCCGUUAGGC GAA AGGAUACA | 10086 | UGUAUCCUU UAGAAUUU | 2951 |
| 5416 | AAAAUUCU CUGAUGA GCCGUUAGGC GAA AAGGAUAC | 10087 | GUAUCCUUU AGAAUUUU | 2952 |
| 5417 | UAAAAUUC CUGAUGA GCCGUUAGGC GAA AAAGGAUA | 10088 | UAUCCUUUA GAAUUUUA | 2953 |
| 5422 | UAGGUUAA CUGAUGA GCCGUUAGGC GAA AUUCUAAA | 10089 | UUUAGAAUU UUAACCUA | 2954 |
| 5423 | AUAGGUUA CUGAUGA GCCGUUAGGC GAA AAUUCUAA | 10090 | UUAGAAUUU UAACCUAU | 2955 |
| 5424 | UAUAGGUU CUGAUGA GCCGUUAGGC GAA AAAUUCUA | 10091 | UAGAAUUUU AACCUAUA | 2956 |
| 5425 | UUAUAGGU CUGAUGA GCCGUUAGGC GAA AAAAUUCU | 10092 | AGAAUUUUA ACCUAUAA | 2957 |
| 5430 | UAGUUUUA CUGAUGA GCCGUUAGGC GAA AGGUUAAA | 10093 | UUUAACCUA UAAAACUA | 2958 |
| 5432 | CAUAGUUU CUGAUGA GCCGUUAGGC GAA AUAGGUUA | 10094 | UAACCUAUA AAACUAUG | 2959 |
| 5438 | AGUAGACA CUGAUGA GCCGUUAGGC GAA AGUUUUAU | 10095 | AUAAAACUA UGUCUACU | 2960 |
| 5442 | AACCAGUA CUGAUGA GCCGUUAGGC GAA ACAUAGUU | 10096 | AACUAUGUC UACUGGUU | 2961 |
| 5444 | GAAACCAG CUGAUGA GCCGUUAGGC GAA AGACAUAG | 10097 | CUAUGUCUA CUGGUUUC | 2962 |
| 5450 | CAGGCAGA CUGAUGA GCCGUUAGGC GAA ACCAGUAG | 10098 | CUACUGGUU UCUGCCUG | 2963 |
| 5451 | ACAGGCAG CUGAUGA GCCGUUAGGC GAA AACCAGUA | 10099 | UACUGGUUU CUGCCUGU | 2964 |
| 5452 | CACAGGCA CUGAUGA GCCGUUAGGC GAA AAACCAGU | 10100 | ACUGGUUUC UGCCUGUG | 2965 |

Underlined region can be any X sequence or linker, as described herein.

Table VII: Mouse *flk*-1 VEGF Receptor-Hairpin Ribozyme and Substrate Sequences 237.198

| nt. Position | HP Ribozyme Sequences | Rz Seq ID No. | Substrate | Seq ID No. |
|---|---|---|---|---|
| 74 | GGGACACA AGAA GGGCCC ACCAGAGAAACACACGUUGUGGUACAUUACCUGGUA | 10101 | GGGCCCA GAC UGUGUCCC | 2966 |
| 88 | GUUAUCCC AGAA GCGGGA ACCAGAGAAACACACGUUGUGGUACAUUACCUGGUA | 10102 | UCCCGCA GCC GGGAUAAC | 2967 |
| 105 | GGAAUCGG AGAA GCCAGG ACCAGAGAAACACACGUUGUGGUACAUUACCUGGUA | 10103 | CCUGGCU GAC CCGAUUCC | 2968 |
| 110 | UCCGCGGA AGAA GGUCAG ACCAGAGAAACACACGUUGUGGUACAUUACCUGGUA | 10104 | CUGACCC GAU UCCGCGGA | 2969 |
| 125 | CGGCUGUC AGAA GUGUCC ACCAGAGAAACACACGUUGUGGUACAUUACCUGGUA | 10105 | GGACACC GCU GACAGCCG | 2970 |
| 132 | CCAGCCGC AGAA GUCAGC ACCAGAGAAACACACGUUGUGGUACAUUACCUGGUA | 10106 | GCUGACA GCC GCGGCUGG | 2971 |
| 138 | CUGGCUCC AGAA GCGGCU ACCAGAGAAACACACGUUGUGGUACAUUACCUGGUA | 10107 | AGCCGCG GCU GGAGCCAG | 2972 |
| 175 | CAGCGCAA AGAA GGGGAG ACCAGAGAAACACACGUUGUGGUACAUUACCUGGUA | 10108 | CUCCCCG GUC UUGCGCUG | 2973 |
| 199 | GUCACAGA AGAA GUAUGG ACCAGAGAAACACACGUUGUGGUACAUUACCUGGUA | 10109 | CCAUACC GCC UCUGUGAC | 2974 |
| 309 | CACAGAGC AGAA GCUAGC ACCAGAGAAACACACGUUGUGGUACAUUACCUGGUA | 10110 | GCUAGCU GUC GCUCUGUG | 2975 |
| 342 | CCCACAGA AGAA GCUCGG ACCAGAGAAACACACGUUGUGGUACAUUACCUGGUA | 10111 | CCGAGCC GCC UCUGUGGG | 2976 |
| 434 | UGCAAGUA AGAA GAAGGG ACCAGAGAAACACACGUUGUGGUACAUUACCUGGUA | 10112 | CCCUUCA GAU UACUUGCA | 2977 |
| 630 | UAGACAUA AGAA GUGGAG ACCAGAGAAACACACGUUGUGGUACAUUACCUGGUA | 10113 | CUCCACU GUU UAUGUCUA | 2978 |
| 655 | GAAUGGUG AGAA GUAAUC ACCAGAGAAACACACGUUGUGGUACAUUACCUGGUA | 10114 | GAUUACA GAU CACCAUUC | 2979 |
| 739 | CGACCCUC AGAA GGGGAU ACCAGAGAAACACACGUUGUGGUACAUUACCUGGUA | 10115 | AUCCCCU GCC GAGGGUCG | 2980 |
| 807 | CUGUUUCC AGAA GGAACA ACCAGAGAAACACACGUUGUGGUACAUUACCUGGUA | 10116 | UGUUCCG GAU GGAAACAG | 2981 |
| 920 | ACAUGAUA AGAA GAUAGG ACCAGAGAAACACACGUUGUGGUACAUUACCUGGUA | 10117 | CCUAUCA GUC UAUCAUGU | 2982 |
| 1002 | UUUUCUCC AGAA GAUAGC ACCAGAGAAACACACGUUGUGGUACAUUACCUGGUA | 10118 | GCUAUCU GCC GGAGAAAA | 2983 |
| 1229 | UCUUGAUC AGAA GUCCAC ACCAGAGAAACACACGUUGUGGUACAUUACCUGGUA | 10119 | GUGGACG GAU GAUCAAGA | 2984 |
| 1365 | AUAUCAGG AGAA GGGUAA ACCAGAGAAACACACGUUGUGGUACAUUACCUGGUA | 10120 | UUACCCA GCU CCUGAUAU | 2985 |
| 1556 | UCUCACCG AGAA GGGGUG ACCAGAGAAACACACGUUGUGGUACAUUACCUGGUA | 10121 | CACCCCA GAU CGGUGAGA | 2986 |
| 1629 | UUGGCGUA AGAA GUGCAU ACCAGAGAAACACACGUUGUGGUACAUUACCUGGUA | 10122 | AUGCACA GUC UACGCCAA | 2987 |
| 1687 | UCUGUAGG AGAA GGCUUC ACCAGAGAAACACACGUUGUGGUACAUUACCUGGUA | 10123 | GAAGCCU GCU CCUACAGA | 2988 |
| 1696 | UUGGCCGG AGAA GUAGGA ACCAGAGAAACACACGUUGUGGUACAUUACCUGGUA | 10124 | UCCUACA GAC CCGGCCAA | 2989 |
| 1796 | UUCCUUCA AGAA GGGCAU ACCAGAGAAACACACGUUGUGGUACAUUACCUGGUA | 10125 | AUGCCCU GAU UGAAGGAA | 2990 |
| 1950 | GGCUGGGC AGAA GGUUGC ACCAGAGAAACACACGUUGUGGUACAUUACCUGGUA | 10126 | GCAACCU GCU GCCCAGCC | 2991 |
| 1953 | GUUGGCUG AGAA GCAGGU ACCAGAGAAACACACGUUGUGGUACAUUACCUGGUA | 10127 | ACCUGCU GCC CAGCCAAC | 2992 |
| 1985 | CAGUGCAC AGAA GGGACA ACCAGAGAAACACACGUUGUGGUACAUUACCUGGUA | 10128 | UGUCCCU GUU GUGCACUG | 2993 |
| 2055 | CCCAUGUG AGAA GAUGUU ACCAGAGAAACACACGUUGUGGUACAUUACCUGGUA | 10129 | AACAUCG GUC CACAUGGG | 2994 |
| 2082 | UUCUUGCA AGAA GGUGUG ACCAGAGAAACACACGUUGUGGUACAUUACCUGGUA | 9329 | CACACCA GUU UGCAAGAA | 2995 |
| 2208 | UUAUCUUG AGAA GAGCAA ACCAGAGAAACACACGUUGUGGUACAUUACCUGGUA | 10130 | UUGCUCU GCU CAAGAUAA | 2996 |

163

| | | | | |
|---|---|---|---|---|
| 2252 | GGAUGAUG AGAA GUUUGA ACCAGAGAAACACACGUUGUGGUACAUUACCUGGUA | 10131 | UCAAACA GCU CAUCAUCC | 2997 |
| 2444 | UGCGGAUA AGAA GGUUCC ACCAGAGAAACACACGUUGUGGUACAUUACCUGGUA | 10132 | GGAACCU GAC UAUCCGCA | 2998 |
| 2639 | GCUUAACG AGAA GUAGGA ACCAGAGAAACACACGUUGUGGUACAUUACCUGGUA | 10133 | UCCUACG GAC CGUUAAGC | 2999 |
| 2703 | GGCAAUUC AGAA GGAUCC ACCAGAGAAACACACGUUGUGGUACAUUACCUGGUA | 10134 | GGAUCCA GAU GAAUUGCC | 3000 |
| 2777 | CUAGUUUC AGAA GGUCCC ACCAGAGAAACACACGUUGUGGUACAUUACCUGGUA | 10135 | GGGACCG GCU GAAACUAG | 3001 |
| 2832 | CCAAAAGC AGAA GCCUCA ACCAGAGAAACACACGUUGUGGUACAUUACCUGGUA | 10136 | UGAGGCA GAC GCUUUUGG | 3002 |
| 3199 | AAAGCCUG AGAA GGCAGA ACCAGAGAAACACACGUUGUGGUACAUUACCUGGUA | 10137 | UCUGCCA GCU CAGGCUUU | 3003 |
| 3278 | GCUCCAAG AGAA GGAAGU ACCAGAGAAACACACGUUGUGGUACAUUACCUGGUA | 9341 | ACUUCCU GAC CUUGGAGC | 2199 |
| 3304 | CACUUGGA AGAA GUAACA ACCAGAGAAACACACGUUGUGGUACAUUACCUGGUA | 9342 | UGUUACA GCU UCCAAGUG | 2200 |
| 3421 | CCGGGCCA AGAA GAAGUC ACCAGAGAAACACACGUUGUGGUACAUUACCUGGUA | 10138 | GACUUCG GCU UGGCCCGG | 3004 |
| 3450 | CUGACAUA AGAA GGGUCU ACCAGAGAAACACACGUUGUGGUACAUUACCUGGUA | 10139 | AGACCCG GAU UAUGUCAG | 3005 |
| 3475 | CAAAGGGA AGAA GGCAUC ACCAGAGAAACACACGUUGUGGUACAUUACCUGGUA | 10140 | GAUGCCC GAC UCCCUUUG | 3006 |
| 3663 | GUAGUGUA AGAA GGAGCC ACCAGAGAAACACACGUUGUGGUACAUUACCUGGUA | 10141 | GGCUCCU GAC UACACUAC | 3007 |
| 3689 | CCAGCAUG AGAA GGUACA ACCAGAGAAACACACGUUGUGGUACAUUACCUGGUA | 9345 | UGUACCA GAC CAUGCUGG | 2203 |
| 3703 | CUCAUGCC AGAA GUCCAG ACCAGAGAAACACACGUUGUGGUACAUUACCUGGUA | 10142 | CUGGACU GCU GGCAUGAG | 3008 |
| 3860 | GUGAGGUA AGAA GGGAGA ACCAGAGAAACACACGUUGUGGUACAUUACCUGGUA | 10143 | UCUCCCU GCC UACCUCAC | 3009 |
| 3873 | AUACAGGA AGAA GGUGAG ACCAGAGAAACACACGUUGUGGUACAUUACCUGGUA | 9348 | CUCACCU GUU UCCUGUAU | 2206 |
| 4038 | UGGCUGUC AGAA GGGAUC ACCAGAGAAACACACGUUGUGGUACAUUACCUGGUA | 10144 | GAUCCCA GAU GACAGCCA | 3010 |
| 4181 | AGCCACUG AGAA GGUUGG ACCAGAGAAACACACGUUGUGGUACAUUACCUGGUA | 10145 | CCAACCA GAC CAGUGGCU | 3011 |
| 4196 | GAUACCCA AGAA GGUAGC ACCAGAGAAACACACGUUGUGGUACAUUACCUGGUA | 10146 | GCUACCA GUC UGGGUAUC | 3012 |
| 4212 | UCUGUGUC AGAA GAGUGA ACCAGAGAAACACACGUUGUGGUACAUUACCUGGUA | 9353 | UCACUCA GAU GACACAGA | 3013 |
| 4278 | UCAGCGUG AGAA GCAGCA ACCAGAGAAACACACGUUGUGGUACAUUACCUGGUA | 10147 | UGCUGCA GUU CACGCUGA | 3014 |
| 4287 | GUCCCUGA AGAA GCGUGA ACCAGAGAAACACACGUUGUGGUACAUUACCUGGUA | 10148 | UCACGCU GAC UCAGGGAC | 3015 |
| 4307 | AGGAGGUG AGAA GCAGUG ACCAGAGAAACACACGUUGUGGUACAUUACCUGGUA | 10149 | CACUGCA GCU CACCUCCU | 3016 |
| 4318 | UCCAUUUA AGAA GGAGGU ACCAGAGAAACACACGUUGUGGUACAUUACCUGGUA | 10150 | ACCUCCU GUU UAAAUGGA | 3017 |
| 4338 | GGAGCCGG AGAA GGACCA ACCAGAGAAACACACGUUGUGGUACAUUACCUGGUA | 10151 | UGGUCCU GUC CCGGCUCC | 3018 |
| 4344 | GGGGGCGG AGAA GGGACA ACCAGAGAAACACACGUUGUGGUACAUUACCUGGUA | 10152 | UGUCCCG GCU CCGCCCCC | 3019 |
| 4349 | GAGUUGGG AGAA GAGCCG ACCAGAGAAACACACGUUGUGGUACAUUACCUGGUA | 10153 | CGGCUCC GCC CCCAACUC | 3020 |
| 4383 | AAAAUCUA AGAA GCACCU ACCAGAGAAACACACGUUGUGGUACAUUACCUGGUA | 10154 | AGGUGCU GCU UAGAUUUU | 3021 |
| 4462 | UCCUUGCA AGAA GAGGUC ACCAGAGAAACACACGUUGUGGUACAUUACCUGGUA | 10155 | GACCUCA GAC UGCAAGGA | 3022 |
| 4574 | GAGACCAC AGAA GGGCAC ACCAGAGAAACACACGUUGUGGUACAUUACCUGGUA | 10156 | GUGCCCU GCU GUGGUCUC | 3023 |
| 4626 | UCUUGGAG AGAA GAGUCC ACCAGAGAAACACACGUUGUGGUACAUUACCUGGUA | 10157 | GGACUCU GUC CUCCAAGA | 3024 |
| 4723 | CCAAGGUA AGAA GACUCG ACCAGAGAAACACACGUUGUGGUACAUUACCUGGUA | 10158 | CGAGUCU GUC UACCUUGG | 3025 |
| 4823 | CAGGCUCC AGAA GCUCUC ACCAGAGAAACACACGUUGUGGUACAUUACCUGGUA | 10159 | GAGAGCG GUU GGAGCCUG | 3026 |
| 4836 | CACAAUGC AGAA GCAGGC ACCAGAGAAACACACGUUGUGGUACAUUACCUGGUA | 10160 | GCCUGCA GAU GCAUUGUG | 3027 |

164

| | | | | |
|---|---|---|---|---|
| 4896 | ACCCUGCC AGAA GCCUUU ACCAGAGAAACACACGUUGUGGUACAUUACCUGGUA | 10161 | AAAGGCG GCC GGCAGGGU | 3028 |
| 4938 | UGUAACCC AGAA GUGAAG ACCAGAGAAACACACGUUGUGGUACAUUACCUGGUA | 10162 | CUUCACA GUC GGGUUACA | 3029 |
| 4996 | ACGUAAGA AGAA GGAAGG ACCAGAGAAACACACGUUGUGGUACAUUACCUGGUA | 10163 | CCUUCCG GAC UCUUACGU | 3030 |
| 5042 | AAGGAGCA AGAA GCAUCA ACCAGAGAAACACACGUUGUGGUACAUUACCUGGUA | 10164 | UGAUGCA GCU UGCUCCUU | 3031 |
| 5118 | UCGGCCCC AGAA GGAGCC ACCAGAGAAACACACGUUGUGGUACAUUACCUGGUA | 10165 | GGCUCCU GAC GGGGCCGA | 3032 |
| 5165 | CUCCACCC AGAA GAAACC ACCAGAGAAACACACGUUGUGGUACAUUACCUGGUA | 10166 | GGUUUCU GCU GGGUGGAG | 3033 |
| 5310 | UUUCUGCC AGAA GGAAGC ACCAGAGAAACACACGUUGUGGUACAUUACCUGGUA | 10167 | GCUUCCU GAU GGCAGAAA | 3034 |
| 5363 | AUUUCGAA AGAA GGCUAG ACCAGAGAAACACACGUUGUGGUACAUUACCUGGUA | 10168 | CUAGCCA GAU UUCGAAAU | 3035 |
| 5453 | AGCACACA AGAA GAAACC ACCAGAGAAACACACGUUGUGGUACAUUACCUGGUA | 10169 | GGUUUCU GCC UGUGUGCU | 3036 |

165

Table VIII: Mouse *flt*-1 VEGF Receptor-Hammerhead Ribozyme and Substrate Sequence 237.198

| nt. Position | HH Ribozyme Sequence | Rz Seq ID No. | Substrate | Seq ID No. |
|---|---|---|---|---|
| 17 | GUGAGCAA CUGAUGA GCCGUUAGGC GAA ACGCGGCC | 10170 | GGCCGCGUC UUGCUCAC | 3037 |
| 19 | UGGUGAGC CUGAUGA GCCGUUAGGC GAA AGACGCGG | 10171 | CCGCGUCUU GCUCACCA | 3038 |
| 23 | ACCAUGGU CUGAUGA GCCGUUAGGC GAA AGCAAGAC | 10172 | GUCUUGCUC ACCAUGGU | 3039 |
| 32 | CAGCAGCU CUGAUGA GCCGUUAGGC GAA ACCAUGGU | 10173 | ACCAUGGUC AGCUGCUG | 3040 |
| 53 | UAAGGCAA CUGAUGA GCCGUUAGGC GAA ACCGCGGU | 10174 | ACCGCGGUC UUGCCUUA | 3041 |
| 55 | CGUAAGGC CUGAUGA GCCGUUAGGC GAA AGACCGCG | 10175 | CGCGGUCUU GCCUUACG | 3042 |
| 60 | CAGCGCGU CUGAUGA GCCGUUAGGC GAA AGGCAAGA | 10176 | UCUUGCCUU ACGCGCUG | 3043 |
| 61 | GCAGCGCG CUGAUGA GCCGUUAGGC GAA AAGGCAAG | 10177 | CUUGCCUUA CGCGCUGC | 3044 |
| 71 | AGACACCC CUGAUGA GCCGUUAGGC GAA AGCAGCGC | 10178 | GCGCUGCUC GGGUGUCU | 3045 |
| 78 | GAGAAGCA CUGAUGA GCCGUUAGGC GAA ACACCCGA | 10179 | UCGGGUGUC UGCUUCUC | 3046 |
| 83 | CCUGUGAG CUGAUGA GCCGUUAGGC GAA AGCAGACA | 7167 | UGUCUGCUU CUCACAGG | 25 |
| 84 | UCCUGUGA CUGAUGA GCCGUUAGGC GAA AAGCAGAC | 7168 | GUCUGCUUC UCACAGGA | 26 |
| 86 | UAUCCUGU CUGAUGA GCCGUUAGGC GAA AGAAGCAG | 10180 | CUGCUUCUC ACAGGAUA | 3047 |
| 94 | CUGAGCCA CUGAUGA GCCGUUAGGC GAA AUCCUGUG | 10181 | CACAGGAUA UGGCUCAG | 3048 |
| 100 | UCGACCCU CUGAUGA GCCGUUAGGC GAA AGCCAUAU | 10182 | AUAUGGCUC AGGGUCGA | 3049 |
| 106 | UUAACUUC CUGAUGA GCCGUUAGGC GAA ACCCUGAG | 10183 | CUCAGGGUC GAAGUUAA | 3050 |
| 112 | GCACUUUU CUGAUGA GCCGUUAGGC GAA ACUUCGAC | 10184 | GUCGAAGUU AAAAGUGC | 3051 |
| 113 | GGCACUUU CUGAUGA GCCGUUAGGC GAA AACUUCGA | 10185 | UCGAAGUUA AAAGUGCC | 3052 |
| 132 | GCCUUUUA CUGAUGA GCCGUUAGGC GAA ACUCAGUU | 7179 | AACUGAGUU UAAAAGGC | 37 |
| 133 | UGCCUUUU CUGAUGA GCCGUUAGGC GAA AACUCAGU | 7180 | ACUGAGUUU AAAAGGCA | 38 |
| 134 | GUGCCUUU CUGAUGA GCCGUUAGGC GAA AAACUCAG | 7181 | CUGAGUUUA AAAGGCAC | 39 |
| 152 | GCUUGCAU CUGAUGA GCCGUUAGGC GAA ACAUGCUG | 10186 | CAGCAUGUC AUGCAAGC | 3053 |
| 171 | GAGAAAGA CUGAUGA GCCGUUAGGC GAA AGUCUGGC | 10187 | GCCAGACUC UCUUUCUC | 3054 |
| 173 | UUGAGAAA CUGAUGA GCCGUUAGGC GAA AGAGUCUG | 10188 | CAGACUCUC UUUCUCAA | 3055 |
| 175 | ACUUGAGA CUGAUGA GCCGUUAGGC GAA AGAGAGUC | 10189 | GACUCUCUU UCUCAAGU | 3056 |
| 176 | CACUUGAG CUGAUGA GCCGUUAGGC GAA AAGAGAGU | 10190 | ACUCUCUUU CUCAAGUG | 3057 |
| 177 | GCACUUGA CUGAUGA GCCGUUAGGC GAA AAAGAGAG | 10191 | CUCUCUUUC UCAAGUGC | 3058 |
| 179 | CUGCACUU CUGAUGA GCCGUUAGGC GAA AGAAAGAG | 10192 | CUCUUUCUC AAGUGCAG | 3059 |
| 205 | GAGACCAU CUGAUGA GCCGUUAGGC GAA AGUGGGCU | 10193 | AGCCCACUC AUGGUCUC | 3060 |
| 211 | UGGGCAGA CUGAUGA GCCGUUAGGC GAA ACCAUGAG | 10194 | CUCAUGGUC UCUGCCCA | 3061 |
| 213 | CGUGGGCA CUGAUGA GCCGUUAGGC GAA AGACCAUG | 10195 | CAUGGUCUC UGCCCACG | 3062 |

166

| | | | | |
|---|---|---|---|---|
| 254 | GGGGGAGU CUGAUGA GCCGUUAGGC GAA AUGCUCAG | 10196 | CUGAGCAUC ACUCCCCC | 3063 |
| 258 | CGAUGGGG CUGAUGA GCCGUUAGGC GAA AGUGAUGC | 10197 | GCAUCACUC CCCCAUCG | 3064 |
| 265 | CACAGGCC CUGAUGA GCCGUUAGGC GAA AUGGGGGA | 10198 | UCCCCCAUC GGCCUGUG | 3065 |
| 282 | UUGCCUGU CUGAUGA GCCGUUAGGC GAA AUCCCUCC | 10199 | GGAGGGAUA ACAGGCAA | 3066 |
| 292 | UGCUGCAG CUGAUGA GCCGUUAGGC GAA AUUGCCUG | 10200 | CAGGCAAUU CUGCAGCA | 3067 |
| 293 | GUGCUGCA CUGAUGA GCCGUUAGGC GAA AAUUGCCU | 10201 | AGGCAAUUC UGCAGCAC | 3068 |
| 304 | CCAAGGUC CUGAUGA GCCGUUAGGC GAA AGGUGCUG | 10202 | CAGCACCUU GACCUUGG | 3069 |
| 310 | CCGUGUCC CUGAUGA GCCGUUAGGC GAA AGGUCAAG | 10203 | CUUGACCUU GGACACGG | 3070 |
| 341 | CAGGUGUA CUGAUGA GCCGUUAGGC GAA AGGCCCGU | 10204 | ACGGGCCUC UACACCUG | 3071 |
| 343 | UACAGGUG CUGAUGA GCCGUUAGGC GAA AGAGGCCC | 10205 | GGGCCUCUA CACCUGUA | 3072 |
| 351 | GAGGUAUC CUGAUGA GCCGUUAGGC GAA ACAGGUGU | 10206 | ACACCUGUA GAUACCUC | 3073 |
| 355 | UAGGGAGG CUGAUGA GCCGUUAGGC GAA AUCUACAG | 10207 | CUGUAGAUA CCUCCCUA | 3074 |
| 359 | GAUGUAGG CUGAUGA GCCGUUAGGC GAA AGGUAUCU | 10208 | AGAUACCUC CCUACAUC | 3075 |
| 363 | AGUAGAUG CUGAUGA GCCGUUAGGC GAA AGGGAGGU | 10209 | ACCUCCCUA CAUCUACU | 3076 |
| 367 | UCGAAGUA CUGAUGA GCCGUUAGGC GAA AUGUAGGG | 10210 | CCCUACAUC UACUUCGA | 3077 |
| 369 | CUUCGAAG CUGAUGA GCCGUUAGGC GAA AGAUGUAG | 10211 | CUACAUCUA CUUCGAAG | 3078 |
| 372 | UUUCUUCG CUGAUGA GCCGUUAGGC GAA AGUAGAUG | 10212 | CAUCUACUU CGAAGAAA | 3079 |
| 373 | UUUUCUUC CUGAUGA GCCGUUAGGC GAA AAGUAGAU | 10213 | AUCUACUUC GAAGAAAA | 3080 |
| 394 | AGAUUGAA CUGAUGA GCCGUUAGGC GAA AUUCCGCU | 10214 | AGCGGAAUC UUCAAUCU | 3081 |
| 396 | GUAGAUUG CUGAUGA GCCGUUAGGC GAA AGAUUCCG | 10215 | CGGAAUCUU CAAUCUAC | 3082 |
| 397 | UGUAGAUU CUGAUGA GCCGUUAGGC GAA AAGAUUCC | 10216 | GGAAUCUUC AAUCUACA | 3083 |
| 401 | AAUAUGUA CUGAUGA GCCGUUAGGC GAA AUUGAAGA | 10217 | UCUUCAAUC UACAUAUU | 3084 |
| 403 | CAAAUAUG CUGAUGA GCCGUUAGGC GAA AGAUUGAA | 10218 | UUCAAUCUA CAUAUUUG | 3085 |
| 407 | CUAACAAA CUGAUGA GCCGUUAGGC GAA AUGUAGAU | 10219 | AUCUACAUA UUUGUUAG | 3086 |
| 409 | CACUAACA CUGAUGA GCCGUUAGGC GAA AUAUGUAG | 10220 | CUACAUAUU UGUUAGUG | 3087 |
| 410 | UCACUAAC CUGAUGA GCCGUUAGGC GAA AAUAUGUA | 10221 | UACAUAUUU GUUAGUGA | 3088 |
| 413 | GCAUCACU CUGAUGA GCCGUUAGGC GAA ACAAAUAU | 10222 | AUAUUUGUU AGUGAUGC | 3089 |
| 414 | UGCAUCAC CUGAUGA GCCGUUAGGC GAA AACAAAUA | 10223 | UAUUUGUUA GUGAUGCA | 3090 |
| 429 | UAUGAAAG CUGAUGA GCCGUUAGGC GAA ACUCCCUG | 10224 | CAGGGAGUC CUUUCAUA | 3091 |
| 432 | CUCUAUGA CUGAUGA GCCGUUAGGC GAA AGGACUCC | 10225 | GGAGUCCUU UCAUAGAG | 3092 |
| 433 | UCUCUAUG CUGAUGA GCCGUUAGGC GAA AAGGACUC | 10226 | GAGUCCUUU CAUAGAGA | 3093 |
| 434 | AUCUCUAU CUGAUGA GCCGUUAGGC GAA AAAGGACU | 10227 | AGUCCUUUC AUAGAGAU | 3094 |
| 437 | UGCAUCUC CUGAUGA GCCGUUAGGC GAA AUGAAAGG | 10228 | CCUUUCAUA GAGAUGCA | 3095 |
| 455 | AGUUUGGG CUGAUGA GCCGUUAGGC GAA AUGUCAGU | 10229 | ACUGACAUA CCCAAACU | 3096 |
| 464 | AUGUGCAC CUGAUGA GCCGUUAGGC GAA AGUUUGGG | 10230 | CCCAAACUU GUGCACAU | 3097 |

167

| | | | | |
|---|---|---|---|---|
| 491 | GGGAUGAU CUGAUGA GCCGUUAGGC GAA AGCUGUCU | 10231 | AGACAGCUC AUCAUCCC | 3098 |
| 494 | CAGGGGAU CUGAUGA GCCGUUAGGC GAA AUGAGCUG | 10232 | CAGCUCAUC AUCCCCUG | 3099 |
| 497 | CGGCAGGG CUGAUGA GCCGUUAGGC GAA AUGAUGAG | 10233 | CUCAUCAUC CCCUGCCG | 3100 |
| 514 | CGUUGGGU CUGAUGA GCCGUUAGGC GAA ACGUCACC | 10234 | GGUGACGUC ACCCAACG | 3101 |
| 524 | GUGACUGU CUGAUGA GCCGUUAGGC GAA ACGUUGGG | 10235 | CCCAACGUC ACAGUCAC | 3102 |
| 530 | UUUAGGGU CUGAUGA GCCGUUAGGC GAA ACUGUGAC | 10236 | GUCACAGUC ACCCUAAA | 3103 |
| 536 | AACUUUUU CUGAUGA GCCGUUAGGC GAA AGGGUGAC | 10237 | GUCACCCUA AAAAAGUU | 3104 |
| 544 | CAAAUGGA CUGAUGA GCCGUUAGGC GAA ACUUUUUU | 10238 | AAAAAAGUU UCCAUUUG | 3105 |
| 545 | UCAAAUGG CUGAUGA GCCGUUAGGC GAA AACUUUUU | 10239 | AAAAAGUUU CCAUUUGA | 3106 |
| 546 | AUCAAAUG CUGAUGA GCCGUUAGGC GAA AAACUUUU | 10240 | AAAAGUUUC CAUUUGAU | 3107 |
| 550 | GAGUAUCA CUGAUGA GCCGUUAGGC GAA AUGGAAAC | 10241 | GUUUCCAUU UGAUACUC | 3108 |
| 551 | AGAGUAUC CUGAUGA GCCGUUAGGC GAA AAUGGAAA | 10242 | UUUCCAUUU GAUACUCU | 3109 |
| 555 | GGUAAGAG CUGAUGA GCCGUUAGGC GAA AUCAAAUG | 10243 | CAUUUGAUA CUCUUACC | 3110 |
| 558 | AGGGGUAA CUGAUGA GCCGUUAGGC GAA AGUAUCAA | 10244 | UUGAUACUC UUACCCCU | 3111 |
| 560 | UCAGGGGU CUGAUGA GCCGUUAGGC GAA AGAGUAUC | 10245 | GAUACUCUU ACCCCUGA | 3112 |
| 561 | AUCAGGGG CUGAUGA GCCGUUAGGC GAA AAGAGUAU | 10246 | AUACUCUUA CCCCUGAU | 3113 |
| 581 | UCCCAUGU CUGAUGA GCCGUUAGGC GAA AUUCUUUG | 10247 | CAAAGAAUA ACAUGGGA | 3114 |
| 594 | GCCUCUCC CUGAUGA GCCGUUAGGC GAA ACUGUCCC | 10248 | GGGACAGUA GGAGAGGC | 3115 |
| 604 | CUAUUAUA CUGAUGA GCCGUUAGGC GAA AGCCUCUC | 10249 | GAGAGGCUU UAUAAUAG | 3116 |
| 605 | GCUAUUAU CUGAUGA GCCGUUAGGC GAA AAGCCUCU | 10250 | AGAGGCUUU AUAAUAGC | 3117 |
| 606 | UGCUAUUA CUGAUGA GCCGUUAGGC GAA AAAGCCUC | 10251 | GAGGCUUUA UAAUAGCA | 3118 |
| 608 | UUUGCUAU CUGAUGA GCCGUUAGGC GAA AUAAAGCC | 10252 | GGCUUUAUA AUAGCAAA | 3119 |
| 611 | GCAUUUGC CUGAUGA GCCGUUAGGC GAA AUUAUAAA | 10253 | UUUAUAAUA GCAAAUGC | 3120 |
| 625 | UCUCUUUG CUGAUGA GCCGUUAGGC GAA ACGUUGCA | 10254 | UGCAACGUA CAAAGAGA | 3121 |
| 635 | AGCAGUCC CUGAUGA GCCGUUAGGC GAA AUCUCUUU | 10255 | AAAGAGAUA GGACUGCU | 3122 |
| 662 | UGCCCGUU CUGAUGA GCCGUUAGGC GAA ACGGUGGC | 10256 | GCCACCGUC AACGGGCA | 3123 |
| 676 | UUGUCUGG CUGAUGA GCCGUUAGGC GAA ACAGGUGC | 10257 | GCACCUGUA CCAGACAA | 3124 |
| 688 | GGGUCAGA CUGAUGA GCCGUUAGGC GAA AGUUUGUC | 10258 | GACAAACUA UCUGACCC | 3125 |
| 690 | AUGGGUCA CUGAUGA GCCGUUAGGC GAA AUAGUUUG | 10259 | CAAACUAUC UGACCCAU | 3126 |
| 699 | GGUCUGCC CUGAUGA GCCGUUAGGC GAA AUGGGUCA | 10260 | UGACCCAUC GGCAGACC | 3127 |
| 711 | UAGGAUUG CUGAUGA GCCGUUAGGC GAA AUUGGUCU | 10261 | AGACCAAUA CAAUCCUA | 3128 |
| 716 | ACAUCUAG CUGAUGA GCCGUUAGGC GAA AUUGUAUU | 10262 | AAUACAAUC CUAGAUGU | 3129 |
| 719 | UGGACAUC CUGAUGA GCCGUUAGGC GAA AGGAUUGU | 10263 | ACAAUCCUA GAUGUCCA | 3130 |
| 725 | CGUAUUUG CUGAUGA GCCGUUAGGC GAA ACAUCUAG | 10264 | CUAGAUGUC CAAAUACG | 3131 |
| 731 | GGCGGGCG CUGAUGA GCCGUUAGGC GAA AUUUGGAC | 10265 | GUCCAAAUA CGCCCGCC | 3132 |

168

| | | | | |
|---|---|---|---|---|
| 758 | UGCCCGUG CUGAUGA GCCGUUAGGC GAA AGCAGUCU | 10266 | AGACUGCUC CACGGGCA | 3133 |
| 771 | GAGGACAA CUGAUGA GCCGUUAGGC GAA AGUCUGCC | 10267 | GGCAGACUC UUGUCCUC | 3134 |
| 773 | UUGAGGAC CUGAUGA GCCGUUAGGC GAA AGAGUCUG | 10268 | CAGACUCUU GUCCUCAA | 3135 |
| 776 | CAGUUGAG CUGAUGA GCCGUUAGGC GAA ACAAGAGU | 10269 | ACUCUUGUC CUCAACUG | 3136 |
| 779 | GUGCAGUU CUGAUGA GCCGUUAGGC GAA AGGACAAG | 10270 | CUUGUCCUC AACUGCAC | 3137 |
| 803 | CUCGUAUU CUGAUGA GCCGUUAGGC GAA AGCUCCGU | 10271 | ACGGAGCUC AAUACGAG | 3138 |
| 807 | CACCCUCG CUGAUGA GCCGUUAGGC GAA AUUGAGCU | 10272 | AGCUCAAUA CGAGGGUG | 3139 |
| 831 | ACCAGGGU CUGAUGA GCCGUUAGGC GAA AUUCCAGC | 10273 | GCUGGAAUU ACCCUGGU | 3140 |
| 832 | UACCAGGG CUGAUGA GCCGUUAGGC GAA AAUUCCAG | 10274 | CUGGAAUUA CCCUGGUA | 3141 |
| 840 | AGUUGCUU CUGAUGA GCCGUUAGGC GAA ACCAGGGU | 10275 | ACCCUGGUA AAGCAACU | 3142 |
| 849 | UGCUCUCU CUGAUGA GCCGUUAGGC GAA AGUUGCUU | 10276 | AAGCAACUA AGAGAGCA | 3143 |
| 859 | GCCUUAUA CUGAUGA GCCGUUAGGC GAA AUGCUCUC | 10277 | GAGAGCAUC UAUAAGGC | 3144 |
| 861 | CUGCCUUA CUGAUGA GCCGUUAGGC GAA AGAUGCUC | 10278 | GAGCAUCUA UAAGGCAG | 3145 |
| 863 | CGCUGCCU CUGAUGA GCCGUUAGGC GAA AUAGAUGC | 10279 | GCAUCUAUA AGGCAGCG | 3146 |
| 875 | CUCCGGUC CUGAUGA GCCGUUAGGC GAA AUCCGCUG | 10280 | CAGCGGAUU GACCGGAG | 3147 |
| 888 | GUUGUGGG CUGAUGA GCCGUUAGGC GAA AUGGCUCC | 10281 | GGAGCCAUU CCCACAAC | 3148 |
| 889 | UGUUGUGG CUGAUGA GCCGUUAGGC GAA AAUGGCUC | 10282 | GAGCCAUUC CCACAACA | 3149 |
| 904 | CACUGUGG CUGAUGA GCCGUUAGGC GAA ACACAUUG | 10283 | CAAUGUGUU CCACAGUG | 3150 |
| 905 | ACACUGUG CUGAUGA GCCGUUAGGC GAA AACACAUU | 10284 | AAUGUGUUC CACAGUGU | 3151 |
| 914 | AUCUUAAG CUGAUGA GCCGUUAGGC GAA ACACUGUG | 10285 | CACAGUGUU CUUAAGAU | 3152 |
| 915 | GAUCUUAA CUGAUGA GCCGUUAGGC GAA AACACUGU | 10286 | ACAGUGUUC UUAAGAUC | 3153 |
| 917 | UUGAUCUU CUGAUGA GCCGUUAGGC GAA AGAACACU | 10287 | AGUGUUCUU AAGAUCAA | 3154 |
| 918 | GUUGAUCU CUGAUGA GCCGUUAGGC GAA AAGAACAC | 10288 | GUGUUCUUA AGAUCAAC | 3155 |
| 923 | ACAUUGUU CUGAUGA GCCGUUAGGC GAA AUCUUAAG | 10289 | CUUAAGAUC AACAAUGU | 3156 |
| 953 | CAGGUGUA CUGAUGA GCCGUUAGGC GAA AGCCCCUU | 10290 | AAGGGGCUC UACACCUG | 3157 |
| 955 | GACAGGUG CUGAUGA GCCGUUAGGC GAA AGAGCCCC | 10291 | GGGGCUCUA CACCUGUC | 3158 |
| 963 | CUUCACGC CUGAUGA GCCGUUAGGC GAA ACAGGUGU | 10292 | ACACCUGUC GCGUGAAG | 3159 |
| 979 | GGAACGAG CUGAUGA GCCGUUAGGC GAA ACCCACUC | 10293 | GAGUGGGUC CUCGUUCC | 3160 |
| 982 | ACUGGAAC CUGAUGA GCCGUUAGGC GAA AGGACCCA | 10294 | UGGGUCCUC GUUCCAGU | 3161 |
| 985 | AAGACUGG CUGAUGA GCCGUUAGGC GAA ACGAGGAC | 10295 | GUCCUCGUU CCAGUCUU | 3162 |
| 986 | AAAGACUG CUGAUGA GCCGUUAGGC GAA AACGAGGA | 10296 | UCCUCGUUC CAGUCUUU | 3163 |
| 991 | UGUUGAAA CUGAUGA GCCGUUAGGC GAA ACUGGAAC | 10297 | GUUCCAGUC UUUCAACA | 3164 |
| 993 | GGUGUUGA CUGAUGA GCCGUUAGGC GAA AGACUGGA | 10298 | UCCAGUCUU UCAACACC | 3165 |
| 994 | AGGUGUUG CUGAUGA GCCGUUAGGC GAA AAGACUGG | 10299 | CCAGUCUUU CAACACCU | 3166 |
| 995 | GAGGUGUU CUGAUGA GCCGUUAGGC GAA AAAGACUG | 10300 | CAGUCUUUC AACACCUC | 3167 |

| | | | | |
|---|---|---|---|---|
| 1003 | CAUGCACG CUGAUGA GCCGUUAGGC GAA AGGUGUUG | 10301 | CAACACCUC CGUGCAUG | 3168 |
| 1015 | CUUUUUCA CUGAUGA GCCGUUAGGC GAA ACACAUGC | 10302 | GCAUGUGUA UGAAAAAG | 3169 |
| 1027 | CACUGAUG CUGAUGA GCCGUUAGGC GAA AUCCUUUU | 10303 | AAAAGGAUU CAUCAGUG | 3170 |
| 1028 | ACACUGAU CUGAUGA GCCGUUAGGC GAA AAUCCUUU | 10304 | AAAGGAUUC AUCAGUGU | 3171 |
| 1031 | UUCACACU CUGAUGA GCCGUUAGGC GAA AUGAAUCC | 10305 | GGAUUCAUC AGUGUGAA | 3172 |
| 1044 | CUGCUUCC CUGAUGA GCCGUUAGGC GAA AUGUUUCA | 10306 | UGAAACAUC GGAAGCAG | 3173 |
| 1084 | GCCGAUAG CUGAUGA GCCGUUAGGC GAA ACCGUCUU | 10307 | AAGACGGUC CUAUCGGC | 3174 |
| 1087 | ACAGCCGA CUGAUGA GCCGUUAGGC GAA AGGACCGU | 10308 | ACGGUCCUA UCGGCUGU | 3175 |
| 1089 | GGACAGCC CUGAUGA GCCGUUAGGC GAA AUAGGACC | 10309 | GGUCCUAUC GGCUGUCC | 3176 |
| 1096 | CUUUCAUG CUGAUGA GCCGUUAGGC GAA ACAGCCGA | 10310 | UCGGCUGUC CAUGAAAG | 3177 |
| 1114 | GGGAGGGG CUGAUGA GCCGUUAGGC GAA AGGCCUUC | 10311 | GAAGGCCUU CCCCUCCC | 3178 |
| 1115 | GGGGAGGG CUGAUGA GCCGUUAGGC GAA AAGGCCUU | 10312 | AAGGCCUUC CCCUCCCC | 3179 |
| 1120 | UUUCUGGG CUGAUGA GCCGUUAGGC GAA AGGGGAAG | 10313 | CUUCCCCUC CCCAGAAA | 3180 |
| 1130 | AACCAUAC CUGAUGA GCCGUUAGGC GAA AUUUCUGG | 10314 | CCAGAAAUC GUAUGGUU | 3181 |
| 1133 | UUUAACCA CUGAUGA GCCGUUAGGC GAA ACGAUUUC | 10315 | GAAAUCGUA UGGUUAAA | 3182 |
| 1138 | CAUCUUUU CUGAUGA GCCGUUAGGC GAA ACCAUACG | 10316 | CGUAUGGUU AAAAGAUG | 3183 |
| 1139 | CCAUCUUU CUGAUGA GCCGUUAGGC GAA AACCAUAC | 7352 | GUAUGGUUA AAAGAUGG | 210 |
| 1150 | UUGCAGGC CUGAUGA GCCGUUAGGC GAA AGCCAUCU | 10317 | AGAUGGCUC GCCUGCAA | 3184 |
| 1162 | CAGACUUC CUGAUGA GCCGUUAGGC GAA AUGUUGCA | 10318 | UGCAACAUU GAAGUCUG | 3185 |
| 1168 | AGCGAGCA CUGAUGA GCCGUUAGGC GAA ACUUCAAU | 10319 | AUUGAAGUC UGCUCGCU | 3186 |
| 1173 | CAAAUAGC CUGAUGA GCCGUUAGGC GAA AGCAGACU | 10320 | AGUCUGCUC GCUAUUUG | 3187 |
| 1177 | GUACCAAA CUGAUGA GCCGUUAGGC GAA AGCGAGCA | 10321 | UGCUCGCUA UUUGGUAC | 3188 |
| 1179 | AUGUACCA CUGAUGA GCCGUUAGGC GAA AUAGCGAG | 10322 | CUCGCUAUU UGGUACAU | 3189 |
| 1180 | CAUGUACC CUGAUGA GCCGUUAGGC GAA AAUAGCGA | 10323 | UCGCUAUUU GGUACAUG | 3190 |
| 1184 | UAGCCAUG CUGAUGA GCCGUUAGGC GAA ACCAAAUA | 10324 | UAUUUGGUA CAUGGCUA | 3191 |
| 1192 | UUAAUGAG CUGAUGA GCCGUUAGGC GAA AGCCAUGU | 10325 | ACAUGGCUA CUCAUUAA | 3192 |
| 1195 | UAAUUAAU CUGAUGA GCCGUUAGGC GAA AGUAGCCA | 10326 | UGGCUACUC AUUAAUUA | 3193 |
| 1198 | UGAUAAUU CUGAUGA GCCGUUAGGC GAA AUGAGUAG | 10327 | CUACUCAUU AAUUAUCA | 3194 |
| 1199 | UUGAUAAU CUGAUGA GCCGUUAGGC GAA AAUGAGUA | 10328 | UACUCAUUA AUUAUCAA | 3195 |
| 1202 | UCUUUGAU CUGAUGA GCCGUUAGGC GAA AUUAAUGA | 10329 | UCAUUAAUU AUCAAAGA | 3196 |
| 1203 | AUCUUUGA CUGAUGA GCCGUUAGGC GAA AAUUAAUG | 10330 | CAUUAAUUA UCAAAGAU | 3197 |
| 1205 | ACAUCUUU CUGAUGA GCCGUUAGGC GAA AUAAUUAA | 10331 | UUAAUUAUC AAAGAUGU | 3198 |
| 1237 | AGAUCGUA CUGAUGA GCCGUUAGGC GAA AGUCCCCU | 10332 | AGGGGACUA UACGAUCU | 3199 |
| 1239 | CAAGAUCG CUGAUGA GCCGUUAGGC GAA AUAGUCCC | 10333 | GGGACUAUA CGAUCUUG | 3200 |
| 1244 | CCCAGCAA CUGAUGA GCCGUUAGGC GAA AUCGUAUA | 10334 | UAUACGAUC UUGCUGGG | 3201 |

170

| | | | | |
|---|---|---|---|---|
| 1246 | UGCCCAGC CUGAUGA GCCGUUAGGC GAA AGAUCGUA | 10335 | UACGAUCUU GCUGGGCA | 3202 |
| 1256 | GACUGCUU CUGAUGA GCCGUUAGGC GAA AUGCCCAG | 10336 | CUGGGCAUA AAGCAGUC | 3203 |
| 1264 | AUAGCCUU CUGAUGA GCCGUUAGGC GAA ACUGCUUU | 10337 | AAAGCAGUC AAGGCUAU | 3204 |
| 1271 | UUUUUAAA CUGAUGA GCCGUUAGGC GAA AGCCUUGA | 10338 | UCAAGGCUA UUUAAAAA | 3205 |
| 1273 | GGUUUUUA CUGAUGA GCCGUUAGGC GAA AUAGCCUU | 10339 | AAGGCUAUU UAAAAACC | 3206 |
| 1274 | AGGUUUUU CUGAUGA GCCGUUAGGC GAA AAUAGCCU | 10340 | AGGCUAUUU AAAAACCU | 3207 |
| 1275 | GAGGUUUU CUGAUGA GCCGUUAGGC GAA AAAUAGCC | 10341 | GGCUAUUUA AAAACCUC | 3208 |
| 1283 | GUGGCAGU CUGAUGA GCCGUUAGGC GAA AGGUUUUU | 7379 | AAAAACCUC ACUGCCAC | 237 |
| 1293 | UACAAUGA CUGAUGA GCCGUUAGGC GAA AGUGGCAG | 10342 | CUGCCACUC UCAUUGUA | 3209 |
| 1295 | UUUACAAU CUGAUGA GCCGUUAGGC GAA AGAGUGGC | 10343 | GCCACUCUC AUUGUAAA | 3210 |
| 1298 | ACGUUUAC CUGAUGA GCCGUUAGGC GAA AUGAGAGU | 10344 | ACUCUCAUU GUAAACGU | 3211 |
| 1301 | UUCACGUU CUGAUGA GCCGUUAGGC GAA ACAAUGAG | 10345 | CUCAUUGUA AACGUGAA | 3212 |
| 1314 | GUAGAUCU CUGAUGA GCCGUUAGGC GAA AGGUUUCA | 10346 | UGAAACCUC AGAUCUAC | 3213 |
| 1319 | UUUUCGUA CUGAUGA GCCGUUAGGC GAA AUCUGAGG | 10347 | CCUCAGAUC UACGAAAA | 3214 |
| 1321 | ACUUUUCG CUGAUGA GCCGUUAGGC GAA AGAUCUGA | 10348 | UCAGAUCUA CGAAAAGU | 3215 |
| 1330 | AGGACACG CUGAUGA GCCGUUAGGC GAA ACUUUUCG | 10349 | CGAAAAGUC CGUGUCCU | 3216 |
| 1336 | GAAGCGAG CUGAUGA GCCGUUAGGC GAA ACACGGAC | 10350 | GUCCGUGUC CUCGCUUC | 3217 |
| 1339 | UUGGAAGC CUGAUGA GCCGUUAGGC GAA AGGACACG | 10351 | CGUGUCCUC GCUUCCAA | 3218 |
| 1343 | GGGCUUGG CUGAUGA GCCGUUAGGC GAA AGCGAGGA | 10352 | UCCUCGCUU CCAAGCCC | 3219 |
| 1344 | UGGGCUUG CUGAUGA GCCGUUAGGC GAA AAGCGAGG | 10353 | CCUCGCUUC CAAGCCCA | 3220 |
| 1356 | CGGAUAGA CUGAUGA GCCGUUAGGC GAA AGGUGGGC | 10354 | GCCCACCUC UCUAUCCG | 3221 |
| 1358 | AGCGGAUA CUGAUGA GCCGUUAGGC GAA AGAGGUGG | 10355 | CCACCUCUC UAUCCGCU | 3222 |
| 1360 | CCAGCGGA CUGAUGA GCCGUUAGGC GAA AGAGAGGU | 10356 | ACCUCUCUA UCCGCUGG | 3223 |
| 1362 | GCCCAGCG CUGAUGA GCCGUUAGGC GAA AUAGAGAG | 10357 | CUCUCUAUC CGCUGGGC | 3224 |
| 1382 | CAAGUGAG CUGAUGA GCCGUUAGGC GAA ACUUGUCU | 10358 | AGACAAGUC CUCACUUG | 3225 |
| 1385 | GUGCAAGU CUGAUGA GCCGUUAGGC GAA AGGACUUG | 10359 | CAAGUCCUC ACUUGCAC | 3226 |
| 1389 | CACGGUGC CUGAUGA GCCGUUAGGC GAA AGUGAGGA | 10360 | UCCUCACUU GCACCGUG | 3227 |
| 1399 | GGAUGCCA CUGAUGA GCCGUUAGGC GAA ACACGGUG | 10361 | CACCGUGUA UGGCAUCC | 3228 |
| 1406 | GGCCGAGG CUGAUGA GCCGUUAGGC GAA AUGCCAUA | 10362 | UAUGGCAUC CCUCGGCC | 3229 |
| 1410 | UGUUGGCC CUGAUGA GCCGUUAGGC GAA AGGGAUGC | 10363 | GCAUCCCUC GGCCAACA | 3230 |
| 1421 | AGCCACGU CUGAUGA GCCGUUAGGC GAA AUUGUUGG | 10364 | CCAACAAUC ACGUGGCU | 3231 |
| 1430 | GGGUGCCA CUGAUGA GCCGUUAGGC GAA AGCCACGU | 10365 | ACGUGGCUC UGGCACCC | 3232 |
| 1443 | AUUGUGGU CUGAUGA GCCGUUAGGC GAA ACAGGGGU | 10366 | ACCCCUGUC ACCACAAU | 3233 |
| 1452 | UUUGGAGU CUGAUGA GCCGUUAGGC GAA AUUGUGGU | 10367 | ACCACAAUC ACUCCAAA | 3234 |
| 1456 | UUUCUUUG CUGAUGA GCCGUUAGGC GAA AGUGAUUG | 10368 | CAAUCACUC CAAAGAAA | 3235 |

171

| | | | | |
|---|---|---|---|---|
| 1468 | AGAAGUCA CUGAUGA GCCGUUAGGC GAA ACCUUUCU | 10369 | AGAAAGGUA UGACUUCU | 3236 |
| 1474 | CAGUGCAG CUGAUGA GCCGUUAGGC GAA AGUCAUAC | 10370 | GUAUGACUU CUGCACUG | 3237 |
| 1475 | UCAGUGCA CUGAUGA GCCGUUAGGC GAA AAGUCAUA | 10371 | UAUGACUUC UGCACUGA | 3238 |
| 1495 | GGAUAAAG CUGAUGA GCCGUUAGGC GAA AUUCUUCA | 10372 | UGAAGAAUC CUUUAUCC | 3239 |
| 1498 | CCAGGAUA CUGAUGA GCCGUUAGGC GAA AGGAUUCU | 10373 | AGAAUCCUU UAUCCUGG | 3240 |
| 1499 | UCCAGGAU CUGAUGA GCCGUUAGGC GAA AAGGAUUC | 10374 | GAAUCCUUU AUCCUGGA | 3241 |
| 1500 | AUCCAGGA CUGAUGA GCCGUUAGGC GAA AAAGGAUU | 10375 | AAUCCUUUA UCCUGGAU | 3242 |
| 1502 | GGAUCCAG CUGAUGA GCCGUUAGGC GAA AUAAAGGA | 10376 | UCCUUUAUC CUGGAUCC | 3243 |
| 1509 | GCUGCUGG CUGAUGA GCCGUUAGGC GAA AUCCAGGA | 10377 | UCCUGGAUC CCAGCAGC | 3244 |
| 1522 | UGUUUCCU CUGAUGA GCCGUUAGGC GAA AGUUGCUG | 10378 | CAGCAACUU AGGAAACA | 3245 |
| 1523 | CUGUUUCC CUGAUGA GCCGUUAGGC GAA AAGUUGCU | 10379 | AGCAACUUA GGAAACAG | 3246 |
| 1535 | AUGCUCUC CUGAUGA GCCGUUAGGC GAA AUUCUGUU | 7422 | AACAGAAUU GAGAGCAU | 280 |
| 1544 | CGCUGAGA CUGAUGA GCCGUUAGGC GAA AUGCUCUC | 10380 | GAGAGCAUC UCUCAGCG | 3247 |
| 1546 | UGCGCUGA CUGAUGA GCCGUUAGGC GAA AGAUGCUC | 10381 | GAGCAUCUC UCAGCGCA | 3248 |
| 1548 | CAUGCGCU CUGAUGA GCCGUUAGGC GAA AGAGAUGC | 10382 | GCAUCUCUC AGCGCAUG | 3249 |
| 1562 | CCUUCUAU CUGAUGA GCCGUUAGGC GAA ACCGUCAU | 10383 | AUGACGGUC AUAGAAGG | 3250 |
| 1565 | GUUCCUUC CUGAUGA GCCGUUAGGC GAA AUGACCGU | 10384 | ACGGUCAUA GAAGGAAC | 3251 |
| 1578 | AACCGUCU CUGAUGA GCCGUUAGGC GAA AUUUGUUC | 10385 | GAACAAAUA AGACGGUU | 3252 |
| 1586 | AAUGUGCU CUGAUGA GCCGUUAGGC GAA ACCGUCUU | 10386 | AAGACGGUU AGCACAUU | 3253 |
| 1587 | CAAUGUGC CUGAUGA GCCGUUAGGC GAA AACCGUCU | 10387 | AGACGGUUA GCACAUUG | 3254 |
| 1594 | CCACCACC CUGAUGA GCCGUUAGGC GAA AUGUGCUA | 10388 | UAGCACAUU GGUGGUGG | 3255 |
| 1609 | GGGUCUGA CUGAUGA GCCGUUAGGC GAA AGUCAGCC | 10389 | GGCUGACUC UCAGACCC | 3256 |
| 1611 | AGGGGUCU CUGAUGA GCCGUUAGGC GAA AGAGUCAG | 10390 | CUGACUCUC AGACCCCU | 3257 |
| 1625 | CAGCUGUA CUGAUGA GCCGUUAGGC GAA AUUCCAGG | 10391 | CCUGGAAUC UACAGCUG | 3258 |
| 1627 | GGCAGCUG CUGAUGA GCCGUUAGGC GAA AGAUUCCA | 10392 | UGGAAUCUA CAGCUGCC | 3259 |
| 1642 | UUUUAUUG CUGAUGA GCCGUUAGGC GAA AGGCCCGG | 10393 | CCGGGCCUU CAAUAAAA | 3260 |
| 1643 | AUUUUAUU CUGAUGA GCCGUUAGGC GAA AAGGCCCG | 10394 | CGGGCCUUC AAUAAAAU | 3261 |
| 1647 | CCCUAUUU CUGAUGA GCCGUUAGGC GAA AUUGAAGG | 10395 | CCUUCAAUA AAAUAGGG | 3262 |
| 1652 | ACAGUCCC CUGAUGA GCCGUUAGGC GAA AUUUUAUU | 10396 | AAUAAAAUA GGGACUGU | 3263 |
| 1673 | UAAAAUUU CUGAUGA GCCGUUAGGC GAA AUGUUUCU | 10397 | AGAAACAUA AAAUUUUA | 3264 |
| 1678 | UGACAUAA CUGAUGA GCCGUUAGGC GAA AUUUUAUG | 10398 | CAUAAAAUU UUAUGUCA | 3265 |
| 1679 | GUGACAUA CUGAUGA GCCGUUAGGC GAA AAUUUUAU | 10399 | AUAAAAUUU UAUGUCAC | 3266 |
| 1680 | UGUGACAU CUGAUGA GCCGUUAGGC GAA AAAUUUUA | 10400 | UAAAAUUUU AUGUCACA | 3267 |
| 1681 | CUGUGACA CUGAUGA GCCGUUAGGC GAA AAAAUUUU | 10401 | AAAAUUUUA UGUCACAG | 3268 |
| 1685 | ACAUCUGU CUGAUGA GCCGUUAGGC GAA ACAUAAAA | 10402 | UUUUAUGUC ACAGAUGU | 3269 |

172

| | | | | |
|---|---|---|---|---|
| 1705 | AAACGUGA CUGAUGA GCCGUUAGGC GAA AGCCAUUC | 10403 | GAAUGGCUU UCACGUUU | 3270 |
| 1706 | GAAACGUG CUGAUGA GCCGUUAGGC GAA AAGCCAUU | 10404 | AAUGGCUUU CACGUUUC | 3271 |
| 1707 | GGAAACGU CUGAUGA GCCGUUAGGC GAA AAAGCCAU | 10405 | AUGGCUUUC ACGUUUCC | 3272 |
| 1712 | UCCAAGGA CUGAUGA GCCGUUAGGC GAA ACGUGAAA | 10406 | UUUCACGUU UCCUUGGA | 3273 |
| 1713 | UUCCAAGG CUGAUGA GCCGUUAGGC GAA AACGUGAA | 10407 | UUCACGUUU CCUUGGAA | 3274 |
| 1714 | UUUCCAAG CUGAUGA GCCGUUAGGC GAA AAACGUGA | 10408 | UCACGUUUC CUUGGAAA | 3275 |
| 1717 | UCUUUUCC CUGAUGA GCCGUUAGGC GAA AGGAAACG | 10409 | CGUUUCCUU GGAAAAGA | 3276 |
| 1756 | CCACACAG CUGAUGA GCCGUUAGGC GAA ACAGUUUC | 10410 | GAAACUGUC CUGUGUGG | 3277 |
| 1766 | AAUUUAUU CUGAUGA GCCGUUAGGC GAA ACCACACA | 10411 | UGUGUGGUC AAUAAAUU | 3278 |
| 1770 | CAGGAAUU CUGAUGA GCCGUUAGGC GAA AUUGACCA | 10412 | UGGUCAAUA AAUUCCUG | 3279 |
| 1774 | UGUACAGG CUGAUGA GCCGUUAGGC GAA AUUUAUUG | 10413 | CAAUAAAUU CCUGUACA | 3280 |
| 1775 | CUGUACAG CUGAUGA GCCGUUAGGC GAA AAUUUAUU | 10414 | AAUAAAUUC CUGUACAG | 3281 |
| 1780 | UGUCUCUG CUGAUGA GCCGUUAGGC GAA ACAGGAAU | 10415 | AUUCCUGUA CAGAGACA | 3282 |
| 1790 | AUCCAGGU CUGAUGA GCCGUUAGGC GAA AUGUCUCU | 10416 | AGAGACAUU ACCUGGAU | 3283 |
| 1791 | AAUCCAGG CUGAUGA GCCGUUAGGC GAA AAUGUCUC | 10417 | GAGACAUUA CCUGGAUU | 3284 |
| 1799 | CGUAGCAG CUGAUGA GCCGUUAGGC GAA AUCCAGGU | 10418 | ACCUGGAUU CUGCUACG | 3285 |
| 1800 | CCGUAGCA CUGAUGA GCCGUUAGGC GAA AAUCCAGG | 10419 | CCUGGAUUC UGCUACGG | 3286 |
| 1805 | ACUGUCCG CUGAUGA GCCGUUAGGC GAA AGCAGAAU | 10420 | AUUCUGCUA CGGACAGU | 3287 |
| 1814 | CUGUUGUU CUGAUGA GCCGUUAGGC GAA ACUGUCCG | 10421 | CGGACAGUU AACAACAG | 3288 |
| 1815 | UCUGUUGU CUGAUGA GCCGUUAGGC GAA AACUGUCC | 10422 | GGACAGUUA ACAACAGA | 3289 |
| 1836 | GCUGAUAC CUGAUGA GCCGUUAGGC GAA AUGGUGCA | 10423 | UGCACCAUA GUAUCAGC | 3290 |
| 1839 | CUUGCUGA CUGAUGA GCCGUUAGGC GAA ACUAUGGU | 10424 | ACCAUAGUA UCAGCAAG | 3291 |
| 1841 | UGCUUGCU CUGAUGA GCCGUUAGGC GAA AUACUAUG | 10425 | CAUAGUAUC AGCAAGCA | 3292 |
| 1866 | GUAAUCUU CUGAUGA GCCGUUAGGC GAA AGUGGUGG | 10426 | CCACCACUC AAGAUUAC | 3293 |
| 1872 | GAUGGAGU CUGAUGA GCCGUUAGGC GAA AUCUUGAG | 10427 | CUCAAGAUU ACUCCAUC | 3294 |
| 1873 | UGAUGGAG CUGAUGA GCCGUUAGGC GAA AAUCUUGA | 10428 | UCAAGAUUA CUCCAUCA | 3295 |
| 1876 | GAGUGAUG CUGAUGA GCCGUUAGGC GAA AGUAAUCU | 10429 | AGAUUACUC CAUCACUC | 3296 |
| 1880 | UUCAGAGU CUGAUGA GCCGUUAGGC GAA AUGGAGUA | 10430 | UACUCCAUC ACUCUGAA | 3297 |
| 1884 | AAGGUUCA CUGAUGA GCCGUUAGGC GAA AGUGAUGG | 10431 | CCAUCACUC UGAACCUU | 3298 |
| 1892 | UUGAUGAC CUGAUGA GCCGUUAGGC GAA AGGUUCAG | 10432 | CUGAACCUU GUCAUCAA | 3299 |
| 1895 | UUCUUGAU CUGAUGA GCCGUUAGGC GAA ACAAGGUU | 10433 | AACCUUGUC AUCAAGAA | 3300 |
| 1898 | ACGUUCUU CUGAUGA GCCGUUAGGC GAA AUGACAAG | 10434 | CUUGUCAUC AAGAACGU | 3301 |
| 1909 | CUUCUAGA CUGAUGA GCCGUUAGGC GAA ACACGUUC | 10435 | GAACGUGUC UCUAGAAG | 3302 |
| 1911 | GUCUUCUA CUGAUGA GCCGUUAGGC GAA AGACACGU | 10436 | ACGUGUCUC UAGAAGAC | 3303 |
| 1913 | GAGUCUUC CUGAUGA GCCGUUAGGC GAA AGAGACAC | 10437 | GUGUCUCUA GAAGACUC | 3304 |

| | | | | |
|---|---|---|---|---|
| 1921 | AGGUGCCC CUGAUGA GCCGUUAGGC GAA AGUCUUCU | 10438 | AGAAGACUC GGGCACCU | 3305 |
| 1930 | UGCACGCA CUGAUGA GCCGUUAGGC GAA AGGUGCCC | 10439 | GGGCACCUA UGCGUGCA | 3306 |
| 1952 | CCUGUGUA CUGAUGA GCCGUUAGGC GAA AUGUUCCU | 10440 | AGGAACAUA UACACAGG | 3307 |
| 1954 | CCCCUGUG CUGAUGA GCCGUUAGGC GAA AUAUGUUC | 10441 | GAACAUAUA CACAGGGG | 3308 |
| 1970 | UUCCGAAG CUGAUGA GCCGUUAGGC GAA AUGUCUUC | 10442 | GAAGACAUC CUUCGGAA | 3309 |
| 1973 | GUCUUCCG CUGAUGA GCCGUUAGGC GAA AGGAUGUC | 10443 | GACAUCCUU CGGAAGAC | 3310 |
| 1974 | UGUCUUCC CUGAUGA GCCGUUAGGC GAA AAGGAUGU | 10444 | ACAUCCUUC GGAAGACA | 3311 |
| 1988 | CUAACGAG CUGAUGA GCCGUUAGGC GAA ACUUCUGU | 10445 | ACAGAAGUU CUCGUUAG | 3312 |
| 1989 | UCUAACGA CUGAUGA GCCGUUAGGC GAA AACUUCUG | 10446 | CAGAAGUUC UCGUUAGA | 3313 |
| 1991 | UCUCUAAC CUGAUGA GCCGUUAGGC GAA AGAACUUC | 10447 | GAAGUUCUC GUUAGAGA | 3314 |
| 1994 | GAAUCUCU CUGAUGA GCCGUUAGGC GAA ACGAGAAC | 10448 | GUUCUCGUU AGAGAUUC | 3315 |
| 1995 | CGAAUCUC CUGAUGA GCCGUUAGGC GAA AACGAGAA | 10449 | UUCUCGUUA GAGAUUCG | 3316 |
| 2001 | CGCUUCCG CUGAUGA GCCGUUAGGC GAA AUCUCUAA | 10450 | UUAGAGAUU CGGAAGCG | 3317 |
| 2002 | GCGCUUCC CUGAUGA GCCGUUAGGC GAA AAUCUCUA | 10451 | UAGAGAUUC GGAAGCGC | 3318 |
| 2021 | AGGUUUUG CUGAUGA GCCGUUAGGC GAA AGCAGGUG | 10452 | CACCUGCUU CAAAACCU | 3319 |
| 2022 | GAGGUUUU CUGAUGA GCCGUUAGGC GAA AAGCAGGU | 10453 | ACCUGCUUC AAAACCUC | 3320 |
| 2030 | UAGUCACU CUGAUGA GCCGUUAGGC GAA AGGUUUUG | 10454 | CAAAACCUC AGUGACUA | 3321 |
| 2038 | AGACCUCG CUGAUGA GCCGUUAGGC GAA AGUCACUG | 10455 | CAGUGACUA CGAGGUCU | 3322 |
| 2045 | CUGAUGGA CUGAUGA GCCGUUAGGC GAA ACCUCGUA | 10456 | UACGAGGUC UCCAUCAG | 3323 |
| 2047 | CACUGAUG CUGAUGA GCCGUUAGGC GAA AGACCUCG | 10457 | CGAGGUCUC CAUCAGUG | 3324 |
| 2051 | GAGCCACU CUGAUGA GCCGUUAGGC GAA AUGGAGAC | 10458 | GUCUCCAUC AGUGGCUC | 3325 |
| 2059 | AGGUCGUA CUGAUGA GCCGUUAGGC GAA AGCCACUG | 10459 | CAGUGGCUC UACGACCU | 3326 |
| 2061 | UAAGGUCG CUGAUGA GCCGUUAGGC GAA AGAGCCAC | 10460 | GUGGCUCUA CGACCUUA | 3327 |
| 2068 | GACAGUCU CUGAUGA GCCGUUAGGC GAA AGGUCGUA | 10461 | UACGACCUU AGACUGUC | 3328 |
| 2069 | UGACAGUC CUGAUGA GCCGUUAGGC GAA AAGGUCGU | 10462 | ACGACCUUA GACUGUCA | 3329 |
| 2076 | UCUAGCUU CUGAUGA GCCGUUAGGC GAA ACAGUCUA | 10463 | UAGACUGUC AAGCUAGA | 3330 |
| 2082 | GACACCUC CUGAUGA GCCGUUAGGC GAA AGCUUGAC | 10464 | GUCAAGCUA GAGGUGUC | 3331 |
| 2090 | GGCGCGGG CUGAUGA GCCGUUAGGC GAA ACACCUCU | 10465 | AGAGGUGUC CCCGCGCC | 3332 |
| 2100 | AGUGAUCU CUGAUGA GCCGUUAGGC GAA AGGCGCGG | 10466 | CCGCGCCUC AGAUCACU | 3333 |
| 2105 | AACCAAGU CUGAUGA GCCGUUAGGC GAA AUCUGAGG | 7520 | CCUCAGAUC ACUUGGUU | 378 |
| 2109 | UUUGAACC CUGAUGA GCCGUUAGGC GAA AGUGAUCU | 10467 | AGAUCACUU GGUUCAAA | 3334 |
| 2113 | UGUUUUUG CUGAUGA GCCGUUAGGC GAA ACCAAGUG | 10468 | CACUUGGUU CAAAAACA | 3335 |
| 2114 | UUGUUUUU CUGAUGA GCCGUUAGGC GAA AACCAAGU | 7523 | ACUUGGUUC AAAAACAA | 3336 |
| 2132 | UCUUGUUG CUGAUGA GCCGUUAGGC GAA AUUUUGUG | 7525 | CACAAAAUA CAACAAGA | 383 |
| 2150 | CCUAAAAU CUGAUGA GCCGUUAGGC GAA AUUCCCGG | 10469 | CCGGGAAUU AUUUUAGG | 3337 |

174

| | | | | |
|---|---|---|---|---|
| 2151 | UCCUAAAA CUGAUGA GCCGUUAGGC GAA AAUUCCCG | 10470 | CGGGAAUUA UUUUAGGA | 3338 |
| 2153 | GGUCCUAA CUGAUGA GCCGUUAGGC GAA AUAAUUCC | 7528 | GGAAUUAUU UUAGGACC | 386 |
| 2154 | UGGUCCUA CUGAUGA GCCGUUAGGC GAA AAUAAUUC | 7529 | GAAUUAUUU UAGGACCA | 387 |
| 2155 | CUGGUCCU CUGAUGA GCCGUUAGGC GAA AAAUAAUU | 7530 | AAUUAUUUU AGGACCAG | 388 |
| 2156 | CCUGGUCC CUGAUGA GCCGUUAGGC GAA AAAAUAAU | 7531 | AUUAUUUUA GGACCAGG | 389 |
| 2179 | UUUCAAUA CUGAUGA GCCGUUAGGC GAA ACAGCGUG | 7532 | CACGCUGUU UAUUGAAA | 390 |
| 2180 | CUUUCAAU CUGAUGA GCCGUUAGGC GAA AACAGCGU | 7533 | ACGCUGUUU AUUGAAAG | 391 |
| 2181 | UCUUUCAA CUGAUGA GCCGUUAGGC GAA AAACAGCG | 7534 | CGCUGUUUA UUGAAAGA | 392 |
| 2183 | ACUCUUUC CUGAUGA GCCGUUAGGC GAA AUAAACAG | 7535 | CUGUUUAUU GAAAGAGU | 393 |
| 2192 | UCCUCUGU CUGAUGA GCCGUUAGGC GAA ACUCUUUC | 10471 | GAAAGAGUC ACAGAGGA | 3339 |
| 2213 | CACCUAUA CUGAUGA GCCGUUAGGC GAA ACACCCUC | 10472 | GAGGGUGUC UAUAGGUG | 3340 |
| 2215 | GGCACCUA CUGAUGA GCCGUUAGGC GAA AGACACCC | 10473 | GGGUGUCUA UAGGUGCC | 3341 |
| 2217 | UCGGCACC CUGAUGA GCCGUUAGGC GAA AUAGACAC | 10474 | GUGUCUAUA GGUGCCGA | 3342 |
| 2263 | CGGUGAGG CUGAUGA GCCGUUAGGC GAA AGGCUGCG | 10475 | CGCAGCCUA CCUCACCG | 3343 |
| 2267 | UGCACGGU CUGAUGA GCCGUUAGGC GAA AGGUAGGC | 10476 | GCCUACCUC ACCGUGCA | 3344 |
| 2284 | ACUUGUCU CUGAUGA GCCGUUAGGC GAA AGGUUCCU | 10477 | AGGAACCUC AGACAAGU | 3345 |
| 2293 | CCAGGUUU CUGAUGA GCCGUUAGGC GAA ACUUGUCU | 10478 | AGACAAGUC AAACCUGG | 3346 |
| 2309 | GUGAGCGU CUGAUGA GCCGUUAGGC GAA AUCAGCUC | 10479 | GAGCUGAUC ACGCUCAC | 3347 |
| 2315 | GUGCACGU CUGAUGA GCCGUUAGGC GAA AGCGUGAU | 10480 | AUCACGCUC ACGUGCAC | 3348 |
| 2342 | AGCCAAAA CUGAUGA GCCGUUAGGC GAA AGGGUCGC | 10481 | GCGACCCUC UUUUGGCU | 3349 |
| 2344 | GGAGCCAA CUGAUGA GCCGUUAGGC GAA AGAGGGUC | 10482 | GACCCUCUU UUGGCUCC | 3350 |
| 2345 | AGGAGCCA CUGAUGA GCCGUUAGGC GAA AAGAGGGU | 10483 | ACCCUCUUU UGGCUCCU | 3351 |
| 2346 | AAGGAGCC CUGAUGA GCCGUUAGGC GAA AAAGAGGG | 10484 | CCCUCUUUU GGCUCCUU | 3352 |
| 2351 | GUUAGAAG CUGAUGA GCCGUUAGGC GAA AGCCAAAA | 10485 | UUUUGGCUC CUUCUAAC | 3353 |
| 2354 | AGAGUUAG CUGAUGA GCCGUUAGGC GAA AGGAGCCA | 10486 | UGGCUCCUU CUAACUCU | 3354 |
| 2355 | GAGAGUUA CUGAUGA GCCGUUAGGC GAA AAGGAGCC | 10487 | GGCUCCUUC UAACUCUC | 3355 |
| 2357 | AAGAGAGU CUGAUGA GCCGUUAGGC GAA AGAAGGAG | 10488 | CUCCUUCUA ACUCUCUU | 3356 |
| 2361 | GAUGAAGA CUGAUGA GCCGUUAGGC GAA AGUUAGAA | 10489 | UUCUAACUC UCUUCAUC | 3357 |
| 2363 | CUGAUGAA CUGAUGA GCCGUUAGGC GAA AGAGUUAG | 10490 | CUAACUCUC UUCAUCAG | 3358 |
| 2365 | UUCUGAUG CUGAUGA GCCGUUAGGC GAA AGAGAGUU | 10491 | AACUCUCUU CAUCAGAA | 3359 |
| 2366 | UUUCUGAU CUGAUGA GCCGUUAGGC GAA AAGAGAGU | 10492 | ACUCUCUUC AUCAGAAA | 3360 |
| 2369 | AGUUUUCU CUGAUGA GCCGUUAGGC GAA AUGAAGAG | 10493 | CUCUUCAUC AGAAAACU | 3361 |
| 2386 | CGGAAGAA CUGAUGA GCCGUUAGGC GAA ACCGCUUC | 10494 | GAAGCGGUC UUCUUCCG | 3362 |
| 2388 | UUCGGAAG CUGAUGA GCCGUUAGGC GAA AGACCGCU | 10495 | AGCGGUCUU CUUCCGAA | 3363 |
| 2389 | CUUCGGAA CUGAUGA GCCGUUAGGC GAA AAGACCGC | 10496 | GCGGUCUUC UUCCGAAG | 3364 |

175

| | | | | |
|---|---|---|---|---|
| 2391 | UACUUCGG CUGAUGA GCCGUUAGGC GAA AGAAGACC | 10497 | GGUCUUCUU CCGAAGUA | 3365 |
| 2392 | UUACUUCG CUGAUGA GCCGUUAGGC GAA AAGAAGAC | 10498 | GUCUUCUUC CGAAGUAA | 3366 |
| 2399 | UCUGUCUU CUGAUGA GCCGUUAGGC GAA ACUUCGGA | 10499 | UCCGAAGUA AAGACAGA | 3367 |
| 2410 | UUGACAGG CUGAUGA GCCGUUAGGC GAA AGUCUGUC | 10500 | GACAGACUA CCUGUCAA | 3368 |
| 2416 | UAAUGAUU CUGAUGA GCCGUUAGGC GAA ACAGGUAG | 10501 | CUACCUGUC AAUCAUUA | 3369 |
| 2420 | UCCAUAAU CUGAUGA GCCGUUAGGC GAA AUUGACAG | 10502 | CUGUCAAUC AUUAUGGA | 3370 |
| 2423 | GGGUCCAU CUGAUGA GCCGUUAGGC GAA AUGAUUGA | 10503 | UCAAUCAUU AUGGACCC | 3371 |
| 2424 | UGGGUCCA CUGAUGA GCCGUUAGGC GAA AAUGAUUG | 10504 | CAAUCAUUA UGGACCCA | 3372 |
| 2441 | UCCAGGGG CUGAUGA GCCGUUAGGC GAA ACUUCAUC | 10505 | GAUGAAGUU CCCCUGGA | 3373 |
| 2442 | AUCCAGGG CUGAUGA GCCGUUAGGC GAA AACUUCAU | 10506 | AUGAAGUUC CCCUGGAU | 3374 |
| 2473 | UGGCAUCA CUGAUGA GCCGUUAGGC GAA AGGGCAGC | 10507 | GCUGCCCUA UGAUGCCA | 3375 |
| 2494 | CCCGUGCA CUGAUGA GCCGUUAGGC GAA ACUCCCAC | 10508 | GUGGGAGUU UGCACGGG | 3376 |
| 2495 | UCCCGUGC CUGAUGA GCCGUUAGGC GAA AACUCCCA | 10509 | UGGGAGUUU GCACGGGA | 3377 |
| 2516 | GAUUUGCC CUGAUGA GCCGUUAGGC GAA AGUUUCAG | 10510 | CUGAAACUA GGCAAAUC | 3378 |
| 2524 | UUCCGAGC CUGAUGA GCCGUUAGGC GAA AUUUGCCU | 10511 | AGGCAAAUC GCUCGGAA | 3379 |
| 2528 | CCUCUUCC CUGAUGA GCCGUUAGGC GAA AGCGAUUU | 10512 | AAAUCGCUC GGAAGAGG | 3380 |
| 2541 | UUUCCCAA CUGAUGA GCCGUUAGGC GAA AGCCCCUC | 10513 | GAGGGGCUU UUGGGAAA | 3381 |
| 2542 | CUUUCCCA CUGAUGA GCCGUUAGGC GAA AAGCCCCU | 10514 | AGGGGCUUU UGGGAAAG | 3382 |
| 2543 | ACUUUCCC CUGAUGA GCCGUUAGGC GAA AAAGCCCC | 10515 | GGGGCUUUU GGGAAAGU | 3383 |
| 2552 | GCUUGAAC CUGAUGA GCCGUUAGGC GAA ACUUUCCC | 10516 | GGGAAAGUC GUUCAAGC | 3384 |
| 2555 | GAGGCUUG CUGAUGA GCCGUUAGGC GAA ACGACUUU | 10517 | AAAGUCGUU CAAGCCUC | 3385 |
| 2556 | AGAGGCUU CUGAUGA GCCGUUAGGC GAA AACGACUU | 10518 | AAGUCGUUC AAGCCUCU | 3386 |
| 2563 | CAAAUGCA CUGAUGA GCCGUUAGGC GAA AGGCUUGA | 10519 | UCAAGCCUC UGCAUUUG | 3387 |
| 2569 | UAAUGCCA CUGAUGA GCCGUUAGGC GAA AUGCAGAG | 10520 | CUCUGCAUU UGGCAUUA | 3388 |
| 2570 | UUAAUGCC CUGAUGA GCCGUUAGGC GAA AAUGCAGA | 10521 | UCUGCAUUU GGCAUUAA | 3389 |
| 2576 | GAUUUCUU CUGAUGA GCCGUUAGGC GAA AUGCCAAA | 7599 | UUUGGCAUU AAGAAAUC | 457 |
| 2577 | UGAUUUCU CUGAUGA GCCGUUAGGC GAA AAUGCCAA | 7600 | UUGGCAUUA AGAAAUCA | 458 |
| 2584 | AGGUGGGU CUGAUGA GCCGUUAGGC GAA AUUUCUUA | 10522 | UAAGAAAUC ACCCACCU | 3390 |
| 2617 | CCUCUUUC CUGAUGA GCCGUUAGGC GAA ACAUCUUC | 10523 | GAAGAUGUU GAAAGAGG | 3391 |
| 2644 | GAGCUUUG CUGAUGA GCCGUUAGGC GAA ACUCACUG | 10524 | CAGUGAGUA CAAAGCUC | 3392 |
| 2652 | GGUCAUCA CUGAUGA GCCGUUAGGC GAA AGCUUUGU | 10525 | ACAAAGCUC UGAUGACC | 3393 |
| 2666 | AAGAUCUU CUGAUGA GCCGUUAGGC GAA AGUUCGGU | 10526 | ACCGAACUC AAGAUCUU | 3394 |
| 2672 | UGGGUCAA CUGAUGA GCCGUUAGGC GAA AUCUUGAG | 10527 | CUCAAGAUC UUGACCCA | 3395 |
| 2674 | UGUGGGUC CUGAUGA GCCGUUAGGC GAA AGAUCUUG | 10528 | CAAGAUCUU GACCCACA | 3396 |
| 2684 | UGAUGGCC CUGAUGA GCCGUUAGGC GAA AUGUGGGU | 10529 | ACCCACAUC GGCCAUCA | 3397 |

176

| | | | | |
|---|---|---|---|---|
| 2691 | AUUCAGAU CUGAUGA GCCGUUAGGC GAA AUGGCCGA | 10530 | UCGGCCAUC AUCUGAAU | 3398 |
| 2694 | CACAUUCA CUGAUGA GCCGUUAGGC GAA AUGAUGGC | 10531 | GCCAUCAUC UGAAUGUG | 3399 |
| 2705 | AGGAGGUU CUGAUGA GCCGUUAGGC GAA ACCACAUU | 10532 | AAUGUGGUU AACCUCCU | 3400 |
| 2706 | CAGGAGGU CUGAUGA GCCGUUAGGC GAA AACCACAU | 10533 | AUGUGGUUA ACCUCCUG | 3401 |
| 2711 | GCUCCCAG CUGAUGA GCCGUUAGGC GAA AGGUUAAC | 10534 | GUUAACCUC CUGGGAGC | 3402 |
| 2742 | CACCAUCA CUGAUGA GCCGUUAGGC GAA AGGCCCUC | 7612 | GAGGGCCUC UGAUGGUG | 470 |
| 2753 | UAUUCCAC CUGAUGA GCCGUUAGGC GAA AUCACCAU | 10535 | AUGGUGAUC GUGGAAUA | 3403 |
| 2761 | AUUUGCAG CUGAUGA GCCGUUAGGC GAA AUUCCACG | 10536 | CGUGGAAUA CUGCAAAU | 3404 |
| 2770 | GGUUUCCG CUGAUGA GCCGUUAGGC GAA AUUUGCAG | 10537 | CUGCAAAUA CGGAAACC | 3405 |
| 2782 | GGUAGUUG CUGAUGA GCCGUUAGGC GAA ACAGGUUU | 10538 | AAACCUGUC CAACUACC | 3406 |
| 2788 | UCUUGAGG CUGAUGA GCCGUUAGGC GAA AGUUGGAC | 10539 | GUCCAACUA CCUCAAGA | 3407 |
| 2792 | UUGCUCUU CUGAUGA GCCGUUAGGC GAA AGGUAGUU | 7621 | AACUACCUC AAGAGCAA | 479 |
| 2809 | GACAGAAU CUGAUGA GCCGUUAGGC GAA AGUCACGU | 10540 | ACGUGACUU AUUCUGUC | 3408 |
| 2810 | AGACAGAA CUGAUGA GCCGUUAGGC GAA AAGUCACG | 10541 | CGUGACUUA UUCUGUCU | 3409 |
| 2812 | UGAGACAG CUGAUGA GCCGUUAGGC GAA AUAAGUCA | 10542 | UGACUUAUU CUGUCUCA | 3410 |
| 2813 | UUGAGACA CUGAUGA GCCGUUAGGC GAA AAUAAGUC | 10543 | GACUUAUUC UGUCUCAA | 3411 |
| 2817 | CUUGUUGA CUGAUGA GCCGUUAGGC GAA ACAGAAUA | 10544 | UAUUCUGUC UCAACAAG | 3412 |
| 2819 | UCCUUGUU CUGAUGA GCCGUUAGGC GAA AGACAGAA | 10545 | UUCUGUCUC AACAAGGA | 3413 |
| 2836 | CCAUAUGC CUGAUGA GCCGUUAGGC GAA AGGCUGCG | 10546 | CGCAGCCUU GCAUAUGG | 3414 |
| 2841 | GAGCUCCA CUGAUGA GCCGUUAGGC GAA AUGCAAGG | 10547 | CCUUGCAUA UGGAGCUC | 3415 |
| 2849 | UCUUUCUU CUGAUGA GCCGUUAGGC GAA AGCUCCAU | 10548 | AUGGAGCUC AAGAAAGA | 3416 |
| 2900 | ACACUGUC CUGAUGA GCCGUUAGGC GAA AGGCGGGG | 10549 | CCCCGCCUA GACAGUGU | 3417 |
| 2909 | GAGCUGCU CUGAUGA GCCGUUAGGC GAA ACACUGUC | 10550 | GACAGUGUC AGCAGCUC | 3418 |
| 2917 | UGACACUU CUGAUGA GCCGUUAGGC GAA AGCUGCUG | 10551 | CAGCAGCUC AAGUGUCA | 3419 |
| 2924 | GAGCUGGU CUGAUGA GCCGUUAGGC GAA ACACUUGA | 10552 | UCAAGUGUC ACCAGCUC | 3420 |
| 2932 | GGAAGCUG CUGAUGA GCCGUUAGGC GAA AGCUGGUG | 10553 | CACCAGCUC CAGCUUCC | 3421 |
| 2938 | CUUCAGGG CUGAUGA GCCGUUAGGC GAA AGCUGGAG | 10554 | CUCCAGCUU CCCUGAAG | 3422 |
| 2939 | UCUUCAGG CUGAUGA GCCGUUAGGC GAA AAGCUGGA | 10555 | UCCAGCUUC CCUGAAGA | 3423 |
| 2982 | CUCACUGU CUGAUGA GCCGUUAGGC GAA AUCCUCGU | 10556 | ACGAGGAUU ACAGUGAG | 3424 |
| 2983 | UCUCACUG CUGAUGA GCCGUUAGGC GAA AAUCCUCG | 10557 | CGAGGAUUA CAGUGAGA | 3425 |
| 2993 | UGCUUGGA CUGAUGA GCCGUUAGGC GAA AUCUCACU | 10558 | AGUGAGAUC UCCAAGCA | 3426 |
| 2995 | GCUGCUUG CUGAUGA GCCGUUAGGC GAA AGAUCUCA | 10559 | UGAGAUCUC CAAGCAGC | 3427 |
| 3008 | UCCAUGGU CUGAUGA GCCGUUAGGC GAA AGGGGCUG | 10560 | CAGCCCCUC ACCAUGGA | 3428 |
| 3026 | CUGUAGGA CUGAUGA GCCGUUAGGC GAA AUCAGGUC | 10561 | GACCUGAUU UCCUACAG | 3429 |
| 3027 | ACUGUAGG CUGAUGA GCCGUUAGGC GAA AAUCAGGU | 10562 | ACCUGAUUU CCUACAGU | 3430 |

177

| | | | | |
|---|---|---|---|---|
| 3028 | AACUGUAG CUGAUGA GCCGUUAGGC GAA AAAUCAGG | 10563 | CCUGAUUUC CUACAGUU | 3431 |
| 3031 | GGAAACUG CUGAUGA GCCGUUAGGC GAA AGGAAAUC | 10564 | GAUUUCCUA CAGUUUCC | 3432 |
| 3036 | CACUUGGA CUGAUGA GCCGUUAGGC GAA ACUGUAGG | 10565 | CCUACAGUU UCCAAGUG | 3433 |
| 3037 | CCACUUGG CUGAUGA GCCGUUAGGC GAA AACUGUAG | 10566 | CUACAGUUU CCAAGUGG | 3434 |
| 3038 | GCCACUUG CUGAUGA GCCGUUAGGC GAA AAACUGUA | 7661 | UACAGUUUC CAAGUGGC | 3435 |
| 3061 | AGGACAGA CUGAUGA GCCGUUAGGC GAA ACUCCAUG | 10567 | CAUGGAGUU UCUGUCCU | 3436 |
| 3062 | GAGGACAG CUGAUGA GCCGUUAGGC GAA AACUCCAU | 10568 | AUGGAGUUU CUGUCCUC | 3437 |
| 3063 | GGAGGACA CUGAUGA GCCGUUAGGC GAA AAACUCCA | 10569 | UGGAGUUUC UGUCCUCC | 3438 |
| 3067 | UUCUGGAG CUGAUGA GCCGUUAGGC GAA ACAGAAAC | 10570 | GUUUCUGUC CUCCAGAA | 3439 |
| 3070 | ACUUUCUG CUGAUGA GCCGUUAGGC GAA AGGACAGA | 10571 | UCUGUCCUC CAGAAAGU | 3440 |
| 3083 | UCCCGAUG CUGAUGA GCCGUUAGGC GAA AUGCACUU | 7668 | AAGUGCAUU CAUCGGGA | 526 |
| 3084 | GUCCCGAU CUGAUGA GCCGUUAGGC GAA AAUGCACU | 7669 | AGUGCAUUC AUCGGGAC | 527 |
| 3087 | CAGGUCCC CUGAUGA GCCGUUAGGC GAA AUGAAUGC | 7670 | GCAUUCAUC GGGACCUG | 528 |
| 3110 | GAUAAAAG CUGAUGA GCCGUUAGGC GAA AUGUUUCU | 7671 | AGAAACAUC CUUUUAUC | 3441 |
| 3113 | UCAGAUAA CUGAUGA GCCGUUAGGC GAA AGGAUGUU | 10572 | AACAUCCUU UUAUCUGA | 3442 |
| 3114 | CUCAGAUA CUGAUGA GCCGUUAGGC GAA AAGGAUGU | 10573 | ACAUCCUUU UAUCUGAG | 3443 |
| 3115 | UCUCAGAU CUGAUGA GCCGUUAGGC GAA AAAGGAUG | 10574 | CAUCCUUUU AUCUGAGA | 3444 |
| 3116 | UUCUCAGA CUGAUGA GCCGUUAGGC GAA AAAAGGAU | 10575 | AUCCUUUUA UCUGAGAA | 3445 |
| 3118 | UGUUCUCA CUGAUGA GCCGUUAGGC GAA AUAAAAGG | 10576 | CCUUUUAUC UGAGAACA | 3446 |
| 3140 | AAGUCGCA CUGAUGA GCCGUUAGGC GAA AUCUUCAC | 10577 | GUGAAGAUU UGCGACUU | 3447 |
| 3141 | AAAGUCGC CUGAUGA GCCGUUAGGC GAA AAUCUUCA | 10578 | UGAAGAUUU GCGACUUU | 3448 |
| 3148 | CCAGGCCA CUGAUGA GCCGUUAGGC GAA AGUCGCAA | 10579 | UUGCGACUU UGGCCUGG | 3449 |
| 3149 | GCCAGGCC CUGAUGA GCCGUUAGGC GAA AAGUCGCA | 10580 | UGCGACUUU GGCCUGGC | 3450 |
| 3165 | CUUAUAAA CUGAUGA GCCGUUAGGC GAA AUCCCGGG | 7684 | CCCGGGAUA UUUAUAAG | 542 |
| 3167 | UUCUUAUA CUGAUGA GCCGUUAGGC GAA AUAUCCCG | 7685 | CGGGAUAUU UAUAAGAA | 543 |
| 3168 | GUUCUUAU CUGAUGA GCCGUUAGGC GAA AAUAUCCC | 7686 | GGGAUAUUU AUAAGAAC | 544 |
| 3169 | GGUUCUUA CUGAUGA GCCGUUAGGC GAA AAAUAUCC | 7687 | GGAUAUUUA UAAGAACC | 545 |
| 3171 | AGGGUUCU CUGAUGA GCCGUUAGGC GAA AUAAAUAU | 10581 | AUAUUUAUA AGAACCCU | 3451 |
| 3183 | CCUCACAU CUGAUGA GCCGUUAGGC GAA AUCAGGGU | 10582 | ACCCUGAUU AUGUGAGG | 3452 |
| 3184 | UCCUCACA CUGAUGA GCCGUUAGGC GAA AAUCAGGG | 10583 | CCCUGAUUA UGUGAGGA | 3453 |
| 3201 | AAGUCGAG CUGAUGA GCCGUUAGGC GAA AUCUCCUC | 10584 | GAGGAGAUA CUCGACUU | 3454 |
| 3204 | GGGAAGUC CUGAUGA GCCGUUAGGC GAA AGUAUCUC | 10585 | GAGAUACUC GACUUCCC | 3455 |
| 3209 | UUUAGGGG CUGAUGA GCCGUUAGGC GAA AGUCGAGU | 10586 | ACUCGACUU CCCCUAAA | 3456 |
| 3210 | UUUUAGGG CUGAUGA GCCGUUAGGC GAA AAGUCGAG | 10587 | CUCGACUUC CCCUAAAA | 3457 |
| 3215 | AUCCAUUU CUGAUGA GCCGUUAGGC GAA AGGGGAAG | 10588 | CUUCCCCUA AAAUGGAU | 3458 |

178

| | | | | |
|---|---|---|---|---|
| 3228 | GGAUUCAG CUGAUGA GCCGUUAGGC GAA AGCCAUCC | 10589 | GGAUGGCUC CUGAAUCC | 3459 |
| 3235 | CAAAGAUG CUGAUGA GCCGUUAGGC GAA AUUCAGGA | 10590 | UCCUGAAUC CAUCUUUG | 3460 |
| 3239 | UUGUCAAA CUGAUGA GCCGUUAGGC GAA AUGGAUUC | 10591 | GAAUCCAUC UUUGACAA | 3461 |
| 3241 | CCUUGUCA CUGAUGA GCCGUUAGGC GAA AGAUGGAU | 10592 | AUCCAUCUU UGACAAGG | 3462 |
| 3242 | ACCUUGUC CUGAUGA GCCGUUAGGC GAA AAGAUGGA | 10593 | UCCAUCUUU GACAAGGU | 3463 |
| 3251 | GUGCUGUA CUGAUGA GCCGUUAGGC GAA ACCUUGUC | 10594 | GACAAGGUC UACAGCAC | 3464 |
| 3253 | UGGUGCUG CUGAUGA GCCGUUAGGC GAA AGACCUUG | 10595 | CAAGGUCUA CAGCACCA | 3465 |
| 3277 | CGCCAUAG CUGAUGA GCCGUUAGGC GAA ACCACACA | 10596 | UGUGUGGUC CUAUGGCG | 3466 |
| 3280 | ACACGCCA CUGAUGA GCCGUUAGGC GAA AGGACCAC | 10597 | GUGGUCCUA UGGCGUGU | 3467 |
| 3289 | CCCACAGC CUGAUGA GCCGUUAGGC GAA ACACGCCA | 10598 | UGGCGUGUU GCUGUGGG | 3468 |
| 3302 | AAGGAGAA CUGAUGA GCCGUUAGGC GAA AUCUCCCA | 10599 | UGGGAGAUC UUCUCCUU | 3469 |
| 3304 | CUAAGGAG CUGAUGA GCCGUUAGGC GAA AGAUCUCC | 10600 | GGAGAUCUU CUCCUUAG | 3470 |
| 3305 | CCUAAGGA CUGAUGA GCCGUUAGGC GAA AAGAUCUC | 10601 | GAGAUCUUC UCCUUAGG | 3471 |
| 3307 | CCCCUAAG CUGAUGA GCCGUUAGGC GAA AGAAGAUC | 10602 | GAUCUUCUC CUUAGGGG | 3472 |
| 3310 | AACCCCCU CUGAUGA GCCGUUAGGC GAA AGGAGAAG | 10603 | CUUCUCCUU AGGGGGUU | 3473 |
| 3311 | GAACCCCC CUGAUGA GCCGUUAGGC GAA AAGGAGAA | 10604 | UUCUCCUUA GGGGGUUC | 3474 |
| 3318 | GUAUGGAG CUGAUGA GCCGUUAGGC GAA ACCCCCUA | 10605 | UAGGGGGUU CUCCAUAC | 3475 |
| 3319 | GGUAUGGA CUGAUGA GCCGUUAGGC GAA AACCCCCU | 10606 | AGGGGGUUC UCCAUACC | 3476 |
| 3321 | UGGGUAUG CUGAUGA GCCGUUAGGC GAA AGAACCCC | 10607 | GGGGUUCUC CAUACCCA | 3477 |
| 3325 | CUCCUGGG CUGAUGA GCCGUUAGGC GAA AUGGAGAA | 10608 | UUCUCCAUA CCCAGGAG | 3478 |
| 3352 | GGCUGCAG CUGAUGA GCCGUUAGGC GAA AGUCUUCA | 10609 | UGAAGACUU CUGCAGCC | 3479 |
| 3353 | CGGCUGCA CUGAUGA GCCGUUAGGC GAA AAGUCUUC | 10610 | GAAGACUUC UGCAGCCG | 3480 |
| 3397 | GUGUGGCA CUGAUGA GCCGUUAGGC GAA ACUCCGGG | 10611 | CCCGGAGUA UGCCACAC | 3481 |
| 3413 | AUUUGGUA CUGAUGA GCCGUUAGGC GAA AUUUCAGG | 10612 | CCUGAAAUC UACCAAAU | 3482 |
| 3415 | UGAUUUGG CUGAUGA GCCGUUAGGC GAA AGAUUUCA | 10613 | UGAAAUCUA CCAAAUCA | 3483 |
| 3422 | UCCAACAU CUGAUGA GCCGUUAGGC GAA AUUUGGUA | 10614 | UACCAAAUC AUGUUGGA | 3484 |
| 3427 | AGCAAUCC CUGAUGA GCCGUUAGGC GAA ACAUGAUU | 10615 | AAUCAUGUU GGAUUGCU | 3485 |
| 3432 | GUGCCAGC CUGAUGA GCCGUUAGGC GAA AUCCAACA | 10616 | UGUUGGAUU GCUGGCAC | 3486 |
| 3466 | GUUCAGCA CUGAUGA GCCGUUAGGC GAA ACCGGGGC | 10617 | GCCCCGGUU UGCUGAAC | 3487 |
| 3467 | AGUUCAGC CUGAUGA GCCGUUAGGC GAA AACCGGGG | 10618 | CCCCGGUUU GCUGAACU | 3488 |
| 3476 | UUCUCCAC CUGAUGA GCCGUUAGGC GAA AGUUCAGC | 10619 | GCUGAACUU GUGGAGAA | 3489 |
| 3488 | AGGUCACC CUGAUGA GCCGUUAGGC GAA AGUUUCUC | 10620 | GAGAAACUU GGUGACCU | 3490 |
| 3500 | UUGGCUUG CUGAUGA GCCGUUAGGC GAA AGCAGGUC | 10621 | GACCUGCUU CAAGCCAA | 3491 |
| 3501 | GUUGGCUU CUGAUGA GCCGUUAGGC GAA AAGCAGGU | 10622 | ACCUGCUUC AAGCCAAC | 3492 |
| 3512 | UCCUGUUG CUGAUGA GCCGUUAGGC GAA ACGUUGGC | 10623 | GCCAACGUC CAACAGGA | 3493 |

179

| | | | | |
|---|---|---|---|---|
| 3531 | GGGGAUGU CUGAUGA GCCGUUAGGC GAA AUCUUUCC | 10624 | GGAAAGAUU ACAUCCCC | 3494 |
| 3532 | GGGGGAUG CUGAUGA GCCGUUAGGC GAA AAUCUUUC | 10625 | GAAAGAUUA CAUCCCCC | 3495 |
| 3536 | UUGAGGGG CUGAUGA GCCGUUAGGC GAA AUGUAAUC | 10626 | GAUUACAUC CCCCUCAA | 3496 |
| 3542 | AUGGCAUU CUGAUGA GCCGUUAGGC GAA AGGGGGAU | 10627 | AUCCCCCUC AAUGCCAU | 3497 |
| 3551 | CUAGUCAG CUGAUGA GCCGUUAGGC GAA AUGGCAUU | 10628 | AAUGCCAUA CUGACUAG | 3498 |
| 3558 | ACUGUUUC CUGAUGA GCCGUUAGGC GAA AGUCAGUA | 10629 | UACUGACUA GAAACAGU | 3499 |
| 3567 | UGUGAAGC CUGAUGA GCCGUUAGGC GAA ACUGUUUC | 10630 | GAAACAGUA GCUUCACA | 3500 |
| 3571 | AGUAUGUG CUGAUGA GCCGUUAGGC GAA AGCUACUG | 10631 | CAGUAGCUU CACAUACU | 3501 |
| 3572 | GAGUAUGU CUGAUGA GCCGUUAGGC GAA AAGCUACU | 10632 | AGUAGCUUC ACAUACUC | 3502 |
| 3577 | GGGUCGAG CUGAUGA GCCGUUAGGC GAA AUGUGAAG | 10633 | CUUCACAUA CUCGACCC | 3503 |
| 3580 | UGGGGGUC CUGAUGA GCCGUUAGGC GAA AGUAUGUG | 10634 | CACAUACUC GACCCCCA | 3504 |
| 3592 | CCUCAGAG CUGAUGA GCCGUUAGGC GAA AGGUGGGG | 10635 | CCCCACCUU CUCUGAGG | 3505 |
| 3593 | UCCUCAGA CUGAUGA GCCGUUAGGC GAA AAGGUGGG | 10636 | CCCACCUUC UCUGAGGA | 3506 |
| 3595 | GGUCCUCA CUGAUGA GCCGUUAGGC GAA AGAAGGUG | 10637 | CACCUUCUC UGAGGACC | 3507 |
| 3605 | UCCUUGAA CUGAUGA GCCGUUAGGC GAA AGGUCCUC | 10638 | GAGGACCUU UUCAAGGA | 3508 |
| 3606 | GUCCUUGA CUGAUGA GCCGUUAGGC GAA AAGGUCCU | 10639 | AGGACCUUU UCAAGGAC | 3509 |
| 3607 | CGUCCUUG CUGAUGA GCCGUUAGGC GAA AAAGGUCC | 10640 | GGACCUUUU CAAGGACG | 3510 |
| 3608 | CCGUCCUU CUGAUGA GCCGUUAGGC GAA AAAAGGUC | 10641 | GACCUUUUC AAGGACGG | 3511 |
| 3619 | GAUCUGCA CUGAUGA GCCGUUAGGC GAA AGCCGUCC | 10642 | GGACGGCUU UGCAGAUC | 3512 |
| 3620 | GGAUCUGC CUGAUGA GCCGUUAGGC GAA AAGCCGUC | 10643 | GACGGCUUU GCAGAUCC | 3513 |
| 3627 | AAAAUGUG CUGAUGA GCCGUUAGGC GAA AUCUGCAA | 10644 | UUGCAGAUC CACAUUUU | 3514 |
| 3633 | GGAAUGAA CUGAUGA GCCGUUAGGC GAA AUGUGGAU | 10645 | AUCCACAUU UUCAUUCC | 3515 |
| 3634 | CGGAAUGA CUGAUGA GCCGUUAGGC GAA AAUGUGGA | 10646 | UCCACAUUU UCAUUCCG | 3516 |
| 3635 | CCGGAAUG CUGAUGA GCCGUUAGGC GAA AAAUGUGG | 10647 | CCACAUUUU CAUUCCGG | 3517 |
| 3636 | UCCGGAAU CUGAUGA GCCGUUAGGC GAA AAAAUGUG | 10648 | CACAUUUUC AUUCCGGA | 3518 |
| 3639 | GCUUCCGG CUGAUGA GCCGUUAGGC GAA AUGAAAAU | 10649 | AUUUUCAUU CCGGAAGC | 3519 |
| 3640 | AGCUUCCG CUGAUGA GCCGUUAGGC GAA AAUGAAAA | 10650 | UUUUCAUUC CGGAAGCU | 3520 |
| 3649 | CAUCAUCA CUGAUGA GCCGUUAGGC GAA AGCUUCCG | 10651 | CGGAAGCUC UGAUGAUG | 3521 |
| 3664 | CGUUUACA CUGAUGA GCCGUUAGGC GAA AUCUCACA | 10652 | UGUGAGAUA UGUAAACG | 3522 |
| 3668 | AAAGCGUU CUGAUGA GCCGUUAGGC GAA ACAUAUCU | 10653 | AGAUAUGUA AACGCUUU | 3523 |
| 3675 | GAAUUUGA CUGAUGA GCCGUUAGGC GAA AGCGUUUA | 10654 | UAAACGCUU UCAAAUUC | 3524 |
| 3676 | UGAAUUUG CUGAUGA GCCGUUAGGC GAA AAGCGUUU | 10655 | AAACGCUUU CAAAUUCA | 3525 |
| 3677 | AUGAAUUU CUGAUGA GCCGUUAGGC GAA AAAGCGUU | 10656 | AACGCUUUC AAAUUCAU | 3526 |
| 3682 | GGCUCAUG CUGAUGA GCCGUUAGGC GAA AUUUGAAA | 10657 | UUUCAAAUU CAUGAGCC | 3527 |
| 3683 | AGGCUCAU CUGAUGA GCCGUUAGGC GAA AAUUUGAA | 10658 | UUCAAAUUC AUGAGCCU | 3528 |

180

| | | | | |
|---|---|---|---|---|
| 3701 | AAGGUUUU CUGAUGA GCCGUUAGGC GAA AUUCUUUC | 7779 | GAAAGAAUC AAAACCUU | 637 |
| 3709 | GCUCCUCA CUGAUGA GCCGUUAGGC GAA AGGUUUUG | 10659 | CAAAACCUU UGAGGAGC | 3529 |
| 3710 | AGCUCCUC CUGAUGA GCCGUUAGGC GAA AAGGUUUU | 10660 | AAAACCUUU GAGGAGCU | 3530 |
| 3719 | UUCGGUGA CUGAUGA GCCGUUAGGC GAA AGCUCCUC | 10661 | GAGGAGCUU UCACCGAA | 3531 |
| 3720 | GUUCGGUG CUGAUGA GCCGUUAGGC GAA AAGCUCCU | 10662 | AGGAGCUUU CACCGAAC | 3532 |
| 3721 | AGUUCGGU CUGAUGA GCCGUUAGGC GAA AAAGCUCC | 10663 | GGAGCUUUC ACCGAACU | 3533 |
| 3730 | UGGAGGUG CUGAUGA GCCGUUAGGC GAA AGUUCGGU | 10664 | ACCGAACUC CACCUCCA | 3534 |
| 3736 | CAAACAUG CUGAUGA GCCGUUAGGC GAA AGGUGGAG | 10665 | CUCCACCUC CAUGUUUG | 3535 |
| 3742 | AGUCCUCA CUGAUGA GCCGUUAGGC GAA ACAUGGAG | 10666 | CUCCAUGUU UGAGGACU | 3536 |
| 3743 | UAGUCCUC CUGAUGA GCCGUUAGGC GAA AACAUGGA | 10667 | UCCAUGUUU GAGGACUA | 3537 |
| 3751 | CCAGCUGA CUGAUGA GCCGUUAGGC GAA AGUCCUCA | 10668 | UGAGGACUA UCAGCUGG | 3538 |
| 3753 | GUCCAGCU CUGAUGA GCCGUUAGGC GAA AUAGUCCU | 10669 | AGGACUAUC AGCUGGAC | 3539 |
| 3765 | CAGAGUGC CUGAUGA GCCGUUAGGC GAA AGUGUCCA | 10670 | UGGACACUA GCACUCUG | 3540 |
| 3771 | GCCCAGCA CUGAUGA GCCGUUAGGC GAA AGUGCUAG | 10671 | CUAGCACUC UGCUGGGC | 3541 |
| 3781 | GCAAGGGG CUGAUGA GCCGUUAGGC GAA AGCCCAGC | 10672 | GCUGGGCUC CCCCUUGC | 3542 |
| 3787 | GCUUCAGC CUGAUGA GCCGUUAGGC GAA AGGGGGAG | 10673 | CUCCCCCUU GCUGAAGC | 3543 |
| 3799 | UCCAGGUG CUGAUGA GCCGUUAGGC GAA ACCGCUUC | 10674 | GAAGCGGUU CACCUGGA | 3544 |
| 3800 | GUCCAGGU CUGAUGA GCCGUUAGGC GAA AACCGCUU | 10675 | AAGCGGUUC ACCUGGAC | 3545 |
| 3829 | UCUUCAUG CUGAUGA GCCGUUAGGC GAA AGGCCUUG | 10676 | CAAGGCCUC CAUGAAGA | 3546 |
| 3839 | CUCAAGUC CUGAUGA GCCGUUAGGC GAA AUCUUCAU | 10677 | AUGAAGAUA GACUUGAG | 3547 |
| 3844 | CUAUUCUC CUGAUGA GCCGUUAGGC GAA AGUCUAUC | 10678 | GAUAGACUU GAGAAUAG | 3548 |
| 3851 | UUACUCGC CUGAUGA GCCGUUAGGC GAA AUUCUCAA | 10679 | UUGAGAAUA GCGAGUAA | 3549 |
| 3858 | CUUGCUUU CUGAUGA GCCGUUAGGC GAA ACUCGCUA | 10680 | UAGCGAGUA AAAGCAAG | 3550 |
| 3878 | AGAUCGGA CUGAUGA GCCGUUAGGC GAA AGUCCCGC | 10681 | GCGGGACUU UCCGAUCU | 3551 |
| 3879 | CAGAUCGG CUGAUGA GCCGUUAGGC GAA AAGUCCCG | 10682 | CGGGACUUU CCGAUCUG | 3552 |
| 3880 | GCAGAUCG CUGAUGA GCCGUUAGGC GAA AAAGUCCC | 10683 | GGGACUUUC CGAUCUGC | 3553 |
| 3885 | CCUCGGCA CUGAUGA GCCGUUAGGC GAA AUCGGAAA | 10684 | UUUCCGAUC UGCCGAGG | 3554 |
| 3901 | AGAAGCAG CUGAUGA GCCGUUAGGC GAA AGCUGGGC | 10685 | GCCCAGCUU CUGCUUCU | 3555 |
| 3902 | GAGAAGCA CUGAUGA GCCGUUAGGC GAA AAGCUGGG | 10686 | CCCAGCUUC UGCUUCUC | 3556 |
| 3907 | AGCUGGAG CUGAUGA GCCGUUAGGC GAA AGCAGAAG | 10687 | CUUCUGCUU CUCCAGCU | 3557 |
| 3908 | CAGCUGGA CUGAUGA GCCGUUAGGC GAA AAGCAGAA | 10688 | UUCUGCUUC UCCAGCUG | 3558 |
| 3910 | CACAGCUG CUGAUGA GCCGUUAGGC GAA AGAAGCAG | 10689 | CUGCUUCUC CAGCUGUG | 3559 |
| 3926 | ACGGGCCU CUGAUGA GCCGUUAGGC GAA AUGUGGCC | 10690 | GGCCACAUC AGGCCCGU | 3560 |
| 3949 | CCAGCUCA CUGAUGA GCCGUUAGGC GAA AUUCAUCG | 10691 | CGAUGAAUC UGAGCUGG | 3561 |
| 3967 | AACAGCAG CUGAUGA GCCGUUAGGC GAA ACUCCUUU | 10692 | AAAGGAGUC CUGCUGUU | 3562 |

181

| | | | | |
|---|---|---|---|---|
| 3975 | GGGUGGAG CUGAUGA GCCGUUAGGC GAA ACAGCAGG | 10693 | CCUGCUGUU CUCCACCC | 3563 |
| 3976 | GGGGUGGA CUGAUGA GCCGUUAGGC GAA AACAGCAG | 10694 | CUGCUGUUC UCCACCCC | 3564 |
| 3978 | UGGGGGUG CUGAUGA GCCGUUAGGC GAA AGAACAGC | 10695 | GCUGUUCUC CACCCCCA | 3565 |
| 3991 | CGGAGUUG CUGAUGA GCCGUUAGGC GAA AGUCUGGG | 10696 | CCCAGACUA CAACUCCG | 3566 |
| 3997 | ACACCACG CUGAUGA GCCGUUAGGC GAA AGUUGUAG | 10697 | CUACAACUC CGUGGUGU | 3567 |
| 4006 | AGGAGUAC CUGAUGA GCCGUUAGGC GAA ACACCACG | 10698 | CGUGGUGUU GUACUCCU | 3568 |
| 4009 | GGGAGGAG CUGAUGA GCCGUUAGGC GAA ACAACACC | 10699 | GGUGUUGUA CUCCUCCC | 3569 |
| 4012 | GCGGGGAG CUGAUGA GCCGUUAGGC GAA AGUACAAC | 10700 | GUUGUACUC CUCCCCGC | 3570 |
| 4015 | CGGGCGGG CUGAUGA GCCGUUAGGC GAA AGGAGUAC | 10701 | GUACUCCUC CCCGCCCG | 3571 |
| 4027 | AGAAGCUU CUGAUGA GCCGUUAGGC GAA AGGCGGGC | 10702 | GCCCGCCUA AAGCUUCU | 3572 |
| 4033 | CUGGUGAG CUGAUGA GCCGUUAGGC GAA AGCUUUAG | 10703 | CUAAAGCUU CUCACCAG | 3573 |
| 4034 | GCUGGUGA CUGAUGA GCCGUUAGGC GAA AAGCUUUA | 10704 | UAAAGCUUC UCACCAGC | 3574 |
| 4036 | GGGCUGGU CUGAUGA GCCGUUAGGC GAA AGAAGCUU | 10705 | AAGCUUCUC ACCAGCCC | 3575 |
| 4066 | AUGUAUAA CUGAUGA GCCGUUAGGC GAA ACUGUCAG | 10706 | CUGACAGUA UUAUACAU | 3576 |
| 4068 | AGAUGUAU CUGAUGA GCCGUUAGGC GAA AUACUGUC | 10707 | GACAGUAUU AUACAUCU | 3577 |
| 4069 | UAGAUGUA CUGAUGA GCCGUUAGGC GAA AAUACUGU | 10708 | ACAGUAUUA UACAUCUA | 3578 |
| 4071 | CAUAGAUG CUGAUGA GCCGUUAGGC GAA AUAAUACU | 10709 | AGUAUUAUA CAUCUAUG | 3579 |
| 4075 | AACUCAUA CUGAUGA GCCGUUAGGC GAA AUGUAUAA | 10710 | UUAUACAUC UAUGAGUU | 3580 |
| 4077 | UAAACUCA CUGAUGA GCCGUUAGGC GAA AGAUGUAU | 10711 | AUACAUCUA UGAGUUUA | 3581 |
| 4083 | UAGGUGUA CUGAUGA GCCGUUAGGC GAA ACUCAUAG | 10712 | CUAUGAGUU UACACCUA | 3582 |
| 4084 | AUAGGUGU CUGAUGA GCCGUUAGGC GAA AACUCAUA | 10713 | UAUGAGUUU ACACCUAU | 3583 |
| 4085 | AAUAGGUG CUGAUGA GCCGUUAGGC GAA AAACUCAU | 10714 | AUGAGUUUA CACCUAUU | 3584 |
| 4091 | GAGCGGAA CUGAUGA GCCGUUAGGC GAA AGGUGUAA | 10715 | UUACACCUA UUCCGCUC | 3585 |
| 4093 | UGGAGCGG CUGAUGA GCCGUUAGGC GAA AUAGGUGU | 10716 | ACACCUAUU CCGCUCCA | 3586 |
| 4094 | GUGGAGCG CUGAUGA GCCGUUAGGC GAA AAUAGGUG | 10717 | CACCUAUUC CGCUCCAC | 3587 |
| 4099 | CUCCUGUG CUGAUGA GCCGUUAGGC GAA AGCGGAAU | 10718 | AUUCCGCUC CACAGGAG | 3588 |
| 4117 | GUCACGAA CUGAUGA GCCGUUAGGC GAA AGCAGCUG | 10719 | CAGCUGCUU UUCGUGAC | 3589 |
| 4118 | GGUCACGA CUGAUGA GCCGUUAGGC GAA AAGCAGCU | 10720 | AGCUGCUUU UCGUGACC | 3590 |
| 4119 | AGGUCACG CUGAUGA GCCGUUAGGC GAA AAAGCAGC | 10721 | GCUGCUUUU CGUGACCU | 3591 |
| 4120 | AAGGUCAC CUGAUGA GCCGUUAGGC GAA AAAAGCAG | 10722 | CUGCUUUUC GUGACCUU | 3592 |
| 4128 | CACGAUUA CUGAUGA GCCGUUAGGC GAA AGGUCACG | 10723 | CGUGACCUU UAAUCGUG | 3593 |
| 4129 | GCACGAUU CUGAUGA GCCGUUAGGC GAA AAGGUCAC | 10724 | GUGACCUUU AAUCGUGC | 3594 |
| 4130 | AGCACGAU CUGAUGA GCCGUUAGGC GAA AAAGGUCA | 10725 | UGACCUUUA AUCGUGCU | 3595 |
| 4133 | AAAAGCAC CUGAUGA GCCGUUAGGC GAA AUUAAAGG | 10726 | CCUUUAAUC GUGCUUUU | 3596 |
| 4139 | AAACAAAA CUGAUGA GCCGUUAGGC GAA AGCACGAU | 10727 | AUCGUGCUU UUUUGUUU | 3597 |

| | | | | |
|---|---|---|---|---|
| 4140 | AAAACAAA CUGAUGA GCCGUUAGGC GAA AAGCACGA | 10728 | UCGUGCUUU UUUGUUUU | 3598 |
| 4141 | AAAAACAA CUGAUGA GCCGUUAGGC GAA AAAGCACG | 10729 | CGUGCUUUU UUGUUUUU | 3599 |
| 4142 | AAAAAACA CUGAUGA GCCGUUAGGC GAA AAAAGCAC | 10730 | GUGCUUUUU UGUUUUUU | 3600 |
| 4143 | CAAAAAAC CUGAUGA GCCGUUAGGC GAA AAAAAGCA | 10731 | UGCUUUUUU GUUUUUUG | 3601 |
| 4146 | AAACAAAA CUGAUGA GCCGUUAGGC GAA ACAAAAAA | 10732 | UUUUUUGUU UUUUGUUU | 3602 |
| 4147 | AAAACAAA CUGAUGA GCCGUUAGGC GAA AACAAAAA | 10733 | UUUUUGUUU UUUGUUUU | 3603 |
| 4148 | CAAAACAA CUGAUGA GCCGUUAGGC GAA AAACAAAA | 10734 | UUUUGUUUU UUGUUUUG | 3604 |
| 4149 | ACAAAACA CUGAUGA GCCGUUAGGC GAA AAAACAAA | 10735 | UUUGUUUUU UGUUUUGU | 3605 |
| 4150 | AACAAAAC CUGAUGA GCCGUUAGGC GAA AAAAACAA | 10736 | UUGUUUUUU GUUUUGUU | 3606 |
| 4153 | ACAAACAA CUGAUGA GCCGUUAGGC GAA ACAAAAAA | 10737 | UUUUUUGUU UUGUUUGU | 3607 |
| 4154 | AACAAACA CUGAUGA GCCGUUAGGC GAA AACAAAAA | 10738 | UUUUUGUUU UGUUUGUU | 3608 |
| 4155 | CAACAAAC CUGAUGA GCCGUUAGGC GAA AAACAAAA | 10739 | UUUUGUUUU GUUUGUUG | 3609 |
| 4158 | CAACAACA CUGAUGA GCCGUUAGGC GAA ACAAAACA | 10740 | UGUUUUGUU UGUUGUUG | 3610 |
| 4159 | GCAACAAC CUGAUGA GCCGUUAGGC GAA AACAAAAC | 10741 | GUUUUGUUU GUUGUUGC | 3611 |
| 4162 | ACAGCAAC CUGAUGA GCCGUUAGGC GAA ACAAACAA | 10742 | UUGUUUGUU GUUGCUGU | 3612 |
| 4165 | AAAACAGC CUGAUGA GCCGUUAGGC GAA ACAACAAA | 10743 | UUUGUUGUU GCUGUUUU | 3613 |
| 4171 | UUAGUCAA CUGAUGA GCCGUUAGGC GAA ACAGCAAC | 10744 | GUUGCUGUU UUGACUAA | 3614 |
| 4172 | GUUAGUCA CUGAUGA GCCGUUAGGC GAA AACAGCAA | 10745 | UUGCUGUUU UGACUAAC | 3615 |
| 4173 | UGUUAGUC CUGAUGA GCCGUUAGGC GAA AAACAGCA | 10746 | UGCUGUUUU GACUAACA | 3616 |
| 4178 | AUUCUUGU CUGAUGA GCCGUUAGGC GAA AGUCAAAA | 7879 | UUUUGACUA ACAAGAAU | 737 |
| 4189 | ACUGGGGU CUGAUGA GCCGUUAGGC GAA ACAUUCUU | 10747 | AAGAAUGUA ACCCCAGU | 3617 |
| 4198 | ACGUCACU CUGAUGA GCCGUUAGGC GAA ACUGGGGU | 10748 | ACCCCAGUU AGUGACGU | 3618 |
| 4199 | CACGUCAC CUGAUGA GCCGUUAGGC GAA AACUGGGG | 10749 | CCCCAGUUA GUGACGUG | 3619 |
| 4216 | AACAAUAG CUGAUGA GCCGUUAGGC GAA AUUCUUCA | 10750 | UGAAGAAUA CUAUUGUU | 3620 |
| 4219 | UCUAACAA CUGAUGA GCCGUUAGGC GAA AGUAUUCU | 10751 | AGAAUACUA UUGUUAGA | 3621 |
| 4221 | UCUCUAAC CUGAUGA GCCGUUAGGC GAA AUAGUAUU | 10752 | AAUACUAUU GUUAGAGA | 3622 |
| 4224 | AUUUCUCU CUGAUGA GCCGUUAGGC GAA ACAAUAGU | 10753 | ACUAUUGUU AGAGAAAU | 3623 |
| 4225 | GAUUUCUC CUGAUGA GCCGUUAGGC GAA AACAAUAG | 10754 | CUAUUGUUA GAGAAAUC | 3624 |
| 4233 | GCGGGGGG CUGAUGA GCCGUUAGGC GAA AUUUCUCU | 10755 | AGAGAAAUC CCCCCCGC | 3625 |
| 4249 | GUUACCCU CUGAUGA GCCGUUAGGC GAA AGGCUUUG | 10756 | CAAAGCCUC AGGGUAAC | 3626 |
| 4255 | GUCCAGGU CUGAUGA GCCGUUAGGC GAA ACCCUGAG | 10757 | CUCAGGGUA ACCUGGAC | 3627 |
| 4282 | GGUCGCCA CUGAUGA GCCGUUAGGC GAA AGGCACCU | 10758 | AGGUGCCUC UGGCGACC | 3628 |
| 4323 | GCUGCAGG CUGAUGA GCCGUUAGGC GAA AGGGUGGG | 10759 | CCCACCCUC CCUGCAGC | 3629 |
| 4341 | ACUGCCUC CUGAUGA GCCGUUAGGC GAA AGUCCCAC | 10760 | GUGGGACUA GAGGCAGU | 3630 |
| 4350 | AAUGGGCU CUGAUGA GCCGUUAGGC GAA ACUGCCUC | 10761 | GAGGCAGUA AGCCCAUU | 3631 |

| | | | | |
|---|---|---|---|---|
| 4358 | CAUGAGCU CUGAUGA GCCGUUAGGC GAA AUGGGCUU | 10762 | AAGCCCAUU AGCUCAUG | 3632 |
| 4359 | CCAUGAGC CUGAUGA GCCGUUAGGC GAA AAUGGGCU | 10763 | AGCCCAUUA GCUCAUGG | 3633 |
| 4363 | GCAGCCAU CUGAUGA GCCGUUAGGC GAA AGCUAAUG | 10764 | CAUUAGCUC AUGGCUGC | 3634 |
| 4387 | GAGAGACA CUGAUGA GCCGUUAGGC GAA AGCAGGUC | 10765 | GACCUGCUC UGUCUCUC | 3635 |
| 4391 | AUAAGAGA CUGAUGA GCCGUUAGGC GAA ACAGAGCA | 10766 | UGCUCUGUC UCUCUUAU | 3636 |
| 4393 | CCAUAAGA CUGAUGA GCCGUUAGGC GAA AGACAGAG | 10767 | CUCUGUCUC UCUUAUGG | 3637 |
| 4395 | CUCCAUAA CUGAUGA GCCGUUAGGC GAA AGAGACAG | 10768 | CUGUCUCUC UUAUGGAG | 3638 |
| 4397 | UCCUCCAU CUGAUGA GCCGUUAGGC GAA AGAGAGAC | 10769 | GUCUCUCUU AUGGAGGA | 3639 |
| 4398 | UUCCUCCA CUGAUGA GCCGUUAGGC GAA AAGAGAGA | 10770 | UCUCUCUUA UGGAGGAA | 3640 |
| 4445 | GCAUCCCA CUGAUGA GCCGUUAGGC GAA AGCCUUUU | 10771 | AAAAGGCUU UGGGAUGC | 3641 |
| 4446 | CGCAUCCC CUGAUGA GCCGUUAGGC GAA AAGCCUUU | 10772 | AAAGGCUUU GGGAUGCG | 3642 |
| 4456 | ACAGGACG CUGAUGA GCCGUUAGGC GAA ACGCAUCC | 10773 | GGAUGCGUC CGUCCUGU | 3643 |
| 4460 | CUCCACAG CUGAUGA GCCGUUAGGC GAA ACGGACGC | 10774 | GCGUCCGUC CUGUGGAG | 3644 |
| 4487 | GCAUAGCG CUGAUGA GCCGUUAGGC GAA AGCCCCCU | 10775 | AGGGGGCUC CGCUAUGC | 3645 |
| 4492 | AAGUGGCA CUGAUGA GCCGUUAGGC GAA AGCGGAGC | 10776 | GCUCCGCUA UGCCACUU | 3646 |
| 4500 | AGUCACUG CUGAUGA GCCGUUAGGC GAA AGUGGCAU | 10777 | AUGCCACUU CAGUGACU | 3647 |
| 4501 | AAGUCACU CUGAUGA GCCGUUAGGC GAA AAGUGGCA | 10778 | UGCCACUUC AGUGACUU | 3648 |
| 4509 | GGAGUGAG CUGAUGA GCCGUUAGGC GAA AGUCACUG | 10779 | CAGUGACUU CUCACUCC | 3649 |
| 4510 | AGGAGUGA CUGAUGA GCCGUUAGGC GAA AAGUCACU | 10780 | AGUGACUUC UCACUCCU | 3650 |
| 4512 | CCAGGAGU CUGAUGA GCCGUUAGGC GAA AGAAGUCA | 10781 | UGACUUCUC ACUCCUGG | 3651 |
| 4516 | GAGGCCAG CUGAUGA GCCGUUAGGC GAA AGUGAGAA | 10782 | UUCUCACUC CUGGCCUC | 3652 |
| 4524 | AAACAGCG CUGAUGA GCCGUUAGGC GAA AGGCCAGG | 10783 | CCUGGCCUC CGCUGUUU | 3653 |
| 4531 | GGGCCCGA CUGAUGA GCCGUUAGGC GAA ACAGCGGA | 10784 | UCCGCUGUU UCGGGCCC | 3654 |
| 4532 | GGGGCCCG CUGAUGA GCCGUUAGGC GAA AACAGCGG | 10785 | CCGCUGUUU CGGGCCCC | 3655 |
| 4533 | GGGGGCCC CUGAUGA GCCGUUAGGC GAA AAACAGCG | 10786 | CGCUGUUUC GGGCCCCC | 3656 |
| 4543 | CCUCUUGG CUGAUGA GCCGUUAGGC GAA AGGGGGCC | 10787 | GGCCCCCUU CCAAGAGG | 3657 |
| 4544 | ACCUCUUG CUGAUGA GCCGUUAGGC GAA AAGGGGGC | 10788 | GCCCCCUUC CAAGAGGU | 3658 |
| 4553 | UGCUCUGA CUGAUGA GCCGUUAGGC GAA ACCUCUUG | 10789 | CAAGAGGUA UCAGAGCA | 3659 |
| 4555 | UCUGCUCU CUGAUGA GCCGUUAGGC GAA AUACCUCU | 10790 | AGAGGUAUC AGAGCAGA | 3660 |
| 4577 | GUCUAGGA CUGAUGA GCCGUUAGGC GAA ACGUCCCU | 10791 | AGGGACGUU UCCUAGAC | 3661 |
| 4578 | GGUCUAGG CUGAUGA GCCGUUAGGC GAA AACGUCCC | 10792 | GGGACGUUU CCUAGACC | 3662 |
| 4579 | UGGUCUAG CUGAUGA GCCGUUAGGC GAA AAACGUCC | 10793 | GGACGUUUC CUAGACCA | 3663 |
| 4582 | CCCUGGUC CUGAUGA GCCGUUAGGC GAA AGGAAACG | 10794 | CGUUUCCUA GACCAGGG | 3664 |
| 4598 | UUCCCGAG CUGAUGA GCCGUUAGGC GAA ACAUGUGC | 10795 | GCACAUGUU CUCGGGAA | 3665 |
| 4599 | GUUCCCGA CUGAUGA GCCGUUAGGC GAA AACAUGUG | 10796 | CACAUGUUC UCGGGAAC | 3666 |

184

| | | | | |
|---|---|---|---|---|
| 4601 | UGGUUCCC CUGAUGA GCCGUUAGGC GAA AGAACAUG | 10797 | CAUGUUCUC GGGAACCA | 3667 |
| 4614 | UUAAGAUU CUGAUGA GCCGUUAGGC GAA ACUGUGGU | 10798 | ACCACAGUU AAUCUUAA | 3668 |
| 4615 | UUUAAGAU CUGAUGA GCCGUUAGGC GAA AACUGUGG | 10799 | CCACAGUUA AUCUUAAA | 3669 |
| 4618 | AGAUUUAA CUGAUGA GCCGUUAGGC GAA AUUAACUG | 10800 | CAGUUAAUC UUAAAUCU | 3670 |
| 4620 | AAAGAUUU CUGAUGA GCCGUUAGGC GAA AGAUUAAC | 10801 | GUUAAUCUU AAAUCUUU | 3671 |
| 4621 | AAAAGAUU CUGAUGA GCCGUUAGGC GAA AAGAUUAA | 10802 | UUAAUCUUA AAUCUUUU | 3672 |
| 4625 | CGGGAAAA CUGAUGA GCCGUUAGGC GAA AUUUAAGA | 10803 | UCUUAAAUC UUUUCCCG | 3673 |
| 4627 | CCCGGGAA CUGAUGA GCCGUUAGGC GAA AGAUUUAA | 10804 | UUAAAUCUU UUCCCGGG | 3674 |
| 4628 | UCCCGGGA CUGAUGA GCCGUUAGGC GAA AAGAUUUA | 10805 | UAAAUCUUU UCCCGGGA | 3675 |
| 4629 | CUCCCGGG CUGAUGA GCCGUUAGGC GAA AAAGAUUU | 10806 | AAAUCUUUU CCCGGGAG | 3676 |
| 4630 | ACUCCCGG CUGAUGA GCCGUUAGGC GAA AAAAGAUU | 10807 | AAUCUUUUC CCGGGAGU | 3677 |
| 4639 | CAACAGAA CUGAUGA GCCGUUAGGC GAA ACUCCCGG | 10808 | CCGGGAGUC UUCUGUUG | 3678 |
| 4641 | GACAACAG CUGAUGA GCCGUUAGGC GAA AGACUCCC | 10809 | GGGAGUCUU CUGUUGUC | 3679 |
| 4642 | AGACAACA CUGAUGA GCCGUUAGGC GAA AAGACUCC | 10810 | GGAGUCUUC UGUUGUCU | 3680 |
| 4646 | AAACAGAC CUGAUGA GCCGUUAGGC GAA ACAGAAGA | 10811 | UCUUCUGUU GUCUGUUU | 3681 |
| 4649 | GGUAAACA CUGAUGA GCCGUUAGGC GAA ACAACAGA | 10812 | UCUGUUGUC UGUUUACC | 3682 |
| 4653 | GGAUGGUA CUGAUGA GCCGUUAGGC GAA ACAGACAA | 10813 | UUGUCUGUU UACCAUCC | 3683 |
| 4654 | UGGAUGGU CUGAUGA GCCGUUAGGC GAA AACAGACA | 10814 | UGUCUGUUU ACCAUCCA | 3684 |
| 4655 | UUGGAUGG CUGAUGA GCCGUUAGGC GAA AAACAGAC | 10815 | GUCUGUUUA CCAUCCAA | 3685 |
| 4660 | AUGCUUUG CUGAUGA GCCGUUAGGC GAA AUGGUAAA | 10816 | UUUACCAUC CAAAGCAU | 3686 |
| 4669 | AUGUUAAA CUGAUGA GCCGUUAGGC GAA AUGCUUUG | 10817 | CAAAGCAUA UUUAACAU | 3687 |
| 4671 | ACAUGUUA CUGAUGA GCCGUUAGGC GAA AUAUGCUU | 10818 | AAGCAUAUU UAACAUGU | 3688 |
| 4672 | CACAUGUU CUGAUGA GCCGUUAGGC GAA AAUAUGCU | 10819 | AGCAUAUUU AACAUGUG | 3689 |
| 4673 | ACACAUGU CUGAUGA GCCGUUAGGC GAA AAAUAUGC | 10820 | GCAUAUUUA ACAUGUGU | 3690 |
| 4682 | CCCCCACU CUGAUGA GCCGUUAGGC GAA ACACAUGU | 10821 | ACAUGUGUC AGUGGGGG | 3691 |
| 4698 | CAGAAGCC CUGAUGA GCCGUUAGGC GAA AGCGCCAC | 10822 | GUGGCGCUU GGCUUCUG | 3692 |
| 4703 | GGCCUCAG CUGAUGA GCCGUUAGGC GAA AGCCAAGC | 10823 | GCUUGGCUU CUGAGGCC | 3693 |
| 4704 | UGGCCUCA CUGAUGA GCCGUUAGGC GAA AAGCCAAG | 10824 | CUUGGCUUC UGAGGCCA | 3694 |
| 4720 | GAACUGAU CUGAUGA GCCGUUAGGC GAA AUGGCUCU | 10825 | AGAGCCAUC AUCAGUUC | 3695 |
| 4723 | GAGGAACU CUGAUGA GCCGUUAGGC GAA AUGAUGGC | 10826 | GCCAUCAUC AGUUCCUC | 3696 |
| 4727 | ACUAGAGG CUGAUGA GCCGUUAGGC GAA ACUGAUGA | 10827 | UCAUCAGUU CCUCUAGU | 3697 |
| 4728 | CACUAGAG CUGAUGA GCCGUUAGGC GAA AACUGAUG | 10828 | CAUCAGUUC CUCUAGUG | 3698 |
| 4731 | UCUCACUA CUGAUGA GCCGUUAGGC GAA AGGAACUG | 10829 | CAGUUCCUC UAGUGAGA | 3699 |
| 4733 | CAUCUCAC CUGAUGA GCCGUUAGGC GAA AGAGGAAC | 10830 | GUUCCUCUA GUGAGAUG | 3700 |
| 4745 | AUGACCUC CUGAUGA GCCGUUAGGC GAA AUGCAUCU | 10831 | AGAUGCAUU GAGGUCAU | 3701 |

| | | | | |
|---|---|---|---|---|
| 4751 | UUGGGUAU CUGAUGA GCCGUUAGGC GAA ACCUCAAU | 10832 | AUUGAGGUC AUACCCAA | 3702 |
| 4754 | AGCUUGGG CUGAUGA GCCGUUAGGC GAA AUGACCUC | 10833 | GAGGUCAUA CCCAAGCU | 3703 |
| 4763 | AGGCCUGC CUGAUGA GCCGUUAGGC GAA AGCUUGGG | 10834 | CCCAAGCUU GCAGGCCU | 3704 |
| 4777 | AGUAUGCG CUGAUGA GCCGUUAGGC GAA AGGUCAGG | 10835 | CCUGACCUU CGCAUACU | 3705 |
| 4778 | CAGUAUGC CUGAUGA GCCGUUAGGC GAA AAGGUCAG | 10836 | CUGACCUUC GCAUACUG | 3706 |
| 4783 | GUGAGCAG CUGAUGA GCCGUUAGGC GAA AUGCGAAG | 10837 | CUUCGCAUA CUGCUCAC | 3707 |
| 4789 | CUCCCCGU CUGAUGA GCCGUUAGGC GAA AGCAGUAU | 10838 | AUACUGCUC ACGGGGAG | 3708 |
| 4799 | GACCACUU CUGAUGA GCCGUUAGGC GAA ACUCCCCG | 10839 | CGGGGAGUU AAGUGGUC | 3709 |
| 4800 | GGACCACU CUGAUGA GCCGUUAGGC GAA AACUCCCC | 10840 | GGGGAGUUA AGUGGUCC | 3710 |
| 4807 | CCAAACUG CUGAUGA GCCGUUAGGC GAA ACCACUUA | 10841 | UAAGUGGUC CAGUUUGG | 3711 |
| 4812 | CUAGGCCA CUGAUGA GCCGUUAGGC GAA ACUGGACC | 10842 | GGUCCAGUU UGGCCUAG | 3712 |
| 4813 | ACUAGGCC CUGAUGA GCCGUUAGGC GAA AACUGGAC | 10843 | GUCCAGUUU GGCCUAGU | 3713 |
| 4819 | AACCUUAC CUGAUGA GCCGUUAGGC GAA AGGCCAAA | 10844 | UUUGGCCUA GUAAGGUU | 3714 |
| 4822 | GGCAACCU CUGAUGA GCCGUUAGGC GAA ACUAGGCC | 10845 | GGCCUAGUA AGGUUGCC | 3715 |
| 4827 | CAGUAGGC CUGAUGA GCCGUUAGGC GAA ACCUUACU | 10846 | AGUAAGGUU GCCUACUG | 3716 |
| 4832 | CCCAUCAG CUGAUGA GCCGUUAGGC GAA AGGCAACC | 10847 | GGUUGCCUA CUGAUGGG | 3717 |
| 4843 | UGGCUUUU CUGAUGA GCCGUUAGGC GAA AGCCCAUC | 10848 | GAUGGGCUC AAAAGCCA | 3718 |
| 4855 | CUGUUUAA CUGAUGA GCCGUUAGGC GAA AUGUGGCU | 10849 | AGCCACAUU UUAAACAG | 3719 |
| 4856 | CCUGUUUA CUGAUGA GCCGUUAGGC GAA AAUGUGGC | 10850 | GCCACAUUU UAAACAGG | 3720 |
| 4857 | ACCUGUUU CUGAUGA GCCGUUAGGC GAA AAAUGUGG | 10851 | CCACAUUUU AAACAGGU | 3721 |
| 4858 | AACCUGUU CUGAUGA GCCGUUAGGC GAA AAAAUGUG | 10852 | CACAUUUUA AACAGGUU | 3722 |
| 4866 | UGAGAUAA CUGAUGA GCCGUUAGGC GAA ACCUGUUU | 10853 | AAACAGGUU UUAUCUCA | 3723 |
| 4867 | UUGAGAUA CUGAUGA GCCGUUAGGC GAA AACCUGUU | 10854 | AACAGGUUU UAUCUCAA | 3724 |
| 4868 | CUUGAGAU CUGAUGA GCCGUUAGGC GAA AAACCUGU | 10855 | ACAGGUUUU AUCUCAAG | 3725 |
| 4869 | ACUUGAGA CUGAUGA GCCGUUAGGC GAA AAAACCUG | 10856 | CAGGUUUUA UCUCAAGU | 3726 |
| 4871 | AUACUUGA CUGAUGA GCCGUUAGGC GAA AUAAAACC | 10857 | GGUUUUAUC UCAAGUAU | 3727 |
| 4873 | UAAUACUU CUGAUGA GCCGUUAGGC GAA AGAUAAAA | 10858 | UUUUAUCUC AAGUAUUA | 3728 |
| 4878 | UAUAUUAA CUGAUGA GCCGUUAGGC GAA ACUUGAGA | 10859 | UCUCAAGUA UUAAUAUA | 3729 |
| 4880 | UAUAUAUU CUGAUGA GCCGUUAGGC GAA AUACUUGA | 10860 | UCAAGUAUU AAUAUAUA | 3730 |
| 4881 | CUAUAUAU CUGAUGA GCCGUUAGGC GAA AAUACUUG | 10861 | CAAGUAUUA AUAUAUAG | 3731 |
| 4884 | UGUCUAUA CUGAUGA GCCGUUAGGC GAA AUUAAUAC | 10862 | GUAUUAAUA UAUAGACA | 3732 |
| 4886 | CUUGUCUA CUGAUGA GCCGUUAGGC GAA AUAUUAAU | 10863 | AUUAAUAUA UAGACAAG | 3733 |
| 4888 | GUCUUGUC CUGAUGA GCCGUUAGGC GAA AUAUAUUA | 10864 | UAAUAUAUA GACAAGAC | 3734 |
| 4900 | UAAUGCAU CUGAUGA GCCGUUAGGC GAA AGUGUCUU | 10865 | AAGACACUU AUGCAUUA | 3735 |
| 4901 | AUAAUGCA CUGAUGA GCCGUUAGGC GAA AAGUGUCU | 10866 | AGACACUUA UGCAUUAU | 3736 |

| | | | | |
|---|---|---|---|---|
| 4907 | AACAGGAU CUGAUGA GCCGUUAGGC GAA AUGCAUAA | 10867 | UUAUGCAUU AUCCUGUU | 3737 |
| 4908 | AAACAGGA CUGAUGA GCCGUUAGGC GAA AAUGCAUA | 10868 | UAUGCAUUA UCCUGUUU | 3738 |
| 4910 | UAAAACAG CUGAUGA GCCGUUAGGC GAA AUAAUGCA | 10869 | UGCAUUAUC CUGUUUUA | 3739 |
| 4915 | AUAUAUAA CUGAUGA GCCGUUAGGC GAA ACAGGAUA | 10870 | UAUCCUGUU UUAUAUAU | 3740 |
| 4916 | GAUAUAUA CUGAUGA GCCGUUAGGC GAA AACAGGAU | 10871 | AUCCUGUUU UAUAUAUC | 3741 |
| 4917 | GGAUAUAU CUGAUGA GCCGUUAGGC GAA AAACAGGA | 10872 | UCCUGUUUU AUAUAUCC | 3742 |
| 4918 | UGGAUAUA CUGAUGA GCCGUUAGGC GAA AAAACAGG | 10873 | CCUGUUUUA UAUAUCCA | 3743 |
| 4920 | AUUGGAUA CUGAUGA GCCGUUAGGC GAA AUAAAACA | 10874 | UGUUUUAUA UAUCCAAU | 3744 |
| 4922 | UCAUUGGA CUGAUGA GCCGUUAGGC GAA AUAUAAAA | 10875 | UUUUAUAUA UCCAAUGA | 3745 |
| 4924 | AUUCAUUG CUGAUGA GCCGUUAGGC GAA AUAUAUAA | 10876 | UUAUAUAUC CAAUGAAU | 3746 |
| 4933 | CCCAGUUA CUGAUGA GCCGUUAGGC GAA AUUCAUUG | 10877 | CAAUGAAUA UAACUGGG | 3747 |
| 4935 | GCCCCAGU CUGAUGA GCCGUUAGGC GAA AUAUUCAU | 10878 | AUGAAUAUA ACUGGGGC | 3748 |
| 4948 | UGACUCUU CUGAUGA GCCGUUAGGC GAA ACUCGCCC | 10879 | GGGCGAGUU AAGAGUCA | 3749 |
| 4949 | AUGACUCU CUGAUGA GCCGUUAGGC GAA AACUCGCC | 10880 | GGCGAGUUA AGAGUCAU | 3750 |
| 4955 | UAGACCAU CUGAUGA GCCGUUAGGC GAA ACUCUUAA | 10881 | UUAAGAGUC AUGGUCUA | 3751 |
| 4961 | CUUUUCUA CUGAUGA GCCGUUAGGC GAA ACCAUGAC | 10882 | GUCAUGGUC UAGAAAAG | 3752 |
| 4963 | CCCUUUUC CUGAUGA GCCGUUAGGC GAA AGACCAUG | 10883 | CAUGGUCUA GAAAAGGG | 3753 |
| 4974 | UACAGAGA CUGAUGA GCCGUUAGGC GAA ACCCCUUU | 10884 | AAAGGGGUU UCUCUGUA | 3754 |
| 4975 | GUACAGAG CUGAUGA GCCGUUAGGC GAA AACCCCUU | 10885 | AAGGGGUUU CUCUGUAC | 3755 |
| 4976 | GGUACAGA CUGAUGA GCCGUUAGGC GAA AAACCCCU | 10886 | AGGGGUUUC UCUGUACC | 3756 |
| 4978 | UGGGUACA CUGAUGA GCCGUUAGGC GAA AGAAACCC | 10887 | GGGUUUCUC UGUACCCA | 3757 |
| 4982 | GAUUUGGG CUGAUGA GCCGUUAGGC GAA ACAGAGAA | 10888 | UUCUCUGUA CCCAAAUC | 3758 |
| 4990 | ACCAGCCC CUGAUGA GCCGUUAGGC GAA AUUUGGGU | 10889 | ACCCAAAUC GGGCUGGU | 3759 |
| 4999 | CUUGGUCC CUGAUGA GCCGUUAGGC GAA ACCAGCCC | 10890 | GGGCUGGUU GGACCAAG | 3760 |
| 5029 | GCUGGGAC CUGAUGA GCCGUUAGGC GAA ACCACUCU | 10891 | AGAGUGGUU GUCCCAGC | 3761 |
| 5032 | AUAGCUGG CUGAUGA GCCGUUAGGC GAA ACAACCAC | 10892 | GUGGUUGUC CCAGCUAU | 3762 |
| 5039 | AGUAACUA CUGAUGA GCCGUUAGGC GAA AGCUGGGA | 10893 | UCCCAGCUA UAGUUACU | 3763 |
| 5041 | UUAGUAAC CUGAUGA GCCGUUAGGC GAA AUAGCUGG | 10894 | CCAGCUAUA GUUACUAA | 3764 |
| 5044 | AGUUUAGU CUGAUGA GCCGUUAGGC GAA ACUAUAGC | 10895 | GCUAUAGUU ACUAAACU | 3765 |
| 5045 | UAGUUUAG CUGAUGA GCCGUUAGGC GAA AACUAUAG | 10896 | CUAUAGUUA CUAAACUA | 3766 |
| 5048 | GAGUAGUU CUGAUGA GCCGUUAGGC GAA AGUAACUA | 10897 | UAGUUACUA AACUACUC | 3767 |
| 5053 | UGGGUGAG CUGAUGA GCCGUUAGGC GAA AGUUUAGU | 10898 | ACUAAACUA CUCACCCA | 3768 |
| 5056 | CUUUGGGU CUGAUGA GCCGUUAGGC GAA AGUAGUUU | 10899 | AAACUACUC ACCCAAAG | 3769 |
| 5066 | GAGGUCCC CUGAUGA GCCGUUAGGC GAA ACUUUGGG | 10900 | CCCAAAGUU GGGACCUC | 3770 |
| 5074 | AAGCCAGU CUGAUGA GCCGUUAGGC GAA AGGUCCCA | 10901 | UGGGACCUC ACUGGCUU | 3771 |

187

| | | | | |
|---|---|---|---|---|
| 5082 | GUAAAGAG CUGAUGA GCCGUUAGGC GAA AGCCAGUG | 10902 | CACUGGCUU CUCUUUAC | 3772 |
| 5083 | AGUAAAGA CUGAUGA GCCGUUAGGC GAA AAGCCAGU | 10903 | ACUGGCUUC UCUUUACU | 3773 |
| 5085 | GAAGUAAA CUGAUGA GCCGUUAGGC GAA AGAAGCCA | 10904 | UGGCUUCUC UUUACUUC | 3774 |
| 5087 | AUGAAGUA CUGAUGA GCCGUUAGGC GAA AGAGAAGC | 10905 | GCUUCUCUU UACUUCAU | 3775 |
| 5088 | GAUGAAGU CUGAUGA GCCGUUAGGC GAA AAGAGAAG | 10906 | CUUCUCUUU ACUUCAUC | 3776 |
| 5089 | UGAUGAAG CUGAUGA GCCGUUAGGC GAA AAAGAGAA | 10907 | UUCUCUUUA CUUCAUCA | 3777 |
| 5092 | CCAUGAUG CUGAUGA GCCGUUAGGC GAA AGUAAAGA | 10908 | UCUUUACUU CAUCAUGG | 3778 |
| 5093 | UCCAUGAU CUGAUGA GCCGUUAGGC GAA AAGUAAAG | 10909 | CUUUACUUC AUCAUGGA | 3779 |
| 5096 | AAAUCCAU CUGAUGA GCCGUUAGGC GAA AUGAAGUA | 10910 | UACUUCAUC AUGGAUUU | 3780 |
| 5103 | GAUGGUGA CUGAUGA GCCGUUAGGC GAA AUCCAUGA | 10911 | UCAUGGAUU UCACCAUC | 3781 |
| 5104 | GGAUGGUG CUGAUGA GCCGUUAGGC GAA AAUCCAUG | 10912 | CAUGGAUUU CACCAUCC | 3782 |
| 5105 | GGGAUGGU CUGAUGA GCCGUUAGGC GAA AAAUCCAU | 10913 | AUGGAUUUC ACCAUCCC | 3783 |
| 5111 | UGCCUUGG CUGAUGA GCCGUUAGGC GAA AUGGUGAA | 10914 | UUCACCAUC CCAAGGCA | 3784 |
| 5122 | UCCUCUCA CUGAUGA GCCGUUAGGC GAA ACUGCCUU | 10915 | AAGGCAGUC UGAGAGGA | 3785 |
| 5134 | AUACUCUU CUGAUGA GCCGUUAGGC GAA AGCUCCUC | 10916 | GAGGAGCUA AAGAGUAU | 3786 |
| 5141 | UGGGCUGA CUGAUGA GCCGUUAGGC GAA ACUCUUUA | 10917 | UAAAGAGUA UCAGCCCA | 3787 |
| 5143 | UAUGGGCU CUGAUGA GCCGUUAGGC GAA AUACUCUU | 10918 | AAGAGUAUC AGCCCAUA | 3788 |
| 5151 | UUAAUAAA CUGAUGA GCCGUUAGGC GAA AUGGGCUG | 10919 | CAGCCCAUA UUUAUUAA | 3789 |
| 5153 | GCUUAAUA CUGAUGA GCCGUUAGGC GAA AUAUGGGC | 10920 | GCCCAUAUU UAUUAAGC | 3790 |
| 5154 | UGCUUAAU CUGAUGA GCCGUUAGGC GAA AAUAUGGG | 10921 | CCCAUAUUU AUUAAGCA | 3791 |
| 5155 | GUGCUUAA CUGAUGA GCCGUUAGGC GAA AAAUAUGG | 10922 | CCAUAUUUA UUAAGCAC | 3792 |
| 5157 | AAGUGCUU CUGAUGA GCCGUUAGGC GAA AUAAAUAU | 10923 | AUAUUUAUU AAGCACUU | 3793 |
| 5158 | AAAGUGCU CUGAUGA GCCGUUAGGC GAA AAUAAAUA | 10924 | UAUUUAUUA AGCACUUU | 3794 |
| 5165 | GGAGCAUA CUGAUGA GCCGUUAGGC GAA AGUGCUUA | 10925 | UAAGCACUU UAUGCUCC | 3795 |
| 5166 | AGGAGCAU CUGAUGA GCCGUUAGGC GAA AAGUGCUU | 10926 | AAGCACUUU AUGCUCCU | 3796 |
| 5167 | AAGGAGCA CUGAUGA GCCGUUAGGC GAA AAAGUGCU | 10927 | AGCACUUUA UGCUCCUU | 3797 |
| 5172 | GUGCCAAG CUGAUGA GCCGUUAGGC GAA AGCAUAAA | 10928 | UUUAUGCUC CUUGGCAC | 3798 |
| 5175 | GCUGUGCC CUGAUGA GCCGUUAGGC GAA AGGAGCAU | 10929 | AUGCUCCUU GGCACAGC | 3799 |
| 5195 | GCAUAAAU CUGAUGA GCCGUUAGGC GAA ACACAUCA | 10930 | UGAUGUGUA AUUUAUGC | 3800 |
| 5198 | CUUGCAUA CUGAUGA GCCGUUAGGC GAA AUUACACA | 10931 | UGUGUAAUU UAUGCAAG | 3801 |
| 5199 | GCUUGCAU CUGAUGA GCCGUUAGGC GAA AAUUACAC | 10932 | GUGUAAUUU AUGCAAGC | 3802 |
| 5200 | AGCUUGCA CUGAUGA GCCGUUAGGC GAA AAAUUACA | 10933 | UGUAAUUUA UGCAAGCU | 3803 |
| 5209 | UGGAGAGG CUGAUGA GCCGUUAGGC GAA AGCUUGCA | 10934 | UGCAAGCUC CCUCUCCA | 3804 |
| 5213 | UAGCUGGA CUGAUGA GCCGUUAGGC GAA AGGGAGCU | 10935 | AGCUCCCUC UCCAGCUA | 3805 |
| 5215 | CCUAGCUG CUGAUGA GCCGUUAGGC GAA AGAGGGAG | 10936 | CUCCCUCUC CAGCUAGG | 3806 |

| | | | | |
|---|---|---|---|---|
| 5221 | CUGAGUCC CUGAUGA GCCGUUAGGC GAA AGCUGGAG | 10937 | CUCCAGCUA GGACUCAG | 3807 |
| 5227 | AAUAUCCU CUGAUGA GCCGUUAGGC GAA AGUCCUAG | 10938 | CUAGGACUC AGGAUAUU | 3808 |
| 5233 | UUGACUAA CUGAUGA GCCGUUAGGC GAA AUCCUGAG | 10939 | CUCAGGAUA UUAGUCAA | 3809 |
| 5235 | CAUUGACU CUGAUGA GCCGUUAGGC GAA AUAUCCUG | 10940 | CAGGAUAUU AGUCAAUG | 3810 |
| 5236 | UCAUUGAC CUGAUGA GCCGUUAGGC GAA AAUAUCCU | 10941 | AGGAUAUUA GUCAAUGA | 3811 |
| 5239 | GGCUCAUU CUGAUGA GCCGUUAGGC GAA ACUAAUAU | 8081 | AUAUUAGUC AAUGAGCC | 3812 |
| 5250 | UUCCUUUU CUGAUGA GCCGUUAGGC GAA AUGGCUCA | 10942 | UGAGCCAUC AAAAGGAA | 3813 |
| 5273 | AAAUAAGA CUGAUGA GCCGUUAGGC GAA AGGUUUUU | 10943 | AAAAACCUA UCUUAUUU | 3814 |
| 5275 | GAAAAUAA CUGAUGA GCCGUUAGGC GAA AUAGGUUU | 10944 | AAACCUAUC UUAUUUUC | 3815 |
| 5277 | AUGAAAAU CUGAUGA GCCGUUAGGC GAA AGAUAGGU | 10945 | ACCUAUCUU AUUUUCAU | 3816 |
| 5278 | GAUGAAAA CUGAUGA GCCGUUAGGC GAA AAGAUAGG | 10946 | CCUAUCUUA UUUUCAUC | 3817 |
| 5280 | CAGAUGAA CUGAUGA GCCGUUAGGC GAA AUAAGAUA | 10947 | UAUCUUAUU UUCAUCUG | 3818 |
| 5281 | ACAGAUGA CUGAUGA GCCGUUAGGC GAA AAUAAGAU | 10948 | AUCUUAUUU UCAUCUGU | 3819 |
| 5282 | AACAGAUG CUGAUGA GCCGUUAGGC GAA AAAUAAGA | 10949 | UCUUAUUUU CAUCUGUU | 3820 |
| 5283 | AAACAGAU CUGAUGA GCCGUUAGGC GAA AAAAUAAG | 10950 | CUUAUUUUC AUCUGUUU | 3821 |
| 5286 | AUGAAACA CUGAUGA GCCGUUAGGC GAA AUGAAAAU | 10951 | AUUUUCAUC UGUUUCAU | 3822 |
| 5290 | AGGUAUGA CUGAUGA GCCGUUAGGC GAA ACAGAUGA | 10952 | UCAUCUGUU UCAUACCU | 3823 |
| 5291 | AAGGUAUG CUGAUGA GCCGUUAGGC GAA AACAGAUG | 10953 | CAUCUGUUU CAUACCUU | 3824 |
| 5292 | CAAGGUAU CUGAUGA GCCGUUAGGC GAA AAACAGAU | 10954 | AUCUGUUUC AUACCUUG | 3825 |
| 5295 | AGACAAGG CUGAUGA GCCGUUAGGC GAA AUGAAACA | 10955 | UGUUUCAUA CCUUGUCU | 3826 |
| 5299 | CCCCAGAC CUGAUGA GCCGUUAGGC GAA AGGUAUGA | 10956 | UCAUACCUU GUCUGGGG | 3827 |
| 5302 | AGACCCCA CUGAUGA GCCGUUAGGC GAA ACAAGGUA | 10957 | UACCUUGUC UGGGGUCU | 3828 |
| 5309 | CGUCAUUA CUGAUGA GCCGUUAGGC GAA ACCCCAGA | 10958 | UCUGGGGUC UAAUGACG | 3829 |
| 5311 | AUCGUCAU CUGAUGA GCCGUUAGGC GAA AGACCCCA | 10959 | UGGGGUCUA AUGACGAU | 3830 |
| 5331 | CCCAUGUC CUGAUGA GCCGUUAGGC GAA ACCCUGUU | 10960 | AACAGGGUA GACAUGGG | 3831 |
| 5350 | CCCUUUUC CUGAUGA GCCGUUAGGC GAA ACCCUGUC | 10961 | GACAGGGUA GAAAAGGG | 3832 |
| 5367 | ACCCCAAA CUGAUGA GCCGUUAGGC GAA AGCGGGCA | 10962 | UGCCCGCUC UUUGGGGU | 3833 |
| 5369 | AGACCCCA CUGAUGA GCCGUUAGGC GAA AGAGCGGG | 10963 | CCCGCUCUU UGGGGUCU | 3834 |
| 5370 | UAGACCCC CUGAUGA GCCGUUAGGC GAA AAGAGCGG | 10964 | CCGCUCUUU GGGGUCUA | 3835 |
| 5376 | CAUCUCUA CUGAUGA GCCGUUAGGC GAA ACCCCAAA | 10965 | UUUGGGGUC UAGAGAUG | 3836 |
| 5378 | CUCAUCUC CUGAUGA GCCGUUAGGC GAA AGACCCCA | 10966 | UGGGGUCUA GAGAUGAG | 3837 |
| 5395 | AUUUUAGA CUGAUGA GCCGUUAGGC GAA ACCCAGGG | 10967 | CCCUGGGUC UCUAAAAU | 3838 |
| 5397 | CCAUUUUA CUGAUGA GCCGUUAGGC GAA AGACCCAG | 10968 | CUGGGUCUC UAAAAUGG | 3839 |
| 5399 | AGCCAUUU CUGAUGA GCCGUUAGGC GAA AGAGACCC | 10969 | GGGUCUCUA AAAUGGCU | 3840 |
| 5408 | UUCUAAGA CUGAUGA GCCGUUAGGC GAA AGCCAUUU | 10970 | AAAUGGCUC UCUUAGAA | 3841 |

189

| | | | | |
|---|---|---|---|---|
| 5410 | ACUUCUAA CUGAUGA GCCGUUAGGC GAA AGAGCCAU | 10971 | AUGGCUCUC UUAGAAGU | 3842 |
| 5412 | CAACUUCU CUGAUGA GCCGUUAGGC GAA AGAGAGCC | 10972 | GGCUCUCUU AGAAGUUG | 3843 |
| 5413 | ACAACUUC CUGAUGA GCCGUUAGGC GAA AAGAGAGC | 10973 | GCUCUCUUA GAAGUUGU | 3844 |
| 5419 | GCACAUAC CUGAUGA GCCGUUAGGC GAA ACUUCUAA | 10974 | UUAGAAGUU GUAUGUGC | 3845 |
| 5422 | UUUGCACA CUGAUGA GCCGUUAGGC GAA ACAACUUC | 10975 | GAAGUUGUA UGUGCAAA | 3846 |
| 5432 | CAGACCAU CUGAUGA GCCGUUAGGC GAA AUUUGCAC | 10976 | GUGCAAAUU AUGGUCUG | 3847 |
| 5433 | ACAGACCA CUGAUGA GCCGUUAGGC GAA AAUUUGCA | 10977 | UGCAAAUUA UGGUCUGU | 3848 |
| 5438 | AGCACACA CUGAUGA GCCGUUAGGC GAA ACCAUAAU | 10978 | AUUAUGGUC UGUGUGCU | 3849 |
| 5447 | CACGACCU CUGAUGA GCCGUUAGGC GAA AGCACACA | 10979 | UGUGUGCUU AGGUCGUG | 3850 |
| 5448 | GCACGACC CUGAUGA GCCGUUAGGC GAA AAGCACAC | 10980 | GUGUGCUUA GGUCGUGC | 3851 |
| 5452 | GUGUGCAC CUGAUGA GCCGUUAGGC GAA ACCUAAGC | 10981 | GCUUAGGUC GUGCACAC | 3852 |
| 5475 | CCAGCUGU CUGAUGA GCCGUUAGGC GAA ACCGGCUC | 10982 | GAGCCGGUC ACAGCUGG | 3853 |
| 5497 | AAAGCAGC CUGAUGA GCCGUUAGGC GAA AUUCAUCG | 10983 | CGAUGAAUA GCUGCUUU | 3854 |
| 5504 | CUCUCCCA CUGAUGA GCCGUUAGGC GAA AGCAGCUA | 10984 | UAGCUGCUU UGGGAGAG | 3855 |
| 5505 | GCUCUCCC CUGAUGA GCCGUUAGGC GAA AAGCAGCU | 10985 | AGCUGCUUU GGGAGAGC | 3856 |
| 5524 | UAAGUGGC CUGAUGA GCCGUUAGGC GAA AGCAUGCU | 10986 | AGCAUGCUA GCCACUUA | 3857 |
| 5531 | AGAGAAUU CUGAUGA GCCGUUAGGC GAA AGUGGCUA | 10987 | UAGCCACUU AAUUCUCU | 3858 |
| 5532 | CAGAGAAU CUGAUGA GCCGUUAGGC GAA AAGUGGCU | 10988 | AGCCACUUA AUUCUCUG | 3859 |
| 5535 | GGUCAGAG CUGAUGA GCCGUUAGGC GAA AUUAAGUG | 10989 | CACUUAAUU CUCUGACC | 3860 |
| 5536 | CGGUCAGA CUGAUGA GCCGUUAGGC GAA AAUUAAGU | 10990 | ACUUAAUUC UCUGACCG | 3861 |
| 5538 | CCCGGUCA CUGAUGA GCCGUUAGGC GAA AGAAUUAA | 10991 | UUAAUUCUC UGACCGGG | 3862 |
| 5554 | GUACCCAU CUGAUGA GCCGUUAGGC GAA AUGCUGGC | 10992 | GCCAGCAUC AUGGGUAC | 3863 |
| 5561 | GGAGCAGG CUGAUGA GCCGUUAGGC GAA ACCCAUGA | 10993 | UCAUGGGUA CCUGCUCC | 3864 |
| 5568 | ACACAGGG CUGAUGA GCCGUUAGGC GAA AGCAGGUA | 10994 | UACCUGCUC CCCUGUGU | 3865 |
| 5577 | GGAUGGGG CUGAUGA GCCGUUAGGC GAA ACACAGGG | 10995 | CCCUGUGUA CCCCAUCC | 3866 |
| 5584 | ACCUUAAG CUGAUGA GCCGUUAGGC GAA AUGGGGUA | 10996 | UACCCCAUC CUUAAGGU | 3867 |
| 5587 | AAAACCUU CUGAUGA GCCGUUAGGC GAA AGGAUGGG | 10997 | CCCAUCCUU AAGGUUUU | 3868 |
| 5588 | GAAAACCU CUGAUGA GCCGUUAGGC GAA AAGGAUGG | 10998 | CCAUCCUUA AGGUUUUC | 3869 |
| 5593 | AGACAGAA CUGAUGA GCCGUUAGGC GAA ACCUUAAG | 10999 | CUUAAGGUU UUCUGUCU | 3870 |
| 5594 | CAGACAGA CUGAUGA GCCGUUAGGC GAA AACCUUAA | 11000 | UUAAGGUUU UCUGUCUG | 3871 |
| 5595 | UCAGACAG CUGAUGA GCCGUUAGGC GAA AAACCUUA | 11001 | UAAGGUUUU CUGUCUGA | 3872 |
| 5596 | AUCAGACA CUGAUGA GCCGUUAGGC GAA AAAACCUU | 11002 | AAGGUUUUC UGUCUGAU | 3873 |
| 5600 | UCUCAUCA CUGAUGA GCCGUUAGGC GAA ACAGAAAA | 11003 | UUUUCUGUC UGAUGAGA | 3874 |
| 5627 | UCAGUGGG CUGAUGA GCCGUUAGGC GAA AUUGCACU | 11004 | AGUGCAAUC CCCACUGA | 3875 |
| 5660 | UGCACCAA CUGAUGA GCCGUUAGGC GAA AGCCACAG | 11005 | CUGUGGCUC UUGGUGCA | 3876 |

| | | | | |
|---|---|---|---|---|
| 5662 | AGUGCACC CUGAUGA GCCGUUAGGC GAA AGAGCCAC | 11006 | GUGGCUCUU GGUGCACU | 3877 |
| 5671 | UGGCUGGU CUGAUGA GCCGUUAGGC GAA AGUGCACC | 11007 | GGUGCACUC ACCAGCCA | 3878 |
| 5685 | UACUUGUC CUGAUGA GCCGUUAGGC GAA AGUCCUGG | 11008 | CCAGGACUA GACAAGUA | 3879 |
| 5693 | CCCUUUCC CUGAUGA GCCGUUAGGC GAA ACUUGUCU | 11009 | AGACAAGUA GGAAAGGG | 3880 |
| 5704 | GUGGCUAG CUGAUGA GCCGUUAGGC GAA AGCCCUUU | 11010 | AAAGGGCUU CUAGCCAC | 3881 |
| 5705 | UGUGGCUA CUGAUGA GCCGUUAGGC GAA AAGCCCUU | 11011 | AAGGGCUUC UAGCCACA | 3882 |
| 5707 | AGUGUGGC CUGAUGA GCCGUUAGGC GAA AGAAGCCC | 11012 | GGGCUUCUA GCCACACU | 3883 |
| 5731 | CCCUACCU CUGAUGA GCCGUUAGGC GAA AUUUUCUU | 11013 | AAGAAAAUC AGGUAGGG | 3884 |
| 5736 | GCCAGCCC CUGAUGA GCCGUUAGGC GAA ACCUGAUU | 11014 | AAUCAGGUA GGGCUGGC | 3885 |
| 5754 | UGGACAAA CUGAUGA GCCGUUAGGC GAA AUGUCUUU | 11015 | AAAGACAUC UUUGUCCA | 3886 |
| 5756 | AAUGGACA CUGAUGA GCCGUUAGGC GAA AGAUGUCU | 11016 | AGACAUCUU UGUCCAUU | 3887 |
| 5757 | GAAUGGAC CUGAUGA GCCGUUAGGC GAA AAGAUGUC | 11017 | GACAUCUUU GUCCAUUC | 3888 |
| 5760 | UGCGAAUG CUGAUGA GCCGUUAGGC GAA ACAAAGAU | 11018 | AUCUUUGUC CAUUCGCA | 3889 |
| 5764 | CUUUUGCG CUGAUGA GCCGUUAGGC GAA AUGGACAA | 11019 | UUGUCCAUU CGCAAAAG | 3890 |
| 5765 | GCUUUUGC CUGAUGA GCCGUUAGGC GAA AAUGGACA | 11020 | UGUCCAUUC GCAAAAGC | 3891 |
| 5775 | GCCGACAA CUGAUGA GCCGUUAGGC GAA AGCUUUUG | 11021 | CAAAAGCUC UUGUCGGC | 3892 |
| 5777 | CAGCCGAC CUGAUGA GCCGUUAGGC GAA AGAGCUUU | 11022 | AAAGCUCUU GUCGGCUG | 3893 |
| 5780 | CUGCAGCC CUGAUGA GCCGUUAGGC GAA ACAAGAGC | 11023 | GCUCUUGUC GGCUGCAG | 3894 |
| 5794 | GCCUGACU CUGAUGA GCCGUUAGGC GAA ACACACUG | 11024 | CAGUGUGUA AGUCAGGC | 3895 |
| 5798 | CAUCGCCU CUGAUGA GCCGUUAGGC GAA ACUUACAC | 11025 | GUGUAAGUC AGGCGAUG | 3896 |
| 5818 | UUCUCUGG CUGAUGA GCCGUUAGGC GAA AGCCUCUG | 11026 | CAGAGGCUA CCAGAGAA | 3897 |
| 5852 | GGAUGAGA CUGAUGA GCCGUUAGGC GAA ACCUCAGG | 11027 | CCUGAGGUU UCUCAUCC | 3898 |
| 5853 | UGGAUGAG CUGAUGA GCCGUUAGGC GAA AACCUCAG | 11028 | CUGAGGUUU CUCAUCCA | 3899 |
| 5854 | CUGGAUGA CUGAUGA GCCGUUAGGC GAA AAACCUCA | 11029 | UGAGGUUUC UCAUCCAG | 3900 |
| 5856 | AUCUGGAU CUGAUGA GCCGUUAGGC GAA AGAAACCU | 11030 | AGGUUUCUC AUCCAGAU | 3901 |
| 5859 | GAUAUCUG CUGAUGA GCCGUUAGGC GAA AUGAGAAA | 11031 | UUUCUCAUC CAGAUAUC | 3902 |
| 5865 | UUGCUGGA CUGAUGA GCCGUUAGGC GAA AUCUGGAU | 11032 | AUCCAGAUA UCCAGCAA | 3903 |
| 5867 | AAUUGCUG CUGAUGA GCCGUUAGGC GAA AUAUCUGG | 11033 | CCAGAUAUC CAGCAAUU | 3904 |
| 5875 | CACCCCCC CUGAUGA GCCGUUAGGC GAA AUUGCUGG | 11034 | CCAGCAAUU GGGGGGUG | 3905 |
| 5896 | GGACCAUC CUGAUGA GCCGUUAGGC GAA AUGGUCUU | 11035 | AAGACCAUA GAUGGUCC | 3906 |
| 5903 | UAAUACAG CUGAUGA GCCGUUAGGC GAA ACCAUCUA | 11036 | UAGAUGGUC CUGUAUUA | 3907 |
| 5908 | CGGAAUAA CUGAUGA GCCGUUAGGC GAA ACAGGACC | 11037 | GGUCCUGUA UUAUUCCG | 3908 |
| 5910 | AUCGGAAU CUGAUGA GCCGUUAGGC GAA AUACAGGA | 11038 | UCCUGUAUU AUUCCGAU | 3909 |
| 5911 | AAUCGGAA CUGAUGA GCCGUUAGGC GAA AAUACAGG | 11039 | CCUGUAUUA UUCCGAUU | 3910 |
| 5913 | AAAAUCGG CUGAUGA GCCGUUAGGC GAA AUAAUACA | 11040 | UGUAUUAUU CCGAUUUU | 3911 |

191

| | | | | |
|---|---|---|---|---|
| 5914 | UAAAAUCG CUGAUGA GCCGUUAGGC GAA AAUAAUAC | 11041 | GUAUUAUUC CGAUUUUA | 3912 |
| 5919 | AUUAUUAA CUGAUGA GCCGUUAGGC GAA AUCGGAAU | 11042 | AUUCCGAUU UUAAUAAU | 3913 |
| 5920 | GAUUAUUA CUGAUGA GCCGUUAGGC GAA AAUCGGAA | 11043 | UUCCGAUUU UAAUAAUC | 3914 |
| 5921 | AGAUUAUU CUGAUGA GCCGUUAGGC GAA AAAUCGGA | 11044 | UCCGAUUUU AAUAAUCU | 3915 |
| 5922 | UAGAUUAU CUGAUGA GCCGUUAGGC GAA AAAAUCGG | 11045 | CCGAUUUUA AUAAUCUA | 3916 |
| 5925 | AAUUAGAU CUGAUGA GCCGUUAGGC GAA AUUAAAAU | 11046 | AUUUUAAUA AUCUAAUU | 3917 |
| 5928 | ACGAAUUA CUGAUGA GCCGUUAGGC GAA AUUAUUAA | 11047 | UUAAUAAUC UAAUUCGU | 3918 |
| 5930 | UCACGAAU CUGAUGA GCCGUUAGGC GAA AGAUUAUU | 11048 | AAUAAUCUA AUUCGUGA | 3919 |
| 5933 | UGAUCACG CUGAUGA GCCGUUAGGC GAA AUUAGAUU | 11049 | AAUCUAAUU CGUGAUCA | 3920 |
| 5934 | AUGAUCAC CUGAUGA GCCGUUAGGC GAA AAUUAGAU | 11050 | AUCUAAUUC GUGAUCAU | 3921 |
| 5940 | CUCUUAAU CUGAUGA GCCGUUAGGC GAA AUCACGAA | 11051 | UUCGUGAUC AUUAAGAG | 3922 |
| 5943 | AGUCUCUU CUGAUGA GCCGUUAGGC GAA AUGAUCAC | 11052 | GUGAUCAUU AAGAGACU | 3923 |
| 5944 | AAGUCUCU CUGAUGA GCCGUUAGGC GAA AAUGAUCA | 11053 | UGAUCAUUA AGAGACUU | 3924 |
| 5952 | AUUUACUA CUGAUGA GCCGUUAGGC GAA AGUCUCUU | 11054 | AAGAGACUU UAGUAAAU | 3925 |
| 5953 | CAUUUACU CUGAUGA GCCGUUAGGC GAA AAGUCUCU | 11055 | AGAGACUUU AGUAAAUG | 3926 |
| 5954 | ACAUUUAC CUGAUGA GCCGUUAGGC GAA AAAGUCUC | 11056 | GAGACUUUA GUAAAUGU | 3927 |
| 5957 | GGGACAUU CUGAUGA GCCGUUAGGC GAA ACUAAAGU | 11057 | ACUUUAGUA AAUGUCCC | 3928 |
| 5963 | GGAAAAGG CUGAUGA GCCGUUAGGC GAA ACAUUUAC | 11058 | GUAAAUGUC CCUUUUCC | 3929 |
| 5967 | UGUGGGAA CUGAUGA GCCGUUAGGC GAA AGGGACAU | 11059 | AUGUCCCUU UUCCCACA | 3930 |
| 5968 | UUGUGGGA CUGAUGA GCCGUUAGGC GAA AAGGGACA | 11060 | UGUCCCUUU UCCCACAA | 3931 |
| 5969 | UUUGUGGG CUGAUGA GCCGUUAGGC GAA AAAGGGAC | 11061 | GUCCCUUUU CCCACAAA | 3932 |
| 5970 | UUUUGUGG CUGAUGA GCCGUUAGGC GAA AAAAGGGA | 11062 | UCCCUUUUC CCACAAAA | 3933 |
| 5981 | CUUUUCUU CUGAUGA GCCGUUAGGC GAA ACUUUUGU | 11063 | ACAAAAGUA AAGAAAAG | 3934 |
| 5992 | AAUCCCGA CUGAUGA GCCGUUAGGC GAA AGCUUUUC | 11064 | GAAAAGCUA UCGGGAUU | 3935 |
| 5994 | AGAAUCCC CUGAUGA GCCGUUAGGC GAA AUAGCUUU | 11065 | AAAGCUAUC GGGAUUCU | 3936 |
| 6000 | AACCAGAG CUGAUGA GCCGUUAGGC GAA AUCCCGAU | 11066 | AUCGGGAUU CUCUGGUU | 3937 |
| 6001 | GAACCAGA CUGAUGA GCCGUUAGGC GAA AAUCCCGA | 11067 | UCGGGAUUC UCUGGUUC | 3938 |
| 6003 | CAGAACCA CUGAUGA GCCGUUAGGC GAA AGAAUCCC | 11068 | GGGAUUCUC UGGUUCUG | 3939 |
| 6008 | UUAAGCAG CUGAUGA GCCGUUAGGC GAA ACCAGAGA | 11069 | UCUCUGGUU CUGCUUAA | 3940 |
| 6009 | UUUAAGCA CUGAUGA GCCGUUAGGC GAA AACCAGAG | 11070 | CUCUGGUUC UGCUUAAA | 3941 |
| 6014 | AAGUCUUU CUGAUGA GCCGUUAGGC GAA AGCAGAAC | 11071 | GUUCUGCUU AAAGACUU | 3942 |
| 6015 | UAAGUCUU CUGAUGA GCCGUUAGGC GAA AAGCAGAA | 11072 | UUCUGCUUA AAGACUUA | 3943 |
| 6022 | CCAAAGCU CUGAUGA GCCGUUAGGC GAA AGUCUUUA | 11073 | UAAAGACUU AGCUUUGG | 3944 |
| 6023 | UCCAAAGC CUGAUGA GCCGUUAGGC GAA AAGUCUUU | 11074 | AAAGACUUA GCUUUGGA | 3945 |
| 6027 | AGGCUCCA CUGAUGA GCCGUUAGGC GAA AGCUAAGU | 11075 | ACUUAGCUU UGGAGCCU | 3946 |

192

| | | | | |
|---|---|---|---|---|
| 6028 | UAGGCUCC CUGAUGA GCCGUUAGGC GAA AAGCUAAG | 11076 | CUUAGCUUU GGAGCCUA | 3947 |
| 6036 | AACUUUCA CUGAUGA GCCGUUAGGC GAA AGGCUCCA | 11077 | UGGAGCCUA UGAAAGUU | 3948 |
| 6044 | GGCUGAUC CUGAUGA GCCGUUAGGC GAA ACUUUCAU | 11078 | AUGAAAGUU GAUCAGCC | 3949 |

Underlined region can be any X sequence or linker, as described herein.

**Table IX: Mouse *flt*1 VEGF Receptor-Hairpin Ribozyme and Substrate Sequence** 237.198

| nt. Position | HP Ribozyme | Rz Seq ID No. | Substrate | Seq ID No. |
|---|---|---|---|---|
| 33 | GUCCCAGC AGAA GACCAU ACCAGAGAAACACACGUUGUGGUACAUUACCUGGUA | 11079 | AUGGUCA GCU GCUGGGAC | 3950 |
| 36 | GGUGUCCC AGAA GCUGAC ACCAGAGAAACACACGUUGUGGUACAUUACCUGGUA | 11080 | GUCAGCU GCU GGGACACC | 3951 |
| 50 | UAAGGCAA AGAA GCGGUG ACCAGAGAAACACACGUUGUGGUACAUUACCUGGUA | 11081 | CACCGCG GUC UUGCCUUA | 3952 |
| 67 | GACACCCG AGAA GCGCGU ACCAGAGAAACACACGUUGUGGUACAUUACCUGGUA | 11082 | ACGCGCU GCU CGGGUGUC | 3953 |
| 79 | CUGUGAGA AGAA GACACC ACCAGAGAAACACACGUUGUGGUACAUUACCUGGUA | 11083 | GGUGUCU GCU UCUCACAG | 3954 |
| 166 | GAAAGAGA AGAA GGCCUG ACCAGAGAAACACACGUUGUGGUACAUUACCUGGUA | 11084 | CAGGCCA GAC UCUCUUUC | 3955 |
| 197 | CAUGAGUG AGAA GCCUCC ACCAGAGAAACACACGUUGUGGUACAUUACCUGGUA | 11085 | GGAGGCA GCC CACUCAUG | 3956 |
| 214 | CGGUCGUG AGAA GAGACC ACCAGAGAAACACACGUUGUGGUACAUUACCUGGUA | 11086 | GGUCUCU GCC CACGACCG | 3957 |
| 266 | CUCCCACA AGAA GAUGGG ACCAGAGAAACACACGUUGUGGUACAUUACCUGGUA | 11087 | CCCAUCG GCC UGUGGGAG | 3958 |
| 487 | GGAUGAUG AGAA GUCUUC ACCAGAGAAACACACGUUGUGGUACAUUACCUGGUA | 11088 | GAAGACA GCU CAUCAUCC | 3959 |
| 501 | CGUCACCC AGAA GGGGAU ACCAGAGAAACACACGUUGUGGUACAUUACCUGGUA | 11089 | AUCCCCU GCC GGGUGACG | 3960 |
| 566 | CUUUGCCC AGAA GGGGUA ACCAGAGAAACACACGUUGUGGUACAUUACCUGGUA | 11090 | UACCCCU GAU GGGCAAAG | 3961 |
| 640 | CGCAGUUC AGAA GUCCUA ACCAGAGAAACACACGUUGUGGUACAUUACCUGGUA | 11091 | UAGGACU GCU GAACUGCG | 3962 |
| 691 | GCCGAUGG AGAA GAUAGU ACCAGAGAAACACACGUUGUGGUACAUUACCUGGUA | 11092 | ACUAUCU GAC CCAUCGGC | 3963 |
| 703 | UUGUAUUG AGAA GCCGAU ACCAGAGAAACACACGUUGUGGUACAUUACCUGGUA | 11093 | AUCGGCA GAC CAAUACAA | 3964 |
| 736 | CUGGGCUC AGAA GGCGUA ACCAGAGAAACACACGUUGUGGUACAUUACCUGGUA | 11094 | UACGCCC GCC GAGCCCAG | 3965 |
| 754 | GCCCGUGG AGAA GUCUCA ACCAGAGAAACACACGUUGUGGUACAUUACCUGGUA | 11095 | UGAGACU GCU CCACGGGC | 3966 |
| 766 | GGACAAGA AGAA GCCCGU ACCAGAGAAACACACGUUGUGGUACAUUACCUGGUA | 11096 | ACGGGCA GAC UCUUGUCC | 3967 |
| 871 | UCCGGUCA AGAA GCUGCC ACCAGAGAAACACACGUUGUGGUACAUUACCUGGUA | 11097 | GGCAGCG GAU UGACCGGA | 3968 |
| 960 | CUUCACGC AGAA GGUGUA ACCAGAGAAACACACGUUGUGGUACAUUACCUGGUA | 11098 | UACACCU GUC GCGUGAAG | 3969 |
| 988 | UGUUGAAA AGAA GGAACG ACCAGAGAAACACACGUUGUGGUACAUUACCUGGUA | 11099 | CGUUCCA GUC UUUCAACA | 3970 |
| 1051 | CCUGCACC AGAA GCUUCC ACCAGAGAAACACACGUUGUGGUACAUUACCUGGUA | 11100 | GGAAGCA GCC GGUGCAGG | 3971 |
| 1081 | GCCGAUAG AGAA GUCUUC ACCAGAGAAACACACGUUGUGGUACAUUACCUGGUA | 11101 | GAAGACG GUC CUAUCGGC | 3972 |
| 1090 | UCAUGGAC AGAA GAUAGG ACCAGAGAAACACACGUUGUGGUACAUUACCUGGUA | 11102 | CCUAUCG GCU GUCCAUGA | 3973 |
| 1093 | CUUUCAUG AGAA GCCGAU ACCAGAGAAACACACGUUGUGGUACAUUACCUGGUA | 11103 | AUCGGCU GUC CAUGAAAG | 3974 |
| 1169 | AAAUAGCG AGAA GACUUC ACCAGAGAAACACACGUUGUGGUACAUUACCUGGUA | 11104 | GAAGUCU GCU CGCUAUUU | 3975 |
| 1315 | UUUCGUAG AGAA GAGGUU ACCAGAGAAACACACGUUGUGGUACAUUACCUGGUA | 11105 | AACCUCA GAU CUACGAAA | 3976 |
| 1363 | UGCUGCCC AGAA GAUAGA ACCAGAGAAACACACGUUGUGGUACAUUACCUGGUA | 11106 | UCUAUCC GCU GGGCAGCA | 3977 |
| 1604 | GUCUGAGA AGAA GCCACC ACCAGAGAAACACACGUUGUGGUACAUUACCUGGUA | 11107 | GGUGGCU GAC UCUCAGAC | 3978 |
| 1612 | UUCCAGGG AGAA GAGAGU ACCAGAGAAACACACGUUGUGGUACAUUACCUGGUA | 11108 | ACUCUCA GAC CCCUGGAA | 3979 |
| 1629 | GGCCCGGC AGAA GUAGAU ACCAGAGAAACACACGUUGUGGUACAUUACCUGGUA | 11109 | AUCUACA GCU GCCGGGCC | 3980 |

194

| | | | | |
|---|---|---|---|---|
| 1632 | GAAGGCCC AGAA GCUGUA ACCAGAGAAACACACGUUGUGGUACAUUACCUGGUA | 11110 | UACAGCU GCC GGGCCUUC | 3981 |
| 1688 | UUCGGCAC AGAA GUGACA ACCAGAGAAACACACGUUGUGGUACAUUACCUGGUA | 11111 | UGUCACA GAU GUGCCGAA | 3982 |
| 1730 | UCUCCUUC AGAA GGCAUC ACCAGAGAAACACACGUUGUGGUACAUUACCUGGUA | 11112 | GAUGCCA GCC GAAGGAGA | 3983 |
| 1753 | CCACACAG AGAA GUUUCA ACCAGAGAAACACACGUUGUGGUACAUUACCUGGUA | 11113 | UGAAACU GUC CUGUGUGG | 3984 |
| 2017 | GGUUUUGA AGAA GGUGUG ACCAGAGAAACACACGUUGUGGUACAUUACCUGGUA | 11114 | CACACCU GCU UCAAAACC | 3985 |
| 2101 | ACCAAGUG AGAA GAGGCG ACCAGAGAAACACACGUUGUGGUACAUUACCUGGUA | 11115 | CGCCUCA GAU CACUUGGU | 3986 |
| 2176 | UUUCAAUA AGAA GCGUGC ACCAGAGAAACACACGUUGUGGUACAUUACCUGGUA | 8583 | GCACGCU GUU UAUUGAAA | 1441 |
| 2258 | GUGAGGUA AGAA GCGCUU ACCAGAGAAACACACGUUGUGGUACAUUACCUGGUA | 11116 | AAGCGCA GCC UACCUCAC | 3987 |
| 2305 | UGAGCGUG AGAA GCUCCA ACCAGAGAAACACACGUUGUGGUACAUUACCUGGUA | 11117 | UGGAGCU GAU CACGCUCA | 3988 |
| 2383 | CGGAAGAA AGAA GCUUCA ACCAGAGAAACACACGUUGUGGUACAUUACCUGGUA | 11118 | UGAAGCG GUC UUCUUCCG | 3989 |
| 2405 | GACAGGUA AGAA GUCUUU ACCAGAGAAACACACGUUGUGGUACAUUACCUGGUA | 11119 | AAAGACA GAC UACCUGUC | 3990 |
| 2432 | GGAACUUC AGAA GGGUCC ACCAGAGAAACACACGUUGUGGUACAUUACCUGGUA | 8587 | GGACCCA GAU GAAGUUCC | 1445 |
| 2464 | CAUAGGGC AGAA GUUCAC ACCAGAGAAACACACGUUGUGGUACAUUACCUGGUA | 11120 | GUGAACG GCU GCCCUAUG | 3991 |
| 2467 | CAUCAUAG AGAA GCCGUU ACCAGAGAAACACACGUUGUGGUACAUUACCUGGUA | 11121 | AACGGCU GCC CUAUGAUG | 3992 |
| 2592 | CACAGUCC AGAA GGUGGG ACCAGAGAAACACACGUUGUGGUACAUUACCUGGUA | 11122 | CCCACCU GCC GGACUGUG | 3993 |
| 2596 | CAGCCACA AGAA GGCAGG ACCAGAGAAACACACGUUGUGGUACAUUACCUGGUA | 11123 | CCUGCCG GAC UGUGGCUG | 3994 |
| 2653 | GUUCGGUC AGAA GAGCUU ACCAGAGAAACACACGUUGUGGUACAUUACCUGGUA | 11124 | AAGCUCU GAU GACCGAAC | 3995 |
| 2743 | CGAUCACC AGAA GAGGCC ACCAGAGAAACACACGUUGUGGUACAUUACCUGGUA | 11125 | GGCCUCU GAU GGUGAUCG | 3996 |
| 2779 | GGUAGUUG AGAA GGUUUC ACCAGAGAAACACACGUUGUGGUACAUUACCUGGUA | 11126 | GAAACCU GUC CAACUACC | 3997 |
| 2814 | CUUGUUGA AGAA GAAUAA ACCAGAGAAACACACGUUGUGGUACAUUACCUGGUA | 11127 | UUAUUCU GUC UCAACAAG | 3998 |
| 2831 | AUAUGCAA AGAA GCGUCC ACCAGAGAAACACACGUUGUGGUACAUUACCUGGUA | 11128 | GGACGCA GCC UUGCAUAU | 3999 |
| 2895 | ACUGUCUA AGAA GGGCUU ACCAGAGAAACACACGUUGUGGUACAUUACCUGGUA | 11129 | AAGCCCC GCC UAGACAGU | 4000 |
| 2913 | GACACUUG AGAA GCUGAC ACCAGAGAAACACACGUUGUGGUACAUUACCUGGUA | 11130 | GUCAGCA GCU CAAGUGUC | 4001 |
| 2928 | GAAGCUGG AGAA GGUGAC ACCAGAGAAACACACGUUGUGGUACAUUACCUGGUA | 11131 | GUCACCA GCU CCAGCUUC | 4002 |
| 2934 | UUCAGGGA AGAA GGAGCU ACCAGAGAAACACACGUUGUGGUACAUUACCUGGUA | 11132 | AGCUCCA GCU UCCCUGAA | 4003 |
| 3001 | UGGUGAGG AGAA GCUUGG ACCAGAGAAACACACGUUGUGGUACAUUACCUGGUA | 11133 | CCAAGCA GCC CCUCACCA | 4004 |
| 3022 | UGUAGGAA AGAA GGUCUU ACCAGAGAAACACACGUUGUGGUACAUUACCUGGUA | 11134 | AAGACCU GAU UUCCUACA | 4005 |
| 3033 | CACUUGGA AGAA GUAGGA ACCAGAGAAACACACGUUGUGGUACAUUACCUGGUA | 11135 | UCCUACA GUU UCCAAGUG | 4006 |
| 3064 | UUCUGGAG AGAA GAAACU ACCAGAGAAACACACGUUGUGGUACAUUACCUGGUA | 11136 | AGUUUCU GUC CUCCAGAA | 4007 |
| 3179 | CUCACAUA AGAA GGGUUC ACCAGAGAAACACACGUUGUGGUACAUUACCUGGUA | 8599 | GAACCCU GAU UAUGUGAG | 4008 |
| 3357 | CUUCAGGC AGAA GCAGAA ACCAGAGAAACACACGUUGUGGUACAUUACCUGGUA | 11137 | UUCUGCA GCC GCCUGAAG | 4009 |
| 3360 | UUCCUUCA AGAA GCUGCA ACCAGAGAAACACACGUUGUGGUACAUUACCUGGUA | 11138 | UGCAGCC GCC UGAAGGAA | 4010 |
| 3379 | GGGUUCUC AGAA GCAUGC ACCAGAGAAACACACGUUGUGGUACAUUACCUGGUA | 11139 | GCAUGCG GAU GAGAACCC | 4011 |
| 3463 | GUUCAGCA AGAA GGGGCC ACCAGAGAAACACACGUUGUGGUACAUUACCUGGUA | 11140 | GGCCCCG GUU UGCUGAAC | 4012 |
| 3496 | UGGCUUGA AGAA GGUCAC ACCAGAGAAACACACGUUGUGGUACAUUACCUGGUA | 11141 | GUGACCU GCU UCAAGCCA | 4013 |

195

| | | | | |
|---|---|---|---|---|
| 3553 | UGUUUCUA AGAA GUAUGG ACCAGAGAAACACACGUUGUGGUACAUUACCUGGUA | 11142 | CCAUACU GAC UAGAAACA | 4014 |
| 3615 | AUCUGCAA AGAA GUCCUU ACCAGAGAAACACACGUUGUGGUACAUUACCUGGUA | 11143 | AAGGACG GCU UUGCAGAU | 4015 |
| 3623 | AAAUGUGG AGAA GCAAAG ACCAGAGAAACACACGUUGUGGUACAUUACCUGGUA | 11144 | CUUUGCA GAU CCACAUUU | 4016 |
| 3650 | CUCACAUC AGAA GAGCUU ACCAGAGAAACACACGUUGUGGUACAUUACCUGGUA | 11145 | AAGCUCU GAU GAUGUGAG | 4017 |
| 3754 | UAGUGUCC AGAA GAUAGU ACCAGAGAAACACACGUUGUGGUACAUUACCUGGUA | 11146 | ACUAUCA GCU GGACACUA | 4018 |
| 3772 | GGGAGCCC AGAA GAGUGC ACCAGAGAAACACACGUUGUGGUACAUUACCUGGUA | 11147 | GCACUCU GCU GGGCUCCC | 4019 |
| 3796 | UCCAGGUG AGAA GCUUCA ACCAGAGAAACACACGUUGUGGUACAUUACCUGGUA | 11148 | UGAAGCG GUU CACCUGGA | 4020 |
| 3881 | CUCGGCAG AGAA GAAAGU ACCAGAGAAACACACGUUGUGGUACAUUACCUGGUA | 11149 | ACUUUCC GAU CUGCCGAG | 4021 |
| 3886 | UGGGCCUC AGAA GAUCGG ACCAGAGAAACACACGUUGUGGUACAUUACCUGGUA | 11150 | CCGAUCU GCC GAGGCCCA | 4022 |
| 3897 | GAAGCAGA AGAA GGGCCU ACCAGAGAAACACACGUUGUGGUACAUUACCUGGUA | 11151 | AGGCCCA GCU UCUGCUUC | 4023 |
| 3903 | GCUGGAGA AGAA GAAGCU ACCAGAGAAACACACGUUGUGGUACAUUACCUGGUA | 11152 | AGCUUCU GCU UCUCCAGC | 4024 |
| 3912 | GUGGCCAC AGAA GGAGAA ACCAGAGAAACACACGUUGUGGUACAUUACCUGGUA | 11153 | UUCUCCA GCU GUGGCCAC | 4025 |
| 3969 | UGGAGAAC AGAA GGACUC ACCAGAGAAACACACGUUGUGGUACAUUACCUGGUA | 11154 | GAGUCCU GCU GUUCUCCA | 4026 |
| 3972 | GGGUGGAG AGAA GCAGGA ACCAGAGAAACACACGUUGUGGUACAUUACCUGGUA | 11155 | UCCUGCU GUU CUCCACCC | 4027 |
| 3986 | GAGUUGUA AGAA GGGGGU ACCAGAGAAACACACGUUGUGGUACAUUACCUGGUA | 11156 | ACCCCCA GAC UACAACUC | 4028 |
| 4018 | UUUAGGCG AGAA GGGAGG ACCAGAGAAACACACGUUGUGGUACAUUACCUGGUA | 11157 | CCUCCCC GCC CGCCUAAA | 4029 |
| 4022 | AAGCUUUA AGAA GGCGGG ACCAGAGAAACACACGUUGUGGUACAUUACCUGGUA | 11158 | CCCGCCC GCC UAAAGCUU | 4030 |
| 4040 | GUUGUCGG AGAA GGUGAG ACCAGAGAAACACACGUUGUGGUACAUUACCUGGUA | 11159 | CUCACCA GCC CCGACAAC | 4031 |
| 4053 | CUGUCAGG AGAA GGUUGU ACCAGAGAAACACACGUUGUGGUACAUUACCUGGUA | 11160 | ACAACCA GCC CCUGACAG | 4032 |
| 4095 | UCCUGUGG AGAA GAAUAG ACCAGAGAAACACACGUUGUGGUACAUUACCUGGUA | 11161 | CUAUUCC GCU CCACAGGA | 4033 |
| 4110 | CGAAAAGC AGAA GGCUCC ACCAGAGAAACACACGUUGUGGUACAUUACCUGGUA | 11162 | GGAGCCA GCU GCUUUUCG | 4034 |
| 4113 | UCACGAAA AGAA GCUGGC ACCAGAGAAACACACGUUGUGGUACAUUACCUGGUA | 11163 | GCCAGCU GCU UUUCGUGA | 4035 |
| 4168 | UUAGUCAA AGAA GCAACA ACCAGAGAAACACACGUUGUGGUACAUUACCUGGUA | 11164 | UGUUGCU GUU UUGACUAA | 4036 |
| 4290 | GGUGGGCG AGAA GUCGCC ACCAGAGAAACACACGUUGUGGUACAUUACCUGGUA | 11165 | GGCGACC GCC CGCCCACC | 4037 |
| 4294 | GGCCGGUG AGAA GGCGGU ACCAGAGAAACACACGUUGUGGUACAUUACCUGGUA | 11166 | ACCGCCC GCC CACCGGCC | 4038 |
| 4329 | AGUCCCAC AGAA GCAGGG ACCAGAGAAACACACGUUGUGGUACAUUACCUGGUA | 11167 | CCCUGCA GCU GUGGGACU | 4039 |
| 4378 | CAGAGCAG AGAA GUGCAU ACCAGAGAAACACACGUUGUGGUACAUUACCUGGUA | 11168 | AUGCACU GAC CUGCUCUG | 4040 |
| 4383 | AGAGACAG AGAA GGUCAG ACCAGAGAAACACACGUUGUGGUACAUUACCUGGUA | 11169 | CUGACCU GCU CUGUCUCU | 4041 |
| 4388 | AUAAGAGA AGAA GAGCAG ACCAGAGAAACACACGUUGUGGUACAUUACCUGGUA | 11170 | CUGCUCU GUC UCUCUUAU | 4042 |
| 4457 | CUCCACAG AGAA GACGCA ACCAGAGAAACACACGUUGUGGUACAUUACCUGGUA | 11171 | UGCGUCC GUC CUGUGGAG | 4043 |
| 4525 | CCCGAAAC AGAA GAGGCC ACCAGAGAAACACACGUUGUGGUACAUUACCUGGUA | 11172 | GGCCUCC GCU GUUUCGGG | 4044 |
| 4528 | GGGCCCGA AGAA GCGGAG ACCAGAGAAACACACGUUGUGGUACAUUACCUGGUA | 11173 | CUCCGCU GUU UCGGGCCC | 4045 |
| 4643 | AAACAGAC AGAA GAAGAC ACCAGAGAAACACACGUUGUGGUACAUUACCUGGUA | 11174 | GUCUUCU GUU GUCUGUUU | 4046 |
| 4650 | GGAUGGUA AGAA GACAAC ACCAGAGAAACACACGUUGUGGUACAUUACCUGGUA | 11175 | GUUGUCU GUU UACCAUCC | 4047 |
| 4724 | ACUAGAGG AGAA GAUGAU ACCAGAGAAACACACGUUGUGGUACAUUACCUGGUA | 11176 | AUCAUCA GUU CCUCUAGU | 4048 |

196

| | | | | |
|---|---|---|---|---|
| 4771 | AUGCGAAG AGAA GGCCUG ACCAGAGAAACACACGUUGUGGUACAUUACCUGGUA | 11177 | CAGGCCU GAC CUUCGCAU | 4049 |
| 4785 | UCCCCGUG AGAA GUAUGC ACCAGAGAAACACACGUUGUGGUACAUUACCUGGUA | 11178 | GCAUACU GCU CACGGGGA | 4050 |
| 4809 | CUAGGCCA AGAA GGACCA ACCAGAGAAACACACGUUGUGGUACAUUACCUGGUA | 11179 | UGGUCCA GUU UGGCCUAG | 4051 |
| 4834 | UUGAGCCC AGAA GUAGGC ACCAGAGAAACACACGUUGUGGUACAUUACCUGGUA | 11180 | GCCUACU GAU GGGCUCAA | 4052 |
| 4912 | AUAUAUAA AGAA GGAUAA ACCAGAGAAACACACGUUGUGGUACAUUACCUGGUA | 11181 | UUAUCCU GUU UUAUAUAU | 4053 |
| 5119 | UCCUCUCA AGAA GCCUUG ACCAGAGAAACACACGUUGUGGUACAUUACCUGGUA | 11182 | CAAGGCA GUC UGAGAGGA | 4054 |
| 5144 | UAAAUAUG AGAA GAUACU ACCAGAGAAACACACGUUGUGGUACAUUACCUGGUA | 11183 | AGUAUCA GCC CAUAUUUA | 4055 |
| 5287 | AGGUAUGA AGAA GAUGAA ACCAGAGAAACACACGUUGUGGUACAUUACCUGGUA | 11184 | UUCAUCU GUU UCAUACCU | 4056 |
| 5363 | CCCCAAAG AGAA GGCACC ACCAGAGAAACACACGUUGUGGUACAUUACCUGGUA | 11185 | GGUGCCC GCU CUUUGGGG | 4057 |
| 5462 | CCGGCUCC AGAA GGUGUG ACCAGAGAAACACACGUUGUGGUACAUUACCUGGUA | 11186 | CACACCU GCC GGAGCCGG | 4058 |
| 5478 | GUCUGCCC AGAA GUGACC ACCAGAGAAACACACGUUGUGGUACAUUACCUGGUA | 11187 | GGUCACA GCU GGGCAGAC | 4059 |
| 5486 | UAUUCAUC AGAA GCCCAG ACCAGAGAAACACACGUUGUGGUACAUUACCUGGUA | 11188 | CUGGGCA GAC GAUGAAUA | 4060 |
| 5500 | UCUCCCAA AGAA GCUAUU ACCAGAGAAACACACGUUGUGGUACAUUACCUGGUA | 11189 | AAUAGCU GCU UUGGGAGA | 4061 |
| 5539 | CUGGCCCG AGAA GAGAAU ACCAGAGAAACACACGUUGUGGUACAUUACCUGGUA | 11190 | AUUCUCU GAC CGGGCCAG | 4062 |
| 5564 | CACAGGGG AGAA GGUACC ACCAGAGAAACACACGUUGUGGUACAUUACCUGGUA | 11191 | GGUACCU GCU CCCCUGUG | 4063 |
| 5597 | UCUCAUCA AGAA GAAAAC ACCAGAGAAACACACGUUGUGGUACAUUACCUGGUA | 11192 | GUUUUCU GUC UGAUGAGA | 4064 |
| 5601 | CCAGUCUC AGAA GACAGA ACCAGAGAAACACACGUUGUGGUACAUUACCUGGUA | 11193 | UCUGUCU GAU GAGACUGG | 4065 |
| 5639 | GGGCUGCA AGAA GUCUCA ACCAGAGAAACACACGUUGUGGUACAUUACCUGGUA | 11194 | UGAGACA GCC UGCAGCCC | 4066 |
| 5646 | CCACAGUG AGAA GCAGGC ACCAGAGAAACACACGUUGUGGUACAUUACCUGGUA | 11195 | GCCUGCA GCC CACUGUGG | 4067 |
| 5781 | CACACUGC AGAA GACAAG ACCAGAGAAACACACGUUGUGGUACAUUACCUGGUA | 11196 | CUUGUCG GCU GCAGUGUG | 4068 |
| 5829 | CUGUUCUC AGAA GUUUCU ACCAGAGAAACACACGUUGUGGUACAUUACCUGGUA | 11197 | AGAAACG GAU GAGAACAG | 4069 |
| 5842 | AAACCUCA AGAA GCUGUU ACCAGAGAAACACACGUUGUGGUACAUUACCUGGUA | 11198 | AACAGCA GCC UGAGGUUU | 4070 |
| 5915 | UUAUUAAA AGAA GAAUAA ACCAGAGAAACACACGUUGUGGUACAUUACCUGGUA | 11199 | UUAUUCC GAU UUUAAUAA | 4071 |
| 6010 | AGUCUUUA AGAA GAACCA ACCAGAGAAACACACGUUGUGGUACAUUACCUGGUA | 11200 | UGGUUCU GCU UAAAGACU | 4072 |

197

Table X: Homologous Hammerhead Ribozyme Target Sites Between Human flt-1 and KDR RNA

| | flt-1 | | | KDR | |
|---|---|---|---|---|---|
| nt. Position | Target Sequence | flt-1 Seq ID No. | nt. Position | Target Sequence | KDR Seq ID No. |
| 3388 | CCGGGAU A UUUAUAA | 4073 | 3151 | CCGGGAU A UUUAUAA | 4073 |
| 2174 | AAUGUAU A CACAGGG | 4074 | 3069 | AgUGUAU c CACAGGG | 4116 |
| 2990 | UGCAAAU A UGGAAAU | 4075 | 2756 | UGCAAAU u UGGAAAc | 4117 |
| 2693 | CUCCCUU A UGAUGCC | 4076 | 2459 | CUgCCUU A UGAUGCC | 4118 |
| 2981 | GUUGAAU A CUGCAAA | 4077 | 2747 | GUgGAAU u CUGCAAA | 4119 |
| 1359 | UAUGGUU A AAAGAUG | 4078 | 2097 | UgUGGUU u AAAGAUa | 4120 |
| 3390 | GGGAUAU U UAUAAGA | 4079 | 3153 | GGGAUAU U UAUAAag | 4121 |
| 3391 | GGAUAUU U AUAAGAA | 4080 | 3154 | GGAUAUU U AUAAagA | 4122 |
| 2925 | ACGUGGU U AACCUGC | 4081 | 2691 | AuGUGGU c AACCUuC | 4123 |
| 7140 | UAUUUCU A GUCAUGA | 4082 | 2340 | UAcUUCU u GUCAUcA | 4124 |
| 1785 | CAAUAAU A GAAGGAA | 4083 | 1515 | CucUAAU u GAAGGAA | 4125 |
| 2731 | GAGACUU A AACUGGG | 4084 | 768 | uuGACUU c AACUGGG | 4126 |
| 3974 | GAUGACU A CCAGGGC | 4085 | 1466 | GAgGACU u CCAGGGa | 4127 |
| 6590 | UUAAUGU A GAAAGAA | 4086 | 2603 | aaAAUGU u GAAAGAA | 4128 |
| 6705 | GCCAUUU A UGACAAA | 4087 | 3227 | aCaAUUU u UGACAgA | 4129 |
| 974 | GUCAAAU U ACUUAGA | 4088 | 147 | uUCAAAU U ACUUgcA | 4130 |
| 1872 | AUAAAGU U GGGACUG | 4089 | 1602 | AcAAAGU c GGGAgaG | 4131 |
| 2333 | ACUUGGU U UAAAAAC | 4090 | 1088 | AaaUGGU a UAAAAAu | 4132 |
| 2775 | AAGUGGU U CAAGCAU | 4091 | 1745 | AcaUGGU a CAAGCuU | 4133 |
| 3533 | UUCUCCU U AGGUGGG | 4092 | 3296 | UUuUCCU U AGGUGcu | 4134 |
| 3534 | UCUCCUU A GGUGGGU | 4093 | 3297 | UuUCCUU A GGUGcuU | 4135 |
| 3625 | GUACUCU A CUCCUGA | 4094 | 4054 | GagCUCU c CUCCUGu | 4136 |
| 1814 | AGCACCU U GGUUGUG | 4095 | 1059 | AGuACCU U GGUUacc | 4137 |
| 2744 | GGCAAAU C ACUUGGA | 4096 | 147 | uuCAAAU u ACUUGcA | 4130 |
| 2783 | CAAGCAU C AGCAUUU | 4097 | 796 | gAAGCAU C AGCAUaa | 4138 |
| 3613 | GAGAGCU C CUGAGUA | 4098 | 2968 | GgaAGCU C CUGAagA | 4139 |
| 4052 | AAGGCCU C GCUCAAG | 4099 | 1923 | ucuGCCU u GCUCAAG | 4140 |
| 5305 | UCUCCAU A UCAAAAC | 4100 | 456 | ggUCCAU u UCAAAuC | 4141 |

| | | | | | |
|---|---|---|---|---|---|
| 7158 | AUGUAUU U UGUAUAC | 4101 | 631 | gUcUAUU a UGUAcAu | 4142 |
| 1836 | CUAGAAU U UCUGGAA | 4102 | 1007 | aUgGAAU c UCUGGug | 4143 |
| 2565 | CUCUCUU C UGGCUCC | 4103 | 2328 | uguUCUU C UGGCUaC | 4144 |
| 4250 | CUGUACU C CACCCCA | 4104 | 3388 | uUaUACU a CACCagA | 4145 |
| 7124 | ACAUGGU U UGGUCCU | 4105 | 3778 | cagUGGU a UGGUuCU | 4146 |
| 436 | AUGGUCU U UGCCUGA | 4106 | 1337 | AcGGUCU a UGCCauu | 4147 |
| 2234 | GCACCAU A CCUCCUG | 4107 | 1344 | augCCAU u CCUCCcc | 4148 |
| 2763 | GGGCUUU U GGAAAAG | 4108 | 990 | uuGCUUU U GGAAguG | 4149 |
| 4229 | CCAGACU A CAACUCG | 4109 | 767 | auuGACU u CAACUgG | 4150 |
| 5301 | GUUUUCU C CAUAUCA | 4110 | 3307 | ugcUUCU C CAUAUCc | 4151 |
| 6015 | AGAAUGU A UGCCUCU | 4111 | 1917 | AcuAUGU c UGCCUug | 4152 |
| 6095 | AUUCCCU A GUGAGCC | 4112 | 1438 | AUaCCCU u GUGAaga | 4153 |
| 6236 | UGUUGUU C CUCUUCU | 4113 | 76 | UagUGUU u CUCUUga | 4154 |
| 5962 | GCUUCCU U UUAUCCA | 4114 | 3099 | auaUCCU c UUAUCgg | 4155 |
| 7629 | UAUAUAU U CUCUGCU | 4115 | 3096 | gAaAUAU c CUCUuaU | 4156 |

Lowercase letters are used to represent sequence variance between flt-1 and KDR RNA

199

Table XI: 2.5 µmol RNA Synthesis Cycle

| Reagent | Equivalents | Amount | Wait Time* |
|---|---|---|---|
| Phosphoramidites | 6.5 | 163 µL | 2.5 |
| *S*-Ethyl Tetrazole | 23.8 | 238 µL | 2.5 |
| Acetic Anhydride | 100 | 233 µL | 5 sec |
| *N*-Methyl Imidazole | 186 | 233 µL | 5 sec |
| TCA | 83.2 | 1.73 mL | 21 sec |
| Iodine | 8.0 | 1.18 mL | 45 sec |
| Acetonitrile | NA | 6.67 mL | NA |

* Wait time does not include contact time during delivery.

200

Table XII. Ribozyme and attenuated control sequences and locations of modified nucleotides. 237.198

| Target Site* | RPI No. | Ribozyme Sequence† (5'–3') | Activity | Seq. ID No. |
|---|---|---|---|---|
| *Flt*-1358-amino | RPI 4118 | 5' $a_s u_s c_s u_s$uuu cUGAUGa*ggc*gaaa*gcc*Gaa AccauacB 3' | Active | 11201 |
| *Flt*-1358-amino (att.) | RPI 4581 | $a_s u_s c_s u_s$uuu cUuAUGa*ggc*gaaa*gcc*Gau AccauacB | Attenuated | 11202 |
| *Flt*-1358-allyl | RPI 4159 | 5' $a_s u_s c_s u_s$uuu cUGAuGa*ggc*gaaa*gcc*Gaa AccauacB 3' | Active | 11203 |
| *Flt*-1358-allyl (att.) | RPI 4583 | $a_s u_s c_s u_s$uuu cUuAuGa*ggc*gaaa*gcc*Gau AccauacB | Attenuated | 11204 |
| *Flt*-4229-amino | RPI 4131 | $g_s a_s g_s u_s$ug cUGAUGa*ggc*gaaa*gcc*Gaa AgucugB | Active | 11205 |
| *Flt*-4229-amino (att.) | RPI 4582 | $g_s a_s g_s u_s$ug cUuAUGa*ggc*gaaa*gcc*Gau AgucugB | Attenuated | 11206 |
| *Flt*-4229-allyl | RPI 4172 | $g_s a_s g_s u_s$ug cUGAuGa*ggc*gaaa*gcc*Gaa AgucugB | Active | 11207 |
| *Flt*-4229-allyl (att.) | RPI 4584 | $g_s a_s g_s u_s$ug cUuAuGa*ggc*gaaa*gcc*Gau AgucugB | Attenuated | 11208 |
| *KDR*-726-amino | RPI 4097 | $u_s a_s c_s a_s$auu cUGAUGa*ggc*gaaa*gcc*Gaa AagacaaB | Active | 11209 |
| *KDR*-726-amino (att.) | RPI 4674 | $u_s a_s c_s a_s$auu cUuAUGa*ggc*gaaa*gcc*Gau AagacaaB | Attenuated | 11210 |
| *KDR*-726-allyl | RPI 4138 | $u_s a_s c_s a_s$auu cUGAuGa*ggc*gaaa*gcc*Gaa AagacaaB | Active | 11211 |
| *KDR*-726allyl (att.) | | $u_s a_s c_s a_s$auu cUuAuGa*ggc*gaaa*gcc*Gau AagacaaB | Attenuated | 11212 |
| *KDR*-3950-amino | RPI 4110 | $c_s u_s g_s g_s$ag cUGAUGa*ggc*gaaa*gcc*Gaa AcacggB | Active | 11213 |
| *KDR*-3950-amino (att.) | RPI 4677 | $c_s u_s g_s g_s$ag cUuAUGa*ggc*gaaa*gcc*Gau AcacggB | Attenuated | 11214 |
| *KDR*-3950-allyl | RPI 4151 | $c_s u_s g_s g_s$ag cUGAuGa*ggc*gaaa*gcc*Gaa AcacggB | Active | 11215 |
| *KDR*-3950-allyl (att.) | | $c_s u_s g_s g_s$ag cUuAuGa*ggc*gaaa*gcc*Gau AcacggB | Attenuated | 11216 |
| | | binding arm/catalytic core & stem II/binding arm | | |

- Ribozyme target sites are named according to the cleavage position in human *Flt-1* (EMBL accession no. X51602) or human *KDR* mRNA (EMBL accession no. L0497).

[†] Modifications are indicated as follows: 2'-*O*-methyl nucleotides, lowercase; ribonucleotides, uppercase G, A; inverted 3'-3' deoxyabasic, B. Two ribozyme motifs were tested [23]. For the $NH_2$-modified ribozymes, U indicates the two core positions where 2'-$NH_2$ uridines are present. *U* indicates 2'-*C*-allyl-uridine modification. The positions of four phosphorothioate linkages at the 5' end are indicated by a subscript "s". Changes in the attenuated controls are underlined. Nucleotides comprising the base paired region of stem II are in *italics*. A 3 bp stem II is shown above. Ribozymes or attenuated controls referred to in the text with a 4 bp stem II have one additional base pair such that the stem II/loop sequence is *ggcc*gaaa*ggcc*.

202

Table XIII. Ribozyme and attenuated control sequences with locations of modified nucleotides. 237.198

| Ribozyme | Sequence† (5'–3') | Activity | Seq. ID Nos. |
|---|---|---|---|
| RPI.4610 (ANGIOZYME™) | $g_sa_sg_su_s$ug cUGAuGa*ggcc*gaaa*ggcc*Gaa AgucugB | Active | 11217 |
| RPI.13141 | $g_sa_sg_su_s$ug cUAGaGa*ggcc*gaaa*ggcc*Gau AgucugB | BAC‡ | 11218 |
| RPI.13030 | $g_sa_sa_sg_s$gu cUAGuGa*ggcc*gaaa*ggcc*Gau AugucB | SAC* | 11219 |
| | binding arm / core & stem II / binding arm | | |

† Modifications are indicated as follows: 2'-*O*-methyl nucleotides, lowercase; ribonucleotides, uppercase G, A; 2'-*C*-allyl uridine, U; inverted 3'-3' deoxyabasic, B. The positions of four phosphorothioate linkages at the 5' end are indicated by a subscript "s". Nucleotides comprising the base paired region of stem II are in *italics*. Nucleotide changes in the core of the attenuated controls are underlined. ANGIOZYME ribozyme is targeted to cleave site 4229 in human flt-1 RNA and is identical to *Flt*-4229-allyl ribozyme (Table XII) except that the ANGIOZYME has a stem II of length 4 bps.

‡ BAC: *B*inding arm, *A*ttenuated core *C*ontrol.

* SAC: *S*crambled arm, *A*ttenuated core *C*ontrol.

Table XIV: NCH Ribozyme and Target Sequences 237/198

Core Sequence = CUGAUGAG GCCGUUAGGC CGAA
Underlined region can be any X sequence or linker, as described herein.

| nt. Position | NCH Ribozyme | Seq ID Nos. | Target | Seq ID Nos. |
|---|---|---|---|---|
| 9 | CCGAGAGG CUGAUGAG GCCGUUAGGC CGAA IUGUCCGC | 11220 | GCGGACAC T CCTCTCGG | 4157 |
| 11 | AGCCGAGA CUGAUGAG GCCGUUAGGC CGAA IAGUGUCC | 11221 | GGACACTC C TCTCGGCT | 4158 |
| 12 | GAGCCGAG CUGAUGAG GCCGUUAGGC CGAA IGAGUGUC | 11222 | GACACTCC T CTCGGCTC | 4159 |
| 14 | AGGAGCCG CUGAUGAG GCCGUUAGGC CGAA IAGGAGUG | 11223 | CACTCCTC T CGGCTCCT | 4160 |
| 19 | CGGGGAGG CUGAUGAG GCCGUUAGGC CGAA ICCGAGAG | 11224 | CTCTCGGC T CCTCCCCG | 4161 |
| 21 | GCCGGGGA CUGAUGAG GCCGUUAGGC CGAA IAGCCGAG | 11225 | CTCGGCTC C TCCCCGGC | 4162 |
| 22 | UGCCGGGG CUGAUGAG GCCGUUAGGC CGAA IGAGCCGA | 11226 | TCGGCTCC T CCCCGGCA | 4163 |
| 24 | GCUGCCGG CUGAUGAG GCCGUUAGGC CGAA IAGGAGCC | 11227 | GGCTCCTC C CCGGCAGC | 4164 |
| 25 | CGCUGCCG CUGAUGAG GCCGUUAGGC CGAA IGAGGAGC | 11228 | GCTCCTCC C CGGCAGCG | 4165 |
| 26 | CCGCUGCC CUGAUGAG GCCGUUAGGC CGAA IGGAGGAG | 11229 | CTCCTCCC C GGCAGCGG | 4166 |
| 30 | GCCGCCGC CUGAUGAG GCCGUUAGGC CGAA ICCGGGGA | 11230 | TCCCCGGC A GCGGCGGC | 4167 |
| 42 | CCGCUCCG CUGAUGAG GCCGUUAGGC CGAA ICCGCCGC | 11231 | GCGGCGGC T CGGAGCGG | 4168 |
| 53 | AGCCCCGG CUGAUGAG GCCGUUAGGC CGAA ICCCGCUC | 11232 | GAGCGGGC T CCGGGGCT | 4169 |
| 55 | CGAGCCCC CUGAUGAG GCCGUUAGGC CGAA IAGCCCGC | 11233 | GCGGGCTC C GGGGCTCG | 4170 |
| 61 | UGCACCCG CUGAUGAG GCCGUUAGGC CGAA ICCCCGGA | 11234 | TCCGGGGC T CGGGTGCA | 4171 |
| 69 | CUGGCCGC CUGAUGAG GCCGUUAGGC CGAA ICACCCGA | 11235 | TCGGGTGC A GCGGCCAG | 4172 |
| 75 | GGCCCGCU CUGAUGAG GCCGUUAGGC CGAA ICCGCUGC | 11236 | GCAGCGGC C AGCGGGCC | 4173 |
| 76 | AGGCCCGC CUGAUGAG GCCGUUAGGC CGAA IGCCGCUG | 11237 | CAGCGGCC A GCGGGCCT | 4174 |
| 83 | CGCCGCCA CUGAUGAG GCCGUUAGGC CGAA ICCCGCUG | 11238 | CAGCGGGC C TGGCGGCG | 4175 |
| 84 | UCGCCGCC CUGAUGAG GCCGUUAGGC CGAA IGCCCGCU | 11239 | AGCGGGCC T GGCGGCGA | 4176 |
| 100 | CUUCCCCG CUGAUGAG GCCGUUAGGC CGAA IUAAUCCU | 11240 | AGGATTAC C CGGGGAAG | 4177 |
| 101 | ACUUCCCC CUGAUGAG GCCGUUAGGC CGAA IGUAAUCC | 11241 | GGATTACC C GGGGAAGT | 4178 |
| 117 | CAGCCAGG CUGAUGAG GCCGUUAGGC CGAA IACAACCA | 11242 | TGGTTGTC T CCTGGCTG | 4179 |
| 119 | UCCAGCCA CUGAUGAG GCCGUUAGGC CGAA IAGACAAC | 11243 | GTTGTCTC C TGGCTGGA | 4180 |
| 120 | CUCCAGCC CUGAUGAG GCCGUUAGGC CGAA IGAGACAA | 11244 | TTGTCTCC T GGCTGGAG | 4181 |
| 124 | GCGGCUCC CUGAUGAG GCCGUUAGGC CGAA ICCAGGAG | 11245 | CTCCTGGC T GGAGCCGC | 4182 |

204

| | | | | |
|---|---|---|---|---|
| 130 | CGUCUCGC CUGAUGAG GCCGUUAGGC CGAA ICUCCAGC | 11246 | GCTGGAGC C GCGAGACG | 4183 |
| 144 | GCGCCCUG CUGAUGAG GCCGUUAGGC CGAA ICGCCCGU | 11247 | ACGGGCGC T CAGGGCGC | 4184 |
| 146 | CCGCGCCC CUGAUGAG GCCGUUAGGC CGAA IAGCGCCC | 11248 | GGGCGCTC A GGGCGCGG | 4185 |
| 158 | CCGCCGCC CUGAUGAG GCCGUUAGGC CGAA ICCCCGCG | 11249 | CGCGGGGC C GGCGGCGG | 4186 |
| 184 | GCCGCCAG CUGAUGAG GCCGUUAGGC CGAA IUCCGUCC | 11250 | GGACGGAC T CTGGCGGC | 4187 |
| 186 | CGGCCGCC CUGAUGAG GCCGUUAGGC CGAA IAGUCCGU | 11251 | ACGGACTC T GGCGGCCG | 4188 |
| 193 | AACGACCC CUGAUGAG GCCGUUAGGC CGAA ICCGCCAG | 11252 | CTGGCGGC C GGGTCGTT | 4189 |
| 205 | GCUCCCCC CUGAUGAG GCCGUUAGGC CGAA ICCAACGA | 11253 | TCGTTGGC C GGGGGAGC | 4190 |
| 220 | UCGCCCGG CUGAUGAG GCCGUUAGGC CGAA ICCCGCGC | 11254 | GCGCGGGC A CCGGGCGA | 4191 |
| 222 | GCUCGCCC CUGAUGAG GCCGUUAGGC CGAA IUGCCCGC | 11255 | GCGGGCAC C GGGCGAGC | 4192 |
| 231 | ACGCGGCC CUGAUGAG GCCGUUAGGC CGAA ICUCGCCC | 11256 | GGGCGAGC A GGCCGCGT | 4193 |
| 235 | CGCGACGC CUGAUGAG GCCGUUAGGC CGAA ICCUGCUC | 11257 | GAGCAGGC C GCGTCGCG | 4194 |
| 245 | CCAUGGUG CUGAUGAG GCCGUUAGGC CGAA ICGCGACG | 11258 | CGTCGCGC T CACCATGG | 4195 |
| 247 | GACCAUGG CUGAUGAG GCCGUUAGGC CGAA IAGCGCGA | 11259 | TCGCGCTC A CCATGGTC | 4196 |
| 249 | CUGACCAU CUGAUGAG GCCGUUAGGC CGAA IUGAGCGC | 11260 | GCGCTCAC C ATGGTCAG | 4197 |
| 250 | GCUGACCA CUGAUGAG GCCGUUAGGC CGAA IGUGAGCG | 11261 | CGCTCACC A TGGTCAGC | 4198 |
| 256 | CCAGUAGC CUGAUGAG GCCGUUAGGC CGAA IACCAUGG | 11262 | CCATGGTC A GCTACTGG | 4199 |
| 259 | GUCCCAGU CUGAUGAG GCCGUUAGGC CGAA ICUGACCA | 11263 | TGGTCAGC T ACTGGGAC | 4200 |
| 262 | GGUGUCCC CUGAUGAG GCCGUUAGGC CGAA IUAGCUGA | 11264 | TCAGCTAC T GGGACACC | 4201 |
| 268 | GACCCCGG CUGAUGAG GCCGUUAGGC CGAA IUCCCAGU | 11265 | ACTGGGAC A CCGGGGTC | 4202 |
| 270 | AGGACCCC CUGAUGAG GCCGUUAGGC CGAA IUGUCCCA | 11266 | TGGGACAC C GGGGTCCT | 4203 |
| 277 | GCACAGCA CUGAUGAG GCCGUUAGGC CGAA IACCCCGG | 11267 | CCGGGGTC C TGCTGTGC | 4204 |
| 278 | CGCACAGC CUGAUGAG GCCGUUAGGC CGAA IGACCCCG | 11268 | CGGGGTCC T GCTGTGCG | 4205 |
| 281 | GCGCGCAC CUGAUGAG GCCGUUAGGC CGAA ICAGGACC | 11269 | GGTCCTGC T GTGCGCGC | 4206 |
| 290 | AGCUGAGC CUGAUGAG GCCGUUAGGC CGAA ICGCGCAC | 11270 | GTGCGCGC T GCTCAGCT | 4207 |
| 293 | GACAGCUG CUGAUGAG GCCGUUAGGC CGAA ICAGCGCG | 11271 | CGCGCTGC T CAGCTGTC | 4208 |
| 295 | CAGACAGC CUGAUGAG GCCGUUAGGC CGAA IAGCAGCG | 11272 | CGCTGCTC A GCTGTCTG | 4209 |
| 298 | AAGCAGAC CUGAUGAG GCCGUUAGGC CGAA ICUGAGCA | 11273 | TGCTCAGC T GTCTGCTT | 4210 |
| 302 | UGAGAAGC CUGAUGAG GCCGUUAGGC CGAA IACAGCUG | 11274 | CAGCTGTC T GCTTCTCA | 4211 |
| 305 | CUGUGAGA CUGAUGAG GCCGUUAGGC CGAA ICAGACAG | 11275 | CTGTCTGC T TCTCACAG | 4212 |
| 308 | AUCCUGUG CUGAUGAG GCCGUUAGGC CGAA IAAGCAGA | 11276 | TCTGCTTC T CACAGGAT | 4213 |
| 310 | AGAUCCUG CUGAUGAG GCCGUUAGGC CGAA IAGAAGCA | 11277 | TGCTTCTC A CAGGATCT | 4214 |
| 312 | CUAGAUCC CUGAUGAG GCCGUUAGGC CGAA IUGAGAAG | 11278 | CTTCTCAC A GGATCTAG | 4215 |

204

| | | | | |
|---|---|---|---|---|
| 318 | CCUGAACU CUGAUGAG GCCGUUAGGC CGAA IAUCCUGU | 11279 | ACAGGATC T AGTTCAGG | 4216 |
| 324 | UUUGAACC CUGAUGAG GCCGUUAGGC CGAA IAACUAGA | 11280 | TCTAGTTC A GGTTCAAA | 4217 |
| 330 | UUUAAUUU CUGAUGAG GCCGUUAGGC CGAA IAACCUGA | 11281 | TCAGGTTC A AAATTAAA | 4218 |
| 344 | UCAGUUCA CUGAUGAG GCCGUUAGGC CGAA IAUCUUUU | 11282 | AAAAGATC C TGAACTGA | 4219 |
| 345 | CUCAGUUC CUGAUGAG GCCGUUAGGC CGAA IGAUCUUU | 11283 | AAAGATCC T GAACTGAG | 4220 |
| 350 | UUAAACUC CUGAUGAG GCCGUUAGGC CGAA IUUCAGGA | 11284 | TCCTGAAC T GAGTTTAA | 4221 |
| 364 | GUGCUGGG CUGAUGAG GCCGUUAGGC CGAA ICCUUUUA | 11285 | TAAAAGGC A CCCAGCAC | 4222 |
| 366 | AUGUGCUG CUGAUGAG GCCGUUAGGC CGAA IUGCCUUU | 11286 | AAAGGCAC C CAGCACAT | 4223 |
| 367 | GAUGUGCU CUGAUGAG GCCGUUAGGC CGAA IGUGCCUU | 11287 | AAGGCACC C AGCACATC | 4224 |
| 368 | UGAUGUGC CUGAUGAG GCCGUUAGGC CGAA IGGUGCCU | 11288 | AGGCACCC A GCACATCA | 4225 |
| 371 | GCAUGAUG CUGAUGAG GCCGUUAGGC CGAA ICUGGGUG | 11289 | CACCCAGC A CATCATGC | 4226 |
| 373 | UUGCAUGA CUGAUGAG GCCGUUAGGC CGAA IUGCUGGG | 11290 | CCCAGCAC A TCATGCAA | 4227 |
| 376 | UGCUUGCA CUGAUGAG GCCGUUAGGC CGAA IAUGUGCU | 11291 | AGCACATC A TGCAAGCA | 4228 |
| 380 | GGCCUGCU CUGAUGAG GCCGUUAGGC CGAA ICAUGAUG | 11292 | CATCATGC A AGCAGGCC | 4229 |
| 384 | GUCUGGCC CUGAUGAG GCCGUUAGGC CGAA ICUUGCAU | 11293 | ATGCAAGC A GGCCAGAC | 4230 |
| 388 | CAGUGUCU CUGAUGAG GCCGUUAGGC CGAA ICCUGCUU | 11294 | AAGCAGGC C AGACACTG | 4231 |
| 389 | GCAGUGUC CUGAUGAG GCCGUUAGGC CGAA IGCCUGCU | 11295 | AGCAGGCC A GACACTGC | 4232 |
| 393 | AGAUGCAG CUGAUGAG GCCGUUAGGC CGAA IUCUGGCC | 11296 | GGCCAGAC A CTGCATCT | 4233 |
| 395 | GGAGAUGC CUGAUGAG GCCGUUAGGC CGAA IUGUCUGG | 11297 | CCAGACAC T GCATCTCC | 4234 |
| 398 | AUUGGAGA CUGAUGAG GCCGUUAGGC CGAA ICAGUGUC | 11298 | GACACTGC A TCTCCAAT | 4235 |
| 401 | UGCAUUGG CUGAUGAG GCCGUUAGGC CGAA IAUGCAGU | 11299 | ACTGCATC T CCAATGCA | 4236 |
| 403 | CCUGCAUU CUGAUGAG GCCGUUAGGC CGAA IAGAUGCA | 11300 | TGCATCTC C AATGCAGG | 4237 |
| 404 | CCCUGCAU CUGAUGAG GCCGUUAGGC CGAA IGAGAUGC | 11301 | GCATCTCC A ATGCAGGG | 4238 |
| 409 | UUCCCCCC CUGAUGAG GCCGUUAGGC CGAA ICAUUGGA | 11302 | TCCAATGC A GGGGGGAA | 4239 |
| 420 | UUAUGGGC CUGAUGAG GCCGUUAGGC CGAA ICUUCCCC | 11303 | GGGGAAGC A GCCCATAA | 4240 |
| 423 | CAUUUAUG CUGAUGAG GCCGUUAGGC CGAA ICUGCUUC | 11304 | GAAGCAGC C CATAAATG | 4241 |
| 424 | CCAUUUAU CUGAUGAG GCCGUUAGGC CGAA IGCUGCUU | 11305 | AAGCAGCC C ATAAATGG | 4242 |
| 425 | ACCAUUUA CUGAUGAG GCCGUUAGGC CGAA IGGCUGCU | 11306 | AGCAGCCC A TAAATGGT | 4243 |
| 435 | UCAGGCAA CUGAUGAG GCCGUUAGGC CGAA IACCAUUU | 11307 | AAATGGTC T TTGCCTGA | 4244 |
| 440 | CCAUUUCA CUGAUGAG GCCGUUAGGC CGAA ICAAAGAC | 11308 | GTCTTTGC C TGAAATGG | 4245 |
| 441 | ACCAUUUC CUGAUGAG GCCGUUAGGC CGAA IGCAAAGA | 11309 | TCTTTGCC T GAAATGGT | 4246 |
| 470 | UUAUGCUC CUGAUGAG GCCGUUAGGC CGAA ICCUUUCG | 11310 | CGAAAGGC T GAGCATAA | 4247 |
| 475 | UUUAGUUA CUGAUGAG GCCGUUAGGC CGAA ICUCAGCC | 11311 | GGCTGAGC A TAACTAAA | 4248 |

| | | | | |
|---|---|---|---|---|
| 480 | GCAGAUUU CUGAUGAG GCCGUUAGGC CGAA IUUAUGCU | 11312 | AGCATAAC T AAATCTGC | 4249 |
| 486 | CCACAGGC CUGAUGAG GCCGUUAGGC CGAA IAUUUAGU | 11313 | ACTAAATC T GCCTGTGG | 4250 |
| 489 | CUUCCACA CUGAUGAG GCCGUUAGGC CGAA ICAGAUUU | 11314 | AAATCTGC C TGTGGAAG | 4251 |
| 490 | UCUUCCAC CUGAUGAG GCCGUUAGGC CGAA IGCAGAUU | 11315 | AATCTGCC T GTGGAAGA | 4252 |
| 505 | GAAUUGUU CUGAUGAG GCCGUUAGGC CGAA ICCAUUUC | 11316 | GAAATGGC A AACAATTC | 4253 |
| 509 | UGCAGAAU CUGAUGAG GCCGUUAGGC CGAA IUUUGCCA | 11317 | TGGCAAAC A ATTCTGCA | 4254 |
| 514 | AGUACUGC CUGAUGAG GCCGUUAGGC CGAA IAAUUGUU | 11318 | AACAATTC T GCAGTACT | 4255 |
| 517 | UAAAGUAC CUGAUGAG GCCGUUAGGC CGAA ICAGAAUU | 11319 | AATTCTGC A GTACTTTA | 4256 |
| 522 | AAGGUUAA CUGAUGAG GCCGUUAGGC CGAA IUACUGCA | 11320 | TGCAGTAC T TTAACCTT | 4257 |
| 528 | GUGUUCAA CUGAUGAG GCCGUUAGGC CGAA IUUAAAGU | 11321 | ACTTTAAC C TTGAACAC | 4258 |
| 529 | UGUGUUCA CUGAUGAG GCCGUUAGGC CGAA IGUUAAAG | 11322 | CTTTAACC T TGAACACA | 4259 |
| 535 | UUGAGCUG CUGAUGAG GCCGUUAGGC CGAA IUUCAAGG | 11323 | CCTTGAAC A CAGCTCAA | 4260 |
| 537 | GCUUGAGC CUGAUGAG GCCGUUAGGC CGAA IUGUUCAA | 11324 | TTGAACAC A GCTCAAGC | 4261 |
| 540 | UUUGCUUG CUGAUGAG GCCGUUAGGC CGAA ICUGUGUU | 11325 | AACACAGC T CAAGCAAA | 4262 |
| 542 | GGUUUGCU CUGAUGAG GCCGUUAGGC CGAA IAGCUGUG | 11326 | CACAGCTC A AGCAAACC | 4263 |
| 546 | GUGUGGUU CUGAUGAG GCCGUUAGGC CGAA ICUUGAGC | 11327 | GCTCAAGC A AACCACAC | 4264 |
| 550 | GCCAGUGU CUGAUGAG GCCGUUAGGC CGAA IUUUGCUU | 11328 | AAGCAAAC C ACACTGGC | 4265 |
| 551 | AGCCAGUG CUGAUGAG GCCGUUAGGC CGAA IGUUUGCU | 11329 | AGCAAACC A CACTGGCT | 4266 |
| 553 | GAAGCCAG CUGAUGAG GCCGUUAGGC CGAA IUGGUUUG | 11330 | CAAACCAC A CTGGCTTC | 4267 |
| 555 | UAGAAGCC CUGAUGAG GCCGUUAGGC CGAA IUGUGGUU | 11331 | AACCACAC T GGCTTCTA | 4268 |
| 559 | GCUGUAGA CUGAUGAG GCCGUUAGGC CGAA ICCAGUGU | 11332 | ACACTGGC T TCTACAGC | 4269 |
| 562 | GCAGCUGU CUGAUGAG GCCGUUAGGC CGAA IAAGCCAG | 11333 | CTGGCTTC T ACAGCTGC | 4270 |
| 565 | UUUGCAGC CUGAUGAG GCCGUUAGGC CGAA IUAGAAGC | 11334 | GCTTCTAC A GCTGCAAA | 4271 |
| 568 | AUAUUUGC CUGAUGAG GCCGUUAGGC CGAA ICUGUAGA | 11335 | TCTACAGC T GCAAATAT | 4272 |
| 571 | UAGAUAUU CUGAUGAG GCCGUUAGGC CGAA ICAGCUGU | 11336 | ACAGCTGC A AATATCTA | 4273 |
| 578 | GUACAGCU CUGAUGAG GCCGUUAGGC CGAA IAUAUUUG | 11337 | CAAATATC T AGCTGTAC | 4274 |
| 582 | GUAGGUAC CUGAUGAG GCCGUUAGGC CGAA ICUAGAUA | 11338 | TATCTAGC T GTACCTAC | 4275 |
| 587 | UUGAAGUA CUGAUGAG GCCGUUAGGC CGAA IUACAGCU | 11339 | AGCTGTAC C TACTTCAA | 4276 |
| 588 | UUUGAAGU CUGAUGAG GCCGUUAGGC CGAA IGUACAGC | 11340 | GCTGTACC T ACTTCAAA | 4277 |
| 591 | UUCUUUGA CUGAUGAG GCCGUUAGGC CGAA IUAGGUAC | 11341 | GTACCTAC T TCAAAGAA | 4278 |
| 594 | UUCUUCUU CUGAUGAG GCCGUUAGGC CGAA IAAGUAGG | 11342 | CCTACTTC A AAGAAGAA | 4279 |
| 609 | GCAGAUUC CUGAUGAG GCCGUUAGGC CGAA IUUUCCUU | 11343 | AAGGAAAC A GAATCTGC | 4280 |
| 615 | UAGAUUGC CUGAUGAG GCCGUUAGGC CGAA IAUUCUGU | 11344 | ACAGAATC T GCAATCTA | 4281 |

| | | | | |
|---|---|---|---|---|
| 618 | AUAUAGAU CUGAUGAG GCCGUUAGGC CGAA ICAGAUUC | 11345 | GAATCTGC A ATCTATAT | 4282 |
| 622 | AAAUAUAU CUGAUGAG GCCGUUAGGC CGAA IAUUGCAG | 11346 | CTGCAATC T ATATATTT | 4283 |
| 642 | GGUCUACC CUGAUGAG GCCGUUAGGC CGAA IUAUCACU | 11347 | AGTGATAC A GGTAGACC | 4284 |
| 650 | CUACGAAA CUGAUGAG GCCGUUAGGC CGAA IUCUACCU | 11348 | AGGTAGAC C TTTCGTAG | 4285 |
| 651 | UCUACGAA CUGAUGAG GCCGUUAGGC CGAA IGUCUACC | 11349 | GGTAGACC T TTCGTAGA | 4286 |
| 667 | GAUUUCAC CUGAUGAG GCCGUUAGGC CGAA IUACAUCU | 11350 | AGATGTAC A GTGAAATC | 4287 |
| 676 | AAUUUCGG CUGAUGAG GCCGUUAGGC CGAA IAUUUCAC | 11351 | GTGAAATC C CCGAAATT | 4288 |
| 677 | UAAUUUCG CUGAUGAG GCCGUUAGGC CGAA IGAUUUCA | 11352 | TGAAATCC C CGAAATTA | 4289 |
| 678 | AUAAUUUC CUGAUGAG GCCGUUAGGC CGAA IGGAUUUC | 11353 | GAAATCCC C GAAATTAT | 4290 |
| 689 | CAGUCAUG CUGAUGAG GCCGUUAGGC CGAA IUAUAAUU | 11354 | AATTATAC A CATGACTG | 4291 |
| 691 | UUCAGUCA CUGAUGAG GCCGUUAGGC CGAA IUGUAUAA | 11355 | TTATACAC A TGACTGAA | 4292 |
| 696 | CUUCCUUC CUGAUGAG GCCGUUAGGC CGAA IUCAUGUG | 11356 | CACATGAC T GAAGGAAG | 4293 |
| 710 | GAAUGACG CUGAUGAG GCCGUUAGGC CGAA ICUCCCUU | 11357 | AAGGGAGC T CGTCATTC | 4294 |
| 715 | GCAGGGAA CUGAUGAG GCCGUUAGGC CGAA IACGAGCU | 11358 | AGCTCGTC A TTCCCTGC | 4295 |
| 719 | CCCGGCAG CUGAUGAG GCCGUUAGGC CGAA IAAUGACG | 11359 | CGTCATTC C CTGCCGGG | 4296 |
| 720 | ACCCGGCA CUGAUGAG GCCGUUAGGC CGAA IGAAUGAC | 11360 | GTCATTCC C TGCCGGGT | 4297 |
| 721 | AACCCGGC CUGAUGAG GCCGUUAGGC CGAA IGGAAUGA | 11361 | TCATTCCC T GCCGGGTT | 4298 |
| 724 | CGUAACCC CUGAUGAG GCCGUUAGGC CGAA ICAGGGAA | 11362 | TTCCCTGC C GGGTTACG | 4299 |
| 735 | AUGUUAGG CUGAUGAG GCCGUUAGGC CGAA IACGUAAC | 11363 | GTTACGTC A CCTAACAT | 4300 |
| 737 | UGAUGUUA CUGAUGAG GCCGUUAGGC CGAA IUGACGUA | 11364 | TACGTCAC C TAACATCA | 4301 |
| 738 | GUGAUGUU CUGAUGAG GCCGUUAGGC CGAA IGUGACGU | 11365 | ACGTCACC T AACATCAC | 4302 |
| 742 | AACAGUGA CUGAUGAG GCCGUUAGGC CGAA IUUAGGUG | 11366 | CACCTAAC A TCACTGTT | 4303 |
| 745 | AGUAACAG CUGAUGAG GCCGUUAGGC CGAA IAUGUUAG | 11367 | CTAACATC A CTGTTACT | 4304 |
| 747 | AAAGUAAC CUGAUGAG GCCGUUAGGC CGAA IUGAUGUU | 11368 | AACATCAC T GTTACTTT | 4305 |
| 753 | UUUUUUAA CUGAUGAG GCCGUUAGGC CGAA IUAACAGU | 11369 | ACTGTTAC T TTAAAAAA | 4306 |
| 767 | UGUCAAGU CUGAUGAG GCCGUUAGGC CGAA IAAACUUU | 11370 | AAAGTTTC C ACTTGACA | 4307 |
| 768 | GUGUCAAG CUGAUGAG GCCGUUAGGC CGAA IGAAACUU | 11371 | AAGTTTCC A CTTGACAC | 4308 |
| 770 | AAGUGUCA CUGAUGAG GCCGUUAGGC CGAA IUGGAAAC | 11372 | GTTTCCAC T TGACACTT | 4309 |
| 775 | GAUCAAAG CUGAUGAG GCCGUUAGGC CGAA IUCAAGUG | 11373 | CACTTGAC A CTTTGATC | 4310 |
| 777 | GGGAUCAA CUGAUGAG GCCGUUAGGC CGAA IUGUCAAG | 11374 | CTTGACAC T TTGATCCC | 4311 |
| 784 | UCCAUCAG CUGAUGAG GCCGUUAGGC CGAA IAUCAAAG | 11375 | CTTTGATC C CTGATGGA | 4312 |
| 785 | UUCCAUCA CUGAUGAG GCCGUUAGGC CGAA IGAUCAAA | 11376 | TTTGATCC C TGATGGAA | 4313 |
| 786 | UUUCCAUC CUGAUGAG GCCGUUAGGC CGAA IGGAUCAA | 11377 | TTGATCCC T GATGGAAA | 4314 |

| | | | | | |
|---|---|---|---|---|---|
| 799 | CCAGAUUA CUGAUGAG GCCGUUAGGC CGAA ICGUUUUC | 11378 | GAAAACGC A TAATCTGG | 4315 |
| 805 | ACUGUCCC CUGAUGAG GCCGUUAGGC CGAA IAUUAUGC | 11379 | GCATAATC T GGGACAGT | 4316 |
| 811 | CUUUCUAC CUGAUGAG GCCGUUAGGC CGAA IUCCCAGA | 11380 | TCTGGGAC A GTAGAAAG | 4317 |
| 823 | UAUGAUGA CUGAUGAG GCCGUUAGGC CGAA ICCCUUUC | 11381 | GAAAGGGC T TCATCATA | 4318 |
| 826 | UGAUAUGA CUGAUGAG GCCGUUAGGC CGAA IAAGCCCU | 11382 | AGGGCTTC A TCATATCA | 4319 |
| 829 | AUUUGAUA CUGAUGAG GCCGUUAGGC CGAA IAUGAAGC | 11383 | GCTTCATC A TATCAAAT | 4320 |
| 834 | GUUGCAUU CUGAUGAG GCCGUUAGGC CGAA IAUAUGAU | 11384 | ATCATATC A AATGCAAC | 4321 |
| 840 | UUGUACGU CUGAUGAG GCCGUUAGGC CGAA ICAUUUGA | 11385 | TCAAATGC A ACGTACAA | 4322 |
| 847 | UAUUUCUU CUGAUGAG GCCGUUAGGC CGAA IUACGUUG | 11386 | CAACGTAC A AAGAAATA | 4323 |
| 860 | AGGUCAGA CUGAUGAG GCCGUUAGGC CGAA ICCCUAUU | 11387 | AATAGGGC T TCTGACCT | 4324 |
| 863 | CACAGGUC CUGAUGAG GCCGUUAGGC CGAA IAAGCCCU | 11388 | AGGGCTTC T GACCTGTG | 4325 |
| 867 | GCUUCACA CUGAUGAG GCCGUUAGGC CGAA IUCAGAAG | 11389 | CTTCTGAC C TGTGAAGC | 4326 |
| 868 | UGCUUCAC CUGAUGAG GCCGUUAGGC CGAA IGUCAGAA | 11390 | TTCTGACC T GTGAAGCA | 4327 |
| 876 | UUGACUGU CUGAUGAG GCCGUUAGGC CGAA ICUUCACA | 11391 | TGTGAAGC A ACAGTCAA | 4328 |
| 879 | CCAUUGAC CUGAUGAG GCCGUUAGGC CGAA IUUGCUUC | 11392 | GAAGCAAC A GTCAATGG | 4329 |
| 883 | AUGCCCAU CUGAUGAG GCCGUUAGGC CGAA IACUGUUG | 11393 | CAACAGTC A ATGGGCAT | 4330 |
| 890 | UAUACAAA CUGAUGAG GCCGUUAGGC CGAA ICCCAUUG | 11394 | CAATGGGC A TTTGTATA | 4331 |
| 903 | AGAUAGUU CUGAUGAG GCCGUUAGGC CGAA IUCUUAUA | 11395 | TATAAGAC A AACTATCT | 4332 |
| 907 | UGUGAGAU CUGAUGAG GCCGUUAGGC CGAA IUUUGUCU | 11396 | AGACAAAC T ATCTCACA | 4333 |
| 911 | GAUGUGUG CUGAUGAG GCCGUUAGGC CGAA IAUAGUUU | 11397 | AAACTATC T CACACATC | 4334 |
| 913 | UCGAUGUG CUGAUGAG GCCGUUAGGC CGAA IAGAUAGU | 11398 | ACTATCTC A CACATCGA | 4335 |
| 915 | UGUCGAUG CUGAUGAG GCCGUUAGGC CGAA IUGAGAUA | 11399 | TATCTCAC A CATCGACA | 4336 |
| 917 | UUUGUCGA CUGAUGAG GCCGUUAGGC CGAA IUGUGAGA | 11400 | TCTCACAC A TCGACAAA | 4337 |
| 923 | UAUUGGUU CUGAUGAG GCCGUUAGGC CGAA IUCGAUGU | 11401 | ACATCGAC A AACCAATA | 4338 |
| 927 | AUUGUAUU CUGAUGAG GCCGUUAGGC CGAA IUUUGUCG | 11402 | CGACAAAC C AATACAAT | 4339 |
| 928 | GAUUGUAU CUGAUGAG GCCGUUAGGC CGAA IGUUUGUC | 11403 | GACAAACC A ATACAATC | 4340 |
| 933 | UCUAUGAU CUGAUGAG GCCGUUAGGC CGAA IUAUUGGU | 11404 | ACCAATAC A ATCATAGA | 4341 |
| 937 | GACAUCUA CUGAUGAG GCCGUUAGGC CGAA IAUUGUAU | 11405 | ATACAATC A TAGATGTC | 4342 |
| 946 | GCUUAUUU CUGAUGAG GCCGUUAGGC CGAA IACAUCUA | 11406 | TAGATGTC C AAATAAGC | 4343 |
| 947 | UGCUUAUU CUGAUGAG GCCGUUAGGC CGAA IGACAUCU | 11407 | AGATGTCC A AATAAGCA | 4344 |
| 955 | GCGUGGUG CUGAUGAG GCCGUUAGGC CGAA ICUUAUUU | 11408 | AAATAAGC A CACCACGC | 4345 |
| 957 | GGGCGUGG CUGAUGAG GCCGUUAGGC CGAA IUGCUUAU | 11409 | ATAAGCAC A CCACGCCC | 4346 |
| 959 | CUGGGCGU CUGAUGAG GCCGUUAGGC CGAA IUGUGCUU | 11410 | AAGCACAC C ACGCCCAG | 4347 |

209

| | | | | |
|---|---|---|---|---|
| 960 | ACUGGGCG CUGAUGAG GCCGUUAGGC CGAA IGUGUGCU | 11411 | AGCACACC A CGCCCAGT | 4348 |
| 964 | UUUGACUG CUGAUGAG GCCGUUAGGC CGAA ICGUGGUG | 11412 | CACCACGC C CAGTCAAA | 4349 |
| 965 | AUUUGACU CUGAUGAG GCCGUUAGGC CGAA IGCGUGGU | 11413 | ACCACGCC C AGTCAAAT | 4350 |
| 966 | AAUUUGAC CUGAUGAG GCCGUUAGGC CGAA IGGCGUGG | 11414 | CCACGCCC A GTCAAATT | 4351 |
| 970 | AAGUAAUU CUGAUGAG GCCGUUAGGC CGAA IACUGGGC | 11415 | GCCCAGTC A AATTACTT | 4352 |
| 977 | GGCCUCUA CUGAUGAG GCCGUUAGGC CGAA IUAAUUUG | 11416 | CAAATTAC T TAGAGGCC | 4353 |
| 985 | AAGAGUAU CUGAUGAG GCCGUUAGGC CGAA ICCUCUAA | 11417 | TTAGAGGC C ATACTCTT | 4354 |
| 986 | CAAGAGUA CUGAUGAG GCCGUUAGGC CGAA IGCCUCUA | 11418 | TAGAGGCC A TACTCTTG | 4355 |
| 990 | AGGACAAG CUGAUGAG GCCGUUAGGC CGAA IUAUGGCC | 11419 | GGCCATAC T CTTGTCCT | 4356 |
| 992 | UGAGGACA CUGAUGAG GCCGUUAGGC CGAA IAGUAUGG | 11420 | CCATACTC T TGTCCTCA | 4357 |
| 997 | ACAAUUGA CUGAUGAG GCCGUUAGGC CGAA IACAAGAG | 11421 | CTCTTGTC C TCAATTGT | 4358 |
| 998 | UACAAUUG CUGAUGAG GCCGUUAGGC CGAA IGACAAGA | 11422 | TCTTGTCC T CAATTGTA | 4359 |
| 1000 | AGUACAAU CUGAUGAG GCCGUUAGGC CGAA IAGGACAA | 11423 | TTGTCCTC A ATTGTACT | 4360 |
| 1008 | GUGGUAGC CUGAUGAG GCCGUUAGGC CGAA IUACAAUU | 11424 | AATTGTAC T GCTACCAC | 4361 |
| 1011 | GGAGUGGU CUGAUGAG GCCGUUAGGC CGAA ICAGUACA | 11425 | TGTACTGC T ACCACTCC | 4362 |
| 1014 | AAGGGAGU CUGAUGAG GCCGUUAGGC CGAA IUAGCAGU | 11426 | ACTGCTAC C ACTCCCTT | 4363 |
| 1015 | CAAGGGAG CUGAUGAG GCCGUUAGGC CGAA IGUAGCAG | 11427 | CTGCTACC A CTCCCTTG | 4364 |
| 1017 | UUCAAGGG CUGAUGAG GCCGUUAGGC CGAA IUGGUAGC | 11428 | GCTACCAC T CCCTTGAA | 4365 |
| 1019 | UGUUCAAG CUGAUGAG GCCGUUAGGC CGAA IAGUGGUA | 11429 | TACCACTC C CTTGAACA | 4366 |
| 1020 | GUGUUCAA CUGAUGAG GCCGUUAGGC CGAA IGAGUGGU | 11430 | ACCACTCC C TTGAACAC | 4367 |
| 1021 | CGUGUUCA CUGAUGAG GCCGUUAGGC CGAA IGGAGUGG | 11431 | CCACTCCC T TGAACACG | 4368 |
| 1027 | AACUCUCG CUGAUGAG GCCGUUAGGC CGAA IUUCAAGG | 11432 | CCTTGAAC A CGAGAGTT | 4369 |
| 1037 | AGGUCAUU CUGAUGAG GCCGUUAGGC CGAA IAACUCUC | 11433 | GAGAGTTC A AATGACCT | 4370 |
| 1044 | UAACUCCA CUGAUGAG GCCGUUAGGC CGAA IUCAUUUG | 11434 | CAAATGAC C TGGAGTTA | 4371 |
| 1045 | GUAACUCC CUGAUGAG GCCGUUAGGC CGAA IGUCAUUU | 11435 | AAATGACC T GGAGTTAC | 4372 |
| 1054 | UUCAUCAG CUGAUGAG GCCGUUAGGC CGAA IUAACUCC | 11436 | GGAGTTAC C CTGATGAA | 4373 |
| 1055 | UUUCAUCA CUGAUGAG GCCGUUAGGC CGAA IGUAACUC | 11437 | GAGTTACC C TGATGAAA | 4374 |
| 1056 | UUUUCAUC CUGAUGAG GCCGUUAGGC CGAA IGGUAACU | 11438 | AGTTACCC T GATGAAAA | 4375 |
| 1077 | CUUACGGA CUGAUGAG GCCGUUAGGC CGAA ICUCUCUU | 11439 | AAGAGAGC T TCCGTAAG | 4376 |
| 1080 | CGCCUUAC CUGAUGAG GCCGUUAGGC CGAA IAAGCUCU | 11440 | AGAGCTTC C GTAAGGCG | 4377 |
| 1099 | AUUGCUUU CUGAUGAG GCCGUUAGGC CGAA IUCAAUUC | 11441 | GAATTGAC C AAAGCAAT | 4378 |
| 1100 | AAUUGCUU CUGAUGAG GCCGUUAGGC CGAA IGUCAAUU | 11442 | AATTGACC A AAGCAATT | 4379 |
| 1105 | AUGGGAAU CUGAUGAG GCCGUUAGGC CGAA ICUUUGGU | 11443 | ACCAAAGC A ATTCCCAT | 4380 |

| | | | | |
|---|---|---|---|---|
| 1110 | UUGGCAUG CUGAUGAG GCCGUUAGGC CGAA IAAUUGCU | 11444 | AGCAATTC C CATGCCAA | 4381 |
| 1111 | GUUGGCAU CUGAUGAG GCCGUUAGGC CGAA IGAAUUGC | 11445 | GCAATTCC C ATGCCAAC | 4382 |
| 1112 | UGUUGGCA CUGAUGAG GCCGUUAGGC CGAA IGGAAUUG | 11446 | CAATTCCC A TGCCAACA | 4383 |
| 1116 | AAUAUGUU CUGAUGAG GCCGUUAGGC CGAA ICAUGGGA | 11447 | TCCCATGC C AACATATT | 4384 |
| 1117 | GAAUAUGU CUGAUGAG GCCGUUAGGC CGAA IGCAUGGG | 11448 | CCCATGCC A ACATATTC | 4385 |
| 1120 | GUAGAAUA CUGAUGAG GCCGUUAGGC CGAA IUUGGCAU | 11449 | ATGCCAAC A TATTCTAC | 4386 |
| 1126 | AACACUGU CUGAUGAG GCCGUUAGGC CGAA IAAUAUGU | 11450 | ACATATTC T ACAGTGTT | 4387 |
| 1129 | AAGAACAC CUGAUGAG GCCGUUAGGC CGAA IUAGAAUA | 11451 | TATTCTAC A GTGTTCTT | 4388 |
| 1136 | CAAUAGUA CUGAUGAG GCCGUUAGGC CGAA IAACACUG | 11452 | CAGTGTTC T TACTATTG | 4389 |
| 1140 | UUGUCAAU CUGAUGAG GCCGUUAGGC CGAA IUAAGAAC | 11453 | GTTCTTAC T ATTGACAA | 4390 |
| 1147 | CUGCAUUU CUGAUGAG GCCGUUAGGC CGAA IUCAAUAG | 11454 | CTATTGAC A AAATGCAG | 4391 |
| 1154 | CUUUGUUC CUGAUGAG GCCGUUAGGC CGAA ICAUUUUG | 11455 | CAAAATGC A GAACAAAG | 4392 |
| 1159 | UUUGUCUU CUGAUGAG GCCGUUAGGC CGAA IUUCUGCA | 11456 | TGCAGAAC A AAGACAAA | 4393 |
| 1165 | AAGUCCUU CUGAUGAG GCCGUUAGGC CGAA IUCUUUGU | 11457 | ACAAAGAC A AAGGACTT | 4394 |
| 1172 | AAGUAUAA CUGAUGAG GCCGUUAGGC CGAA IUCCUUUG | 11458 | CAAAGGAC T TTATACTT | 4395 |
| 1179 | ACACGACA CUGAUGAG GCCGUUAGGC CGAA IUAUAAAG | 11459 | CTTTATAC T TGTCGTGT | 4396 |
| 1199 | UGAAUGAU CUGAUGAG GCCGUUAGGC CGAA IUCCACUC | 11460 | GAGTGGAC C ATCATTCA | 4397 |
| 1200 | UUGAAUGA CUGAUGAG GCCGUUAGGC CGAA IGUCCACU | 11461 | AGTGGACC A TCATTCAA | 4398 |
| 1203 | GAUUUGAA CUGAUGAG GCCGUUAGGC CGAA IAUGGUCC | 11462 | GGACCATC A TTCAAATC | 4399 |
| 1207 | AACAGAUU CUGAUGAG GCCGUUAGGC CGAA IAAUGAUG | 11463 | CATCATTC A AATCTGTT | 4400 |
| 1212 | GUGUUAAC CUGAUGAG GCCGUUAGGC CGAA IAUUUGAA | 11464 | TTCAAATC T GTTAACAC | 4401 |
| 1219 | CACUGAGG CUGAUGAG GCCGUUAGGC CGAA IUUAACAG | 11465 | CTGTTAAC A CCTCAGTG | 4402 |
| 1221 | UGCACUGA CUGAUGAG GCCGUUAGGC CGAA IUGUUAAC | 11466 | GTTAACAC C TCAGTGCA | 4403 |
| 1222 | AUGCACUG CUGAUGAG GCCGUUAGGC CGAA IGUGUUAA | 11467 | TTAACACC T CAGTGCAT | 4404 |
| 1224 | AUAUGCAC CUGAUGAG GCCGUUAGGC CGAA IAGGUGUU | 11468 | AACACCTC A GTGCATAT | 4405 |
| 1229 | CAUAUAUA CUGAUGAG GCCGUUAGGC CGAA ICACUGAG | 11469 | CTCAGTGC A TATATATG | 4406 |
| 1245 | GUGAUGAA CUGAUGAG GCCGUUAGGC CGAA ICUUUAUC | 11470 | GATAAAGC A TTCATCAC | 4407 |
| 1249 | CACAGUGA CUGAUGAG GCCGUUAGGC CGAA IAAUGCUU | 11471 | AAGCATTC A TCACTGTG | 4408 |
| 1252 | UUUCACAG CUGAUGAG GCCGUUAGGC CGAA IAUGAAUG | 11472 | CATTCATC A CTGTGAAA | 4409 |
| 1254 | UGUUUCAC CUGAUGAG GCCGUUAGGC CGAA IUGAUGAA | 11473 | TTCATCAC T GTGAAACA | 4410 |
| 1262 | GUUUUCGA CUGAUGAG GCCGUUAGGC CGAA IUUUCACA | 11474 | TGTGAAAC A TCGAAAAC | 4411 |
| 1271 | GCACCUGC CUGAUGAG GCCGUUAGGC CGAA IUUUUCGA | 11475 | TCGAAAAC A GCAGGTGC | 4412 |
| 1274 | CAAGCACC CUGAUGAG GCCGUUAGGC CGAA ICUGUUUU | 11476 | AAAACAGC A GGTGCTTG | 4413 |

211

| | | | | |
|---|---|---|---|---|
| 1280 | CGGUUUCA CUGAUGAG GCCGUUAGGC CGAA ICACCUGC | 11477 | GCAGGTGC T TGAAACCG | 4414 |
| 1287 | CCAGCUAC CUGAUGAG GCCGUUAGGC CGAA IUUUCAAG | 11478 | CTTGAAAC C GTAGCTGG | 4415 |
| 1293 | CGCUUGCC CUGAUGAG GCCGUUAGGC CGAA ICUACGGU | 11479 | ACCGTAGC T GGCAAGCG | 4416 |
| 1297 | AGACCGCU CUGAUGAG GCCGUUAGGC CGAA ICCAGCUA | 11480 | TAGCTGGC A AGCGGTCT | 4417 |
| 1305 | AGCCGGUA CUGAUGAG GCCGUUAGGC CGAA IACCGCUU | 11481 | AAGCGGTC T TACCGGCT | 4418 |
| 1309 | AGAGAGCC CUGAUGAG GCCGUUAGGC CGAA IUAAGACC | 11482 | GGTCTTAC C GGCTCTCT | 4419 |
| 1313 | UCAUAGAG CUGAUGAG GCCGUUAGGC CGAA ICCGGUAA | 11483 | TTACCGGC T CTCTATGA | 4420 |
| 1315 | UUUCAUAG CUGAUGAG GCCGUUAGGC CGAA IAGCCGGU | 11484 | ACCGGCTC T CTATGAAA | 4421 |
| 1317 | ACUUUCAU CUGAUGAG GCCGUUAGGC CGAA IAGAGCCG | 11485 | CGGCTCTC T ATGAAAGT | 4422 |
| 1332 | GAGGGAAA CUGAUGAG GCCGUUAGGC CGAA ICCUUCAC | 11486 | GTGAAGGC A TTTCCCTC | 4423 |
| 1337 | CCGGCGAG CUGAUGAG GCCGUUAGGC CGAA IAAAUGCC | 11487 | GGCATTTC C CTCGCCGG | 4424 |
| 1338 | UCCGGCGA CUGAUGAG GCCGUUAGGC CGAA IGAAAUGC | 11488 | GCATTTCC C TCGCCGGA | 4425 |
| 1339 | UUCCGGCG CUGAUGAG GCCGUUAGGC CGAA IGGAAAUG | 11489 | CATTTCCC T CGCCGGAA | 4426 |
| 1343 | CAACUUCC CUGAUGAG GCCGUUAGGC CGAA ICGAGGGA | 11490 | TCCCTCGC C GGAAGTTG | 4427 |
| 1373 | CAGUCGCA CUGAUGAG GCCGUUAGGC CGAA IUAACCCA | 11491 | TGGGTTAC C TGCGACTG | 4428 |
| 1374 | UCAGUCGC CUGAUGAG GCCGUUAGGC CGAA IGUAACCC | 11492 | GGGTTACC T GCGACTGA | 4429 |
| 1380 | GAUUUCUC CUGAUGAG GCCGUUAGGC CGAA IUCGCAGG | 11493 | CCTGCGAC T GAGAAATC | 4430 |
| 1389 | UAGCGAGC CUGAUGAG GCCGUUAGGC CGAA IAUUUCUC | 11494 | GAGAAATC T GCTCGCTA | 4431 |
| 1392 | AAAUAGCG CUGAUGAG GCCGUUAGGC CGAA ICAGAUUU | 11495 | AAATCTGC T CGCTATTT | 4432 |
| 1396 | AGUCAAAU CUGAUGAG GCCGUUAGGC CGAA ICGAGCAG | 11496 | CTGCTCGC T ATTTGACT | 4433 |
| 1404 | UAGCCACG CUGAUGAG GCCGUUAGGC CGAA IUCAAAUA | 11497 | TATTTGAC T CGTGGCTA | 4434 |
| 1411 | UAACGAGU CUGAUGAG GCCGUUAGGC CGAA ICCACGAG | 11498 | CTCGTGGC T ACTCGTTA | 4435 |
| 1414 | AAUUAACG CUGAUGAG GCCGUUAGGC CGAA IUAGCCAC | 11499 | GTGGCTAC T CGTTAATT | 4436 |
| 1426 | UACGUCCU CUGAUGAG GCCGUUAGGC CGAA IAUAAUUA | 11500 | TAATTATC A AGGACGTA | 4437 |
| 1437 | UCCUCUUC CUGAUGAG GCCGUUAGGC CGAA IUUACGUC | 11501 | GACGTAAC T GAAGAGGA | 4438 |
| 1449 | UAAUUCCC CUGAUGAG GCCGUUAGGC CGAA ICAUCCUC | 11502 | GAGGATGC A GGGAATTA | 4439 |
| 1461 | AGCAAGAU CUGAUGAG GCCGUUAGGC CGAA IUAUAAUU | 11503 | AATTATAC A ATCTTGCT | 4440 |
| 1465 | GCUCAGCA CUGAUGAG GCCGUUAGGC CGAA IAUUGUAU | 11504 | ATACAATC T TGCTGAGC | 4441 |
| 1469 | UUAUGCUC CUGAUGAG GCCGUUAGGC CGAA ICAAGAUU | 11505 | AATCTTGC T GAGCATAA | 4442 |
| 1474 | CUGUUUUA CUGAUGAG GCCGUUAGGC CGAA ICUCAGCA | 11506 | TGCTGAGC A TAAAACAG | 4443 |
| 1481 | CAUUUGAC CUGAUGAG GCCGUUAGGC CGAA IUUUUAUG | 11507 | CATAAAAC A GTCAAATG | 4444 |
| 1485 | AACACAUU CUGAUGAG GCCGUUAGGC CGAA IACUGUUU | 11508 | AAACAGTC A AATGTGTT | 4445 |
| 1501 | GGCAGUGA CUGAUGAG GCCGUUAGGC CGAA IUUUUUAA | 11509 | TTAAAAAC C TCACTGCC | 4446 |

| | | | | |
|---|---|---|---|---|
| 1502 | UGGCAGUG CUGAUGAG GCCGUUAGGC CGAA IGUUUUUA | 11510 | TAAAAACC T CACTGCCA | 4447 |
| 1504 | AGUGGCAG CUGAUGAG GCCGUUAGGC CGAA IAGGUUUU | 11511 | AAAACCTC A CTGCCACT | 4448 |
| 1506 | AGAGUGGC CUGAUGAG GCCGUUAGGC CGAA IUGAGGUU | 11512 | AACCTCAC T GCCACTCT | 4449 |
| 1509 | AUUAGAGU CUGAUGAG GCCGUUAGGC CGAA ICAGUGAG | 11513 | CTCACTGC C ACTCTAAT | 4450 |
| 1510 | AAUUAGAG CUGAUGAG GCCGUUAGGC CGAA IGCAGUGA | 11514 | TCACTGCC A CTCTAATT | 4451 |
| 1512 | ACAAUUAG CUGAUGAG GCCGUUAGGC CGAA IUGGCAGU | 11515 | ACTGCCAC T CTAATTGT | 4452 |
| 1514 | UGACAAUU CUGAUGAG GCCGUUAGGC CGAA IAGUGGCA | 11516 | TGCCACTC T AATTGTCA | 4453 |
| 1522 | UUUCACAU CUGAUGAG GCCGUUAGGC CGAA IACAAUUA | 11517 | TAATTGTC A ATGTGAAA | 4454 |
| 1532 | AAAUCUGG CUGAUGAG GCCGUUAGGC CGAA IUUUCACA | 11518 | TGTGAAAC C CCAGATTT | 4455 |
| 1533 | UAAAUCUG CUGAUGAG GCCGUUAGGC CGAA IGUUUCAC | 11519 | GTGAAACC C CAGATTTA | 4456 |
| 1534 | GUAAAUCU CUGAUGAG GCCGUUAGGC CGAA IGGUUUCA | 11520 | TGAAACCC C AGATTTAC | 4457 |
| 1535 | CGUAAAUC CUGAUGAG GCCGUUAGGC CGAA IGGGUUUC | 11521 | GAAACCCC A GATTTACG | 4458 |
| 1551 | GAUGACAC CUGAUGAG GCCGUUAGGC CGAA ICCUUUUC | 11522 | GAAAAGGC C GTGTCATC | 4459 |
| 1557 | GGAAACGA CUGAUGAG GCCGUUAGGC CGAA IACACGGC | 11523 | GCCGTGTC A TCGTTTCC | 4460 |
| 1565 | CCGGGUCU CUGAUGAG GCCGUUAGGC CGAA IAAACGAU | 11524 | ATCGTTTC C AGACCCGG | 4461 |
| 1566 | GCCGGGUC CUGAUGAG GCCGUUAGGC CGAA IGAAACGA | 11525 | TCGTTTCC A GACCCGGC | 4462 |
| 1570 | GAGAGCCG CUGAUGAG GCCGUUAGGC CGAA IUCUGGAA | 11526 | TTCCAGAC C CGGCTCTC | 4463 |
| 1571 | AGAGAGCC CUGAUGAG GCCGUUAGGC CGAA IGUCUGGA | 11527 | TCCAGACC C GGCTCTCT | 4464 |
| 1575 | GGGUAGAG CUGAUGAG GCCGUUAGGC CGAA ICCGGGUC | 11528 | GACCCGGC T CTCTACCC | 4465 |
| 1577 | GUGGGUAG CUGAUGAG GCCGUUAGGC CGAA IAGCCGGG | 11529 | CCCGGCTC T CTACCCAC | 4466 |
| 1579 | CAGUGGGU CUGAUGAG GCCGUUAGGC CGAA IAGAGCCG | 11530 | CGGCTCTC T ACCCACTG | 4467 |
| 1582 | GCCCAGUG CUGAUGAG GCCGUUAGGC CGAA IUAGAGAG | 11531 | CTCTCTAC C CACTGGGC | 4468 |
| 1583 | UGCCCAGU CUGAUGAG GCCGUUAGGC CGAA IGUAGAGA | 11532 | TCTCTACC C ACTGGGCA | 4469 |
| 1584 | CUGCCCAG CUGAUGAG GCCGUUAGGC CGAA IGGUAGAG | 11533 | CTCTACCC A CTGGGCAG | 4470 |
| 1586 | UGCUGCCC CUGAUGAG GCCGUUAGGC CGAA IUGGGUAG | 11534 | CTACCCAC T GGGCAGCA | 4471 |
| 1591 | UUGUCUGC CUGAUGAG GCCGUUAGGC CGAA ICCCAGUG | 11535 | CACTGGGC A GCAGACAA | 4472 |
| 1594 | GAUUUGUC CUGAUGAG GCCGUUAGGC CGAA ICUGCCCA | 11536 | TGGGCAGC A GACAAATC | 4473 |
| 1598 | UCAGGAUU CUGAUGAG GCCGUUAGGC CGAA IUCUGCUG | 11537 | CAGCAGAC A AATCCTGA | 4474 |
| 1603 | ACAAGUCA CUGAUGAG GCCGUUAGGC CGAA IAUUUGUC | 11538 | GACAAATC C TGACTTGT | 4475 |
| 1604 | UACAAGUC CUGAUGAG GCCGUUAGGC CGAA IGAUUUGU | 11539 | ACAAATCC T GACTTGTA | 4476 |
| 1608 | GCGGUACA CUGAUGAG GCCGUUAGGC CGAA IUCAGGAU | 11540 | ATCCTGAC T TGTACCGC | 4477 |
| 1614 | CCAUAUGC CUGAUGAG GCCGUUAGGC CGAA IUACAAGU | 11541 | ACTTGTAC C GCATATGG | 4478 |
| 1617 | AUACCAUA CUGAUGAG GCCGUUAGGC CGAA ICGGUACA | 11542 | TGTACCGC A TATGGTAT | 4479 |

| | | | | |
|---|---|---|---|---|
| 1627 | AGGUUGAG CUGAUGAG GCCGUUAGGC CGAA IAUACCAU | 11543 | ATGGTATC C CTCAACCT | 4480 |
| 1628 | UAGGUUGA CUGAUGAG GCCGUUAGGC CGAA IGAUACCA | 11544 | TGGTATCC C TCAACCTA | 4481 |
| 1629 | GUAGGUUG CUGAUGAG GCCGUUAGGC CGAA IGGAUACC | 11545 | GGTATCCC T CAACCTAC | 4482 |
| 1631 | UUGUAGGU CUGAUGAG GCCGUUAGGC CGAA IAGGGAUA | 11546 | TATCCCTC A ACCTACAA | 4483 |
| 1634 | UGAUUGUA CUGAUGAG GCCGUUAGGC CGAA IUUGAGGG | 11547 | CCCTCAAC C TACAATCA | 4484 |
| 1635 | UUGAUUGU CUGAUGAG GCCGUUAGGC CGAA IGUUGAGG | 11548 | CCTCAACC T ACAATCAA | 4485 |
| 1638 | CACUUGAU CUGAUGAG GCCGUUAGGC CGAA IUAGGUUG | 11549 | CAACCTAC A ATCAAGTG | 4486 |
| 1642 | GAACCACU CUGAUGAG GCCGUUAGGC CGAA IAUUGUAG | 11550 | CTACAATC A AGTGGTTC | 4487 |
| 1651 | GGGGUGCC CUGAUGAG GCCGUUAGGC CGAA IAACCACU | 11551 | AGTGGTTC T GGCACCCC | 4488 |
| 1655 | UACAGGGG CUGAUGAG GCCGUUAGGC CGAA ICCAGAAC | 11552 | GTTCTGGC A CCCCTGTA | 4489 |
| 1657 | GUUACAGG CUGAUGAG GCCGUUAGGC CGAA IUGCCAGA | 11553 | TCTGGCAC C CCTGTAAC | 4490 |
| 1658 | GGUUACAG CUGAUGAG GCCGUUAGGC CGAA IGUGCCAG | 11554 | CTGGCACC C CTGTAACC | 4491 |
| 1659 | UGGUUACA CUGAUGAG GCCGUUAGGC CGAA IGGUGCCA | 11555 | TGGCACCC C TGTAACCA | 4492 |
| 1660 | AUGGUUAC CUGAUGAG GCCGUUAGGC CGAA IGGGUGCC | 11556 | GGCACCCC T GTAACCAT | 4493 |
| 1666 | AUGAUUAU CUGAUGAG GCCGUUAGGC CGAA IUUACAGG | 11557 | CCTGTAAC C ATAATCAT | 4494 |
| 1667 | AAUGAUUA CUGAUGAG GCCGUUAGGC CGAA IGUUACAG | 11558 | CTGTAACC A TAATCATT | 4495 |
| 1673 | CUUCGGAA CUGAUGAG GCCGUUAGGC CGAA IAUUAUGG | 11559 | CCATAATC A TTCCGAAG | 4496 |
| 1677 | CUUGCUUC CUGAUGAG GCCGUUAGGC CGAA IAAUGAUU | 11560 | AATCATTC C GAAGCAAG | 4497 |
| 1683 | UCACACCU CUGAUGAG GCCGUUAGGC CGAA ICUUCGGA | 11561 | TCCGAAGC A AGGTGTGA | 4498 |
| 1693 | GGAACAAA CUGAUGAG GCCGUUAGGC CGAA IUCACACC | 11562 | GGTGTGAC T TTTGTTCC | 4499 |
| 1701 | UCAUUAUU CUGAUGAG GCCGUUAGGC CGAA IAACAAAA | 11563 | TTTTGTTC C AATAATGA | 4500 |
| 1702 | UUCAUUAU CUGAUGAG GCCGUUAGGC CGAA IGAACAAA | 11564 | TTTGTTCC A ATAATGAA | 4501 |
| 1716 | AGGAUAAA CUGAUGAG GCCGUUAGGC CGAA IACUCUUC | 11565 | GAAGAGTC C TTTATCCT | 4502 |
| 1717 | CAGGAUAA CUGAUGAG GCCGUUAGGC CGAA IGACUCUU | 11566 | AAGAGTCC T TTATCCTG | 4503 |
| 1723 | AGCAUCCA CUGAUGAG GCCGUUAGGC CGAA IAUAAAGG | 11567 | CCTTTATC C TGGATGCT | 4504 |
| 1724 | CAGCAUCC CUGAUGAG GCCGUUAGGC CGAA IGAUAAAG | 11568 | CTTTATCC T GGATGCTG | 4505 |
| 1731 | UUGCUGUC CUGAUGAG GCCGUUAGGC CGAA ICAUCCAG | 11569 | CTGGATGC T GACAGCAA | 4506 |
| 1735 | CAUGUUGC CUGAUGAG GCCGUUAGGC CGAA IUCAGCAU | 11570 | ATGCTGAC A GCAACATG | 4507 |
| 1738 | UCCCAUGU CUGAUGAG GCCGUUAGGC CGAA ICUGUCAG | 11571 | CTGACAGC A ACATGGGA | 4508 |
| 1741 | GUUUCCCA CUGAUGAG GCCGUUAGGC CGAA IUUGCUGU | 11572 | ACAGCAAC A TGGGAAAC | 4509 |
| 1750 | CUCAAUUC CUGAUGAG GCCGUUAGGC CGAA IUUUCCCA | 11573 | TGGGAAAC A GAATTGAG | 4510 |
| 1762 | CUGAGUGA CUGAUGAG GCCGUUAGGC CGAA ICUCUCAA | 11574 | TTGAGAGC A TCACTCAG | 4511 |
| 1765 | GCGCUGAG CUGAUGAG GCCGUUAGGC CGAA IAUGCUCU | 11575 | AGAGCATC A CTCAGCGC | 4512 |

| | | | | |
|---|---|---|---|---|
| 1767 | AUGCGCUG CUGAUGAG GCCGUUAGGC CGAA IUGAUGCU | 11576 | AGCATCAC T CAGCGCAT | 4513 |
| 1769 | CCAUGCGC CUGAUGAG GCCGUUAGGC CGAA IAGUGAUG | 11577 | CATCACTC A GCGCATGG | 4514 |
| 1774 | UAUUGCCA CUGAUGAG GCCGUUAGGC CGAA ICGCUGAG | 11578 | CTCAGCGC A TGGCAATA | 4515 |
| 1779 | UCUAUUAU CUGAUGAG GCCGUUAGGC CGAA ICCAUGCG | 11579 | CGCATGGC A ATAATAGA | 4516 |
| 1806 | AAGGUGCU CUGAUGAG GCCGUUAGGC CGAA ICCAUCUU | 11580 | AAGATGGC T AGCACCTT | 4517 |
| 1810 | AACCAAGG CUGAUGAG GCCGUUAGGC CGAA ICUAGCCA | 11581 | TGGCTAGC A CCTTGGTT | 4518 |
| 1812 | ACAACCAA CUGAUGAG GCCGUUAGGC CGAA IUGCUAGC | 11582 | GCTAGCAC C TTGGTTGT | 4519 |
| 1813 | CACAACCA CUGAUGAG GCCGUUAGGC CGAA IGUGCUAG | 11583 | CTAGCACC T TGGTTGTG | 4520 |
| 1824 | CUAGAGUC CUGAUGAG GCCGUUAGGC CGAA ICCACAAC | 11584 | GTTGTGGC T GACTCTAG | 4521 |
| 1828 | AAUUCUAG CUGAUGAG GCCGUUAGGC CGAA IUCAGCCA | 11585 | TGGCTGAC T CTAGAATT | 4522 |
| 1830 | GAAAUUCU CUGAUGAG GCCGUUAGGC CGAA IAGUCAGC | 11586 | GCTGACTC T AGAATTTC | 4523 |
| 1839 | UAGAUUCC CUGAUGAG GCCGUUAGGC CGAA IAAAUUCU | 11587 | AGAATTTC T GGAATCTA | 4524 |
| 1846 | GCAAAUGU CUGAUGAG GCCGUUAGGC CGAA IAUUCCAG | 11588 | CTGGAATC T ACATTTGC | 4525 |
| 1849 | UAUGCAAA CUGAUGAG GCCGUUAGGC CGAA IUAGAUUC | 11589 | GAATCTAC A TTTGCATA | 4526 |
| 1855 | GGAAGCUA CUGAUGAG GCCGUUAGGC CGAA ICAAAUGU | 11590 | ACATTTGC A TAGCTTCC | 4527 |
| 1860 | UUAUUGGA CUGAUGAG GCCGUUAGGC CGAA ICUAUGCA | 11591 | TGCATAGC T TCCAATAA | 4528 |
| 1863 | ACUUUAUU CUGAUGAG GCCGUUAGGC CGAA IAAGCUAU | 11592 | ATAGCTTC C AATAAAGT | 4529 |
| 1864 | AACUUUAU CUGAUGAG GCCGUUAGGC CGAA IGAAGCUA | 11593 | TAGCTTCC A ATAAAGTT | 4530 |
| 1878 | CUUCCCAC CUGAUGAG GCCGUUAGGC CGAA IUCCCAAC | 11594 | GTTGGGAC T GTGGGAAG | 4531 |
| 1891 | AAAGCUUA CUGAUGAG GCCGUUAGGC CGAA IUUUCUUC | 11595 | GAAGAAAC A TAAGCTTT | 4532 |
| 1897 | GAUAUAAA CUGAUGAG GCCGUUAGGC CGAA ICUUAUGU | 11596 | ACATAAGC T TTTATATC | 4533 |
| 1906 | CACAUCUG CUGAUGAG GCCGUUAGGC CGAA IAUAUAAA | 11597 | TTTATATC A CAGATGTG | 4534 |
| 1908 | GGCACAUC CUGAUGAG GCCGUUAGGC CGAA IUGAUAUA | 11598 | TATATCAC A GATGTGCC | 4535 |
| 1916 | ACCCAUUU CUGAUGAG GCCGUUAGGC CGAA ICACAUCU | 11599 | AGATGTGC C AAATGGGT | 4536 |
| 1917 | AACCCAUU CUGAUGAG GCCGUUAGGC CGAA IGCACAUC | 11600 | GATGTGCC A AATGGGTT | 4537 |
| 1928 | AGUUAACA CUGAUGAG GCCGUUAGGC CGAA IAAACCCA | 11601 | TGGGTTTC A TGTTAACT | 4538 |
| 1936 | UUUUUCCA CUGAUGAG GCCGUUAGGC CGAA IUUAACAU | 11602 | ATGTTAAC T TGGAAAAA | 4539 |
| 1949 | CUUCCGUC CUGAUGAG GCCGUUAGGC CGAA ICAUUUUU | 11603 | AAAAATGC C GACGGAAG | 4540 |
| 1966 | CAGUUUCA CUGAUGAG GCCGUUAGGC CGAA IUCCUCUC | 11604 | GAGAGGAC C TGAAACTG | 4541 |
| 1967 | ACAGUUUC CUGAUGAG GCCGUUAGGC CGAA IGUCCUCU | 11605 | AGAGGACC T GAAACTGT | 4542 |
| 1973 | UGCAAGAC CUGAUGAG GCCGUUAGGC CGAA IUUUCAGG | 11606 | CCTGAAAC T GTCTTGCA | 4543 |
| 1977 | ACUGUGCA CUGAUGAG GCCGUUAGGC CGAA IACAGUUU | 11607 | AAACTGTC T TGCACAGT | 4544 |
| 1981 | GUUAACUG CUGAUGAG GCCGUUAGGC CGAA ICAAGACA | 11608 | TGTCTTGC A CAGTTAAC | 4545 |

| | | | | |
|---|---|---|---|---|
| 1983 | UUGUUAAC CUGAUGAG GCCGUUAGGC CGAA IUGCAAGA | 11609 | TCTTGCAC A GTTAACAA | 4546 |
| 1990 | UAAGAACU CUGAUGAG GCCGUUAGGC CGAA IUUAACUG | 11610 | CAGTTAAC A AGTTCTTA | 4547 |
| 1996 | UCUGUAUA CUGAUGAG GCCGUUAGGC CGAA IAACUUGU | 11611 | ACAAGTTC T TATACAGA | 4548 |
| 2002 | AACGUCUC CUGAUGAG GCCGUUAGGC CGAA IUAUAAGA | 11612 | TCTTATAC A GAGACGTT | 4549 |
| 2013 | AAAAUCCA CUGAUGAG GCCGUUAGGC CGAA IUAACGUC | 11613 | GACGTTAC T TGGATTTT | 4550 |
| 2024 | CUGUCCGC CUGAUGAG GCCGUUAGGC CGAA IUAAAAUC | 11614 | GATTTTAC T GCGGACAG | 4551 |
| 2031 | UUAUUAAC CUGAUGAG GCCGUUAGGC CGAA IUCCGCAG | 11615 | CTGCGGAC A GTTAATAA | 4552 |
| 2041 | CAUUGUUC CUGAUGAG GCCGUUAGGC CGAA IUUAUUAA | 11616 | TTAATAAC A GAACAATG | 4553 |
| 2046 | UAGUGCAU CUGAUGAG GCCGUUAGGC CGAA IUUCUGUU | 11617 | AACAGAAC A ATGCACTA | 4554 |
| 2051 | UACUGUAG CUGAUGAG GCCGUUAGGC CGAA ICAUUGUU | 11618 | AACAATGC A CTACAGTA | 4555 |
| 2053 | AAUACUGU CUGAUGAG GCCGUUAGGC CGAA IUGCAUUG | 11619 | CAATGCAC T ACAGTATT | 4556 |
| 2056 | GCUAAUAC CUGAUGAG GCCGUUAGGC CGAA IUAGUGCA | 11620 | TGCACTAC A GTATTAGC | 4557 |
| 2065 | UUUUUGCU CUGAUGAG GCCGUUAGGC CGAA ICUAAUAC | 11621 | GTATTAGC A AGCAAAAA | 4558 |
| 2069 | CCAUUUUU CUGAUGAG GCCGUUAGGC CGAA ICUUGCUA | 11622 | TAGCAAGC A AAAAATGG | 4559 |
| 2079 | UUAGUGAU CUGAUGAG GCCGUUAGGC CGAA ICCAUUUU | 11623 | AAAATGGC C ATCACTAA | 4560 |
| 2080 | CUUAGUGA CUGAUGAG GCCGUUAGGC CGAA IGCCAUUU | 11624 | AAATGGCC A TCACTAAG | 4561 |
| 2083 | CUCCUUAG CUGAUGAG GCCGUUAGGC CGAA IAUGGCCA | 11625 | TGGCCATC A CTAAGGAG | 4562 |
| 2085 | UGCUCCUU CUGAUGAG GCCGUUAGGC CGAA IUGAUGGC | 11626 | GCCATCAC T AAGGAGCA | 4563 |
| 2093 | UGAUGGAG CUGAUGAG GCCGUUAGGC CGAA ICUCCUUA | 11627 | TAAGGAGC A CTCCATCA | 4564 |
| 2095 | AGUGAUGG CUGAUGAG GCCGUUAGGC CGAA IUGCUCCU | 11628 | AGGAGCAC T CCATCACT | 4565 |
| 2097 | AGAGUGAU CUGAUGAG GCCGUUAGGC CGAA IAGUGCUC | 11629 | GAGCACTC C ATCACTCT | 4566 |
| 2098 | AAGAGUGA CUGAUGAG GCCGUUAGGC CGAA IGAGUGCU | 11630 | AGCACTCC A TCACTCTT | 4567 |
| 2101 | AUUAAGAG CUGAUGAG GCCGUUAGGC CGAA IAUGGAGU | 11631 | ACTCCATC A CTCTTAAT | 4568 |
| 2103 | AGAUUAAG CUGAUGAG GCCGUUAGGC CGAA IUGAUGGA | 11632 | TCCATCAC T CTTAATCT | 4569 |
| 2105 | UAAGAUUA CUGAUGAG GCCGUUAGGC CGAA IAGUGAUG | 11633 | CATCACTC T TAATCTTA | 4570 |
| 2111 | UGAUGGUA CUGAUGAG GCCGUUAGGC CGAA IAUUAAGA | 11634 | TCTTAATC T TACCATCA | 4571 |
| 2115 | UUCAUGAU CUGAUGAG GCCGUUAGGC CGAA IUAAGAUU | 11635 | AATCTTAC C ATCATGAA | 4572 |
| 2116 | AUUCAUGA CUGAUGAG GCCGUUAGGC CGAA IGUAAGAU | 11636 | ATCTTACC A TCATGAAT | 4573 |
| 2119 | AACAUUCA CUGAUGAG GCCGUUAGGC CGAA IAUGGUAA | 11637 | TTACCATC A TGAATGTT | 4574 |
| 2130 | UCUUGCAG CUGAUGAG GCCGUUAGGC CGAA IAAACAUU | 11638 | AATGTTTC C CTGCAAGA | 4575 |
| 2131 | AUCUUGCA CUGAUGAG GCCGUUAGGC CGAA IGAAACAU | 11639 | ATGTTTCC C TGCAAGAT | 4576 |
| 2132 | AAUCUUGC CUGAUGAG GCCGUUAGGC CGAA IGGAAACA | 11640 | TGTTTCCC T GCAAGATT | 4577 |
| 2135 | CUGAAUCU CUGAUGAG GCCGUUAGGC CGAA ICAGGGAA | 11641 | TTCCCTGC A AGATTCAG | 4578 |

| | | | | |
|---|---|---|---|---|
| 2142 | UAGGUGCC CUGAUGAG GCCGUUAGGC CGAA IAAUCUUG | 11642 | CAAGATTC A GGCACCTA | 4579 |
| 2146 | GGCAUAGG CUGAUGAG GCCGUUAGGC CGAA ICCUGAAU | 11643 | ATTCAGGC A CCTATGCC | 4580 |
| 2148 | CAGGCAUA CUGAUGAG GCCGUUAGGC CGAA IUGCCUGA | 11644 | TCAGGCAC C TATGCCTG | 4581 |
| 2149 | GCAGGCAU CUGAUGAG GCCGUUAGGC CGAA IGUGCCUG | 11645 | CAGGCACC T ATGCCTGC | 4582 |
| 2154 | GCUCUGCA CUGAUGAG GCCGUUAGGC CGAA ICAUAGGU | 11646 | ACCTATGC C TGCAGAGC | 4583 |
| 2155 | GGCUCUGC CUGAUGAG GCCGUUAGGC CGAA IGCAUAGG | 11647 | CCTATGCC T GCAGAGCC | 4584 |
| 2158 | CCUGGCUC CUGAUGAG GCCGUUAGGC CGAA ICAGGCAU | 11648 | ATGCCTGC A GAGCCAGG | 4585 |
| 2163 | ACAUUCCU CUGAUGAG GCCGUUAGGC CGAA ICUCUGCA | 11649 | TGCAGAGC C AGGAATGT | 4586 |
| 2164 | UACAUUCC CUGAUGAG GCCGUUAGGC CGAA IGCUCUGC | 11650 | GCAGAGCC A GGAATGTA | 4587 |
| 2176 | UUCCCCUG CUGAUGAG GCCGUUAGGC CGAA IUAUACAU | 11651 | ATGTATAC A CAGGGGAA | 4588 |
| 2178 | UCUUCCCC CUGAUGAG GCCGUUAGGC CGAA IUGUAUAC | 11652 | GTATACAC A GGGGAAGA | 4589 |
| 2191 | CUUCUGGA CUGAUGAG GCCGUUAGGC CGAA IAUUUCUU | 11653 | AAGAAATC C TCCAGAAG | 4590 |
| 2192 | UCUUCUGG CUGAUGAG GCCGUUAGGC CGAA IGAUUUCU | 11654 | AGAAATCC T CCAGAAGA | 4591 |
| 2194 | UUUCUUCU CUGAUGAG GCCGUUAGGC CGAA IAGGAUUU | 11655 | AAATCCTC C AGAAGAAA | 4592 |
| 2195 | CUUUCUUC CUGAUGAG GCCGUUAGGC CGAA IGAGGAUU | 11656 | AATCCTCC A GAAGAAAG | 4593 |
| 2211 | UCUCUGAU CUGAUGAG GCCGUUAGGC CGAA IUAAUUUC | 11657 | GAAATTAC A ATCAGAGA | 4594 |
| 2215 | CUGAUCUC CUGAUGAG GCCGUUAGGC CGAA IAUUGUAA | 11658 | TTACAATC A GAGATCAG | 4595 |
| 2222 | GUGCUUCC CUGAUGAG GCCGUUAGGC CGAA IAUCUCUG | 11659 | CAGAGATC A GGAAGCAC | 4596 |
| 2229 | AGGUAUGG CUGAUGAG GCCGUUAGGC CGAA ICUUCCUG | 11660 | CAGGAAGC A CCATACCT | 4597 |
| 2231 | GGAGGUAU CUGAUGAG GCCGUUAGGC CGAA IUGCUUCC | 11661 | GGAAGCAC C ATACCTCC | 4598 |
| 2232 | AGGAGGUA CUGAUGAG GCCGUUAGGC CGAA IGUGCUUC | 11662 | GAAGCACC A TACCTCCT | 4599 |
| 2236 | UCGCAGGA CUGAUGAG GCCGUUAGGC CGAA IUAUGGUG | 11663 | CACCATAC C TCCTGCGA | 4600 |
| 2237 | UUCGCAGG CUGAUGAG GCCGUUAGGC CGAA IGUAUGGU | 11664 | ACCATACC T CCTGCGAA | 4601 |
| 2239 | GUUUCGCA CUGAUGAG GCCGUUAGGC CGAA IAGGUAUG | 11665 | CATACCTC C TGCGAAAC | 4602 |
| 2240 | GGUUUCGC CUGAUGAG GCCGUUAGGC CGAA IGAGGUAU | 11666 | ATACCTCC T GCGAAACC | 4603 |
| 2248 | AUCACUGA CUGAUGAG GCCGUUAGGC CGAA IUUUCGCA | 11667 | TGCGAAAC C TCAGTGAT | 4604 |
| 2249 | GAUCACUG CUGAUGAG GCCGUUAGGC CGAA IGUUUCGC | 11668 | GCGAAACC T CAGTGATC | 4605 |
| 2251 | GUGAUCAC CUGAUGAG GCCGUUAGGC CGAA IAGGUUUC | 11669 | GAAACCTC A GTGATCAC | 4606 |
| 2258 | CCACUGUG CUGAUGAG GCCGUUAGGC CGAA IAUCACUG | 11670 | CAGTGATC A CACAGTGG | 4607 |
| 2260 | GGCCACUG CUGAUGAG GCCGUUAGGC CGAA IUGAUCAC | 11671 | GTGATCAC A CAGTGGCC | 4608 |
| 2262 | AUGGCCAC CUGAUGAG GCCGUUAGGC CGAA IUGUGAUC | 11672 | GATCACAC A GTGGCCAT | 4609 |
| 2268 | CUGCUGAU CUGAUGAG GCCGUUAGGC CGAA ICCACUGU | 11673 | ACAGTGGC C ATCAGCAG | 4610 |
| 2269 | ACUGCUGA CUGAUGAG GCCGUUAGGC CGAA IGCCACUG | 11674 | CAGTGGCC A TCAGCAGT | 4611 |

| | | | | |
|---|---|---|---|---|
| 2272 | GGAACUGC CUGAUGAG GCCGUUAGGC CGAA IAUGGCCA | 11675 | TGGCCATC A GCAGTTCC | 4612 |
| 2275 | GGUGGAAC CUGAUGAG GCCGUUAGGC CGAA ICUGAUGG | 11676 | CCATCAGC A GTTCCACC | 4613 |
| 2280 | AAAGUGGU CUGAUGAG GCCGUUAGGC CGAA IAACUGCU | 11677 | AGCAGTTC C ACCACTTT | 4614 |
| 2281 | UAAAGUGG CUGAUGAG GCCGUUAGGC CGAA IGAACUGC | 11678 | GCAGTTCC A CCACTTTA | 4615 |
| 2283 | UCUAAAGU CUGAUGAG GCCGUUAGGC CGAA IUGGAACU | 11679 | AGTTCCAC C ACTTTAGA | 4616 |
| 2284 | GUCUAAAG CUGAUGAG GCCGUUAGGC CGAA IGUGGAAC | 11680 | GTTCCACC A CTTTAGAC | 4617 |
| 2286 | CAGUCUAA CUGAUGAG GCCGUUAGGC CGAA IUGGUGGA | 11681 | TCCACCAC T TTAGACTG | 4618 |
| 2293 | AGCAUGAC CUGAUGAG GCCGUUAGGC CGAA IUCUAAAG | 11682 | CTTTAGAC T GTCATGCT | 4619 |
| 2297 | CAUUAGCA CUGAUGAG GCCGUUAGGC CGAA IACAGUCU | 11683 | AGACTGTC A TGCTAATG | 4620 |
| 2301 | ACACCAUU CUGAUGAG GCCGUUAGGC CGAA ICAUGACA | 11684 | TGTCATGC T AATGGTGT | 4621 |
| 2311 | AGGCUCGG CUGAUGAG GCCGUUAGGC CGAA IACACCAU | 11685 | ATGGTGTC C CCGAGCCT | 4622 |
| 2312 | GAGGCUCG CUGAUGAG GCCGUUAGGC CGAA IGACACCA | 11686 | TGGTGTCC C CGAGCCTC | 4623 |
| 2313 | UGAGGCUC CUGAUGAG GCCGUUAGGC CGAA IGGACACC | 11687 | GGTGTCCC C GAGCCTCA | 4624 |
| 2318 | UGAUCUGA CUGAUGAG GCCGUUAGGC CGAA ICUCGGGG | 11688 | CCCCGAGC C TCAGATCA | 4625 |
| 2319 | GUGAUCUG CUGAUGAG GCCGUUAGGC CGAA IGCUCGGG | 11689 | CCCGAGCC T CAGATCAC | 4626 |
| 2321 | AAGUGAUC CUGAUGAG GCCGUUAGGC CGAA IAGGCUCG | 11690 | CGAGCCTC A GATCACTT | 4627 |
| 2326 | AAACCAAG CUGAUGAG GCCGUUAGGC CGAA IAUCUGAG | 11691 | CTCAGATC A CTTGGTTT | 4628 |
| 2328 | UUAAACCA CUGAUGAG GCCGUUAGGC CGAA IUGAUCUG | 11692 | CAGATCAC T TGGTTTAA | 4629 |
| 2341 | UUUGUGGU CUGAUGAG GCCGUUAGGC CGAA IUUUUUAA | 11693 | TTAAAAAC A ACCACAAA | 4630 |
| 2344 | UAUUUUGU CUGAUGAG GCCGUUAGGC CGAA IUUGUUUU | 11694 | AAAACAAC C ACAAAATA | 4631 |
| 2345 | GUAUUUUG CUGAUGAG GCCGUUAGGC CGAA IGUUGUUU | 11695 | AAACAACC A CAAAATAC | 4632 |
| 2347 | UUGUAUUU CUGAUGAG GCCGUUAGGC CGAA IUGGUUGU | 11696 | ACAACCAC A AAATACAA | 4633 |
| 2354 | GCUCUUGU CUGAUGAG GCCGUUAGGC CGAA IUAUUUUG | 11697 | CAAAATAC A ACAAGAGC | 4634 |
| 2357 | CAGGCUCU CUGAUGAG GCCGUUAGGC CGAA IUUGUAUU | 11698 | AATACAAC A AGAGCCTG | 4635 |
| 2363 | UAAUUCCA CUGAUGAG GCCGUUAGGC CGAA ICUCUUGU | 11699 | ACAAGAGC C TGGAATTA | 4636 |
| 2364 | AUAAUUCC CUGAUGAG GCCGUUAGGC CGAA IGCUCUUG | 11700 | CAAGAGCC T GGAATTAT | 4637 |
| 2381 | UGCUUCCU CUGAUGAG GCCGUUAGGC CGAA IUCCUAAA | 11701 | TTTAGGAC C AGGAAGCA | 4638 |
| 2382 | CUGCUUCC CUGAUGAG GCCGUUAGGC CGAA IGUCCUAA | 11702 | TTAGGACC A GGAAGCAG | 4639 |
| 2389 | CAGCGUGC CUGAUGAG GCCGUUAGGC CGAA ICUUCCUG | 11703 | CAGGAAGC A GCACGCTG | 4640 |
| 2392 | AAACAGCG CUGAUGAG GCCGUUAGGC CGAA ICUGCUUC | 11704 | GAAGCAGC A CGCTGTTT | 4641 |
| 2396 | CAAUAAAC CUGAUGAG GCCGUUAGGC CGAA ICGUGCUG | 11705 | CAGCACGC T GTTTATTG | 4642 |
| 2413 | CUCUUCUG CUGAUGAG GCCGUUAGGC CGAA IACUCUUU | 11706 | AAAGAGTC A CAGAAGAG | 4643 |
| 2415 | UCCUCUUC CUGAUGAG GCCGUUAGGC CGAA IUGACUCU | 11707 | AGAGTCAC A GAAGAGGA | 4644 |

| | | | | |
|---|---|---|---|---|
| 2434 | GCAGUGAU CUGAUGAG GCCGUUAGGC CGAA IACACCUU | 11708 | AAGGTGTC T ATCACTGC | 4645 |
| 2438 | CUUUGCAG CUGAUGAG GCCGUUAGGC CGAA IAUAGACA | 11709 | TGTCTATC A CTGCAAAG | 4646 |
| 2440 | GGCUUUGC CUGAUGAG GCCGUUAGGC CGAA IUGAUAGA | 11710 | TCTATCAC T GCAAAGCC | 4647 |
| 2443 | GGUGGCUU CUGAUGAG GCCGUUAGGC CGAA ICAGUGAU | 11711 | ATCACTGC A AAGCCACC | 4648 |
| 2448 | UGGUUGGU CUGAUGAG GCCGUUAGGC CGAA ICUUUGCA | 11712 | TGCAAAGC C ACCAACCA | 4649 |
| 2449 | CUGGUUGG CUGAUGAG GCCGUUAGGC CGAA IGCUUUGC | 11713 | GCAAAGCC A CCAACCAG | 4650 |
| 2451 | UUCUGGUU CUGAUGAG GCCGUUAGGC CGAA IUGGCUUU | 11714 | AAAGCCAC C AACCAGAA | 4651 |
| 2452 | CUUCUGGU CUGAUGAG GCCGUUAGGC CGAA IGUGGCUU | 11715 | AAGCCACC A ACCAGAAG | 4652 |
| 2455 | GCCCUUCU CUGAUGAG GCCGUUAGGC CGAA IUUGGUGG | 11716 | CCACCAAC C AGAAGGGC | 4653 |
| 2456 | AGCCCUUC CUGAUGAG GCCGUUAGGC CGAA IGUUGGUG | 11717 | CACCAACC A GAAGGGCT | 4654 |
| 2464 | UUCCACAG CUGAUGAG GCCGUUAGGC CGAA ICCCUUCU | 11718 | AGAAGGGC T CTGTGGAA | 4655 |
| 2466 | CUUUCCAC CUGAUGAG GCCGUUAGGC CGAA IAGCCCUU | 11719 | AAGGGCTC T GTGGAAAG | 4656 |
| 2478 | AGGUAUGC CUGAUGAG GCCGUUAGGC CGAA IAACUUUC | 11720 | GAAAGTTC A GCATACCT | 4657 |
| 2481 | GUGAGGUA CUGAUGAG GCCGUUAGGC CGAA ICUGAACU | 11721 | AGTTCAGC A TACCTCAC | 4658 |
| 2485 | AACAGUGA CUGAUGAG GCCGUUAGGC CGAA IUAUGCUG | 11722 | CAGCATAC C TCACTGTT | 4659 |
| 2486 | GAACAGUG CUGAUGAG GCCGUUAGGC CGAA IGUAUGCU | 11723 | AGCATACC T CACTGTTC | 4660 |
| 2488 | UUGAACAG CUGAUGAG GCCGUUAGGC CGAA IAGGUAUG | 11724 | CATACCTC A CTGTTCAA | 4661 |
| 2490 | CCUUGAAC CUGAUGAG GCCGUUAGGC CGAA IUGAGGUA | 11725 | TACCTCAC T GTTCAAGG | 4662 |
| 2495 | AGGUUCCU CUGAUGAG GCCGUUAGGC CGAA IAACAGUG | 11726 | CACTGTTC A AGGAACCT | 4663 |
| 2502 | UUGUCCGA CUGAUGAG GCCGUUAGGC CGAA IUUCCUUG | 11727 | CAAGGAAC C TCGGACAA | 4664 |
| 2503 | CUUGUCCG CUGAUGAG GCCGUUAGGC CGAA IGUUCCUU | 11728 | AAGGAACC T CGGACAAG | 4665 |
| 2509 | AUUAGACU CUGAUGAG GCCGUUAGGC CGAA IUCCGAGG | 11729 | CCTCGGAC A AGTCTAAT | 4666 |
| 2514 | UCCAGAUU CUGAUGAG GCCGUUAGGC CGAA IACUUGUC | 11730 | GACAAGTC T AATCTGGA | 4667 |
| 2519 | UCAGCUCC CUGAUGAG GCCGUUAGGC CGAA IAUUAGAC | 11731 | GTCTAATC T GGAGCTGA | 4668 |
| 2525 | GAGUGAUC CUGAUGAG GCCGUUAGGC CGAA ICUCCAGA | 11732 | TCTGGAGC T GATCACTC | 4669 |
| 2530 | UGUUAGAG CUGAUGAG GCCGUUAGGC CGAA IAUCAGCU | 11733 | AGCTGATC A CTCTAACA | 4670 |
| 2532 | CAUGUUAG CUGAUGAG GCCGUUAGGC CGAA IUGAUCAG | 11734 | CTGATCAC T CTAACATG | 4671 |
| 2534 | UGCAUGUU CUGAUGAG GCCGUUAGGC CGAA IAGUGAUC | 11735 | GATCACTC T AACATGCA | 4672 |
| 2538 | CAGGUGCA CUGAUGAG GCCGUUAGGC CGAA IUUAGAGU | 11736 | ACTCTAAC A TGCACCTG | 4673 |
| 2542 | CACACAGG CUGAUGAG GCCGUUAGGC CGAA ICAUGUUA | 11737 | TAACATGC A CCTGTGTG | 4674 |
| 2544 | GCCACACA CUGAUGAG GCCGUUAGGC CGAA IUGCAUGU | 11738 | ACATGCAC C TGTGTGGC | 4675 |
| 2545 | AGCCACAC CUGAUGAG GCCGUUAGGC CGAA IGUGCAUG | 11739 | CATGCACC T GTGTGGCT | 4676 |
| 2553 | AGAGUCGC CUGAUGAG GCCGUUAGGC CGAA ICCACACA | 11740 | TGTGTGGC T GCGACTCT | 4677 |

| | | | | |
|---|---|---|---|---|
| 2559 | CAGAAGAG CUGAUGAG GCCGUUAGGC CGAA IUCGCAGC | 11741 | GCTGCGAC T CTCTTCTG | 4678 |
| 2561 | GCCAGAAG CUGAUGAG GCCGUUAGGC CGAA IAGUCGCA | 11742 | TGCGACTC T CTTCTGGC | 4679 |
| 2563 | GAGCCAGA CUGAUGAG GCCGUUAGGC CGAA IAGAGUCG | 11743 | CGACTCTC T TCTGGCTC | 4680 |
| 2566 | UAGGAGCC CUGAUGAG GCCGUUAGGC CGAA IAAGAGAG | 11744 | CTCTCTTC T GGCTCCTA | 4681 |
| 2570 | UUAAUAGG CUGAUGAG GCCGUUAGGC CGAA ICCAGAAG | 11745 | CTTCTGGC T CCTATTAA | 4682 |
| 2572 | GGUUAAUA CUGAUGAG GCCGUUAGGC CGAA IAGCCAGA | 11746 | TCTGGCTC C TATTAACC | 4683 |
| 2573 | GGGUUAAU CUGAUGAG GCCGUUAGGC CGAA IGAGCCAG | 11747 | CTGGCTCC T ATTAACCC | 4684 |
| 2580 | AUAAGGAG CUGAUGAG GCCGUUAGGC CGAA IUUAAUAG | 11748 | CTATTAAC C CTCCTTAT | 4685 |
| 2581 | GAUAAGGA CUGAUGAG GCCGUUAGGC CGAA IGUUAAUA | 11749 | TATTAACC C TCCTTATC | 4686 |
| 2582 | GGAUAAGG CUGAUGAG GCCGUUAGGC CGAA IGGUUAAU | 11750 | ATTAACCC T CCTTATCC | 4687 |
| 2584 | UCGGAUAA CUGAUGAG GCCGUUAGGC CGAA IAGGGUUA | 11751 | TAACCCTC C TTATCCGA | 4688 |
| 2585 | UUCGGAUA CUGAUGAG GCCGUUAGGC CGAA IGAGGGUU | 11752 | AACCCTCC T TATCCGAA | 4689 |
| 2590 | CAUUUUUC CUGAUGAG GCCGUUAGGC CGAA IAUAAGGA | 11753 | TCCTTATC C GAAAAATG | 4690 |
| 2607 | UCAGAAGA CUGAUGAG GCCGUUAGGC CGAA IACCUUUU | 11754 | AAAAGGTC T TCTTCTGA | 4691 |
| 2610 | AUUUCAGA CUGAUGAG GCCGUUAGGC CGAA IAAGACCU | 11755 | AGGTCTTC T TCTGAAAT | 4692 |
| 2613 | UUUAUUUC CUGAUGAG GCCGUUAGGC CGAA IAAGAAGA | 11756 | TCTTCTTC T GAAATAAA | 4693 |
| 2625 | AGGUAGUC CUGAUGAG GCCGUUAGGC CGAA IUCUUUAU | 11757 | ATAAAGAC T GACTACCT | 4694 |
| 2629 | UGAUAGGU CUGAUGAG GCCGUUAGGC CGAA IUCAGUCU | 11758 | AGACTGAC T ACCTATCA | 4695 |
| 2632 | AAUUGAUA CUGAUGAG GCCGUUAGGC CGAA IUAGUCAG | 11759 | CTGACTAC C TATCAATT | 4696 |
| 2633 | UAAUUGAU CUGAUGAG GCCGUUAGGC CGAA IGUAGUCA | 11760 | TGACTACC T ATCAATTA | 4697 |
| 2637 | AUUAUAAU CUGAUGAG GCCGUUAGGC CGAA IAUAGGUA | 11761 | TACCTATC A ATTATAAT | 4698 |
| 2650 | UUCAUCUG CUGAUGAG GCCGUUAGGC CGAA IUCCAUUA | 11762 | TAATGGAC C CAGATGAA | 4699 |
| 2651 | CUUCAUCU CUGAUGAG GCCGUUAGGC CGAA IGUCCAUU | 11763 | AATGGACC C AGATGAAG | 4700 |
| 2652 | ACUUCAUC CUGAUGAG GCCGUUAGGC CGAA IGGUCCAU | 11764 | ATGGACCC A GATGAAGT | 4701 |
| 2663 | CAUCCAAA CUGAUGAG GCCGUUAGGC CGAA IAACUUCA | 11765 | TGAAGTTC C TTTGGATG | 4702 |
| 2664 | UCAUCCAA CUGAUGAG GCCGUUAGGC CGAA IGAACUUC | 11766 | GAAGTTCC T TTGGATGA | 4703 |
| 2675 | GCUCACAC CUGAUGAG GCCGUUAGGC CGAA ICUCAUCC | 11767 | GGATGAGC A GTGTGAGC | 4704 |
| 2687 | CAUAAGGG CUGAUGAG GCCGUUAGGC CGAA ICCGCUCA | 11768 | TGAGCGGC T CCCTTATG | 4705 |
| 2689 | AUCAUAAG CUGAUGAG GCCGUUAGGC CGAA IAGCCGCU | 11769 | AGCGGCTC C CTTATGAT | 4706 |
| 2690 | CAUCAUAA CUGAUGAG GCCGUUAGGC CGAA IGAGCCGC | 11770 | GCGGCTCC C TTATGATG | 4707 |
| 2691 | GCAUCAUA CUGAUGAG GCCGUUAGGC CGAA IGGAGCCG | 11771 | CGGCTCCC T TATGATGC | 4708 |
| 2700 | CACUUGCU CUGAUGAG GCCGUUAGGC CGAA ICAUCAUA | 11772 | TATGATGC C AGCAAGTG | 4709 |
| 2701 | CCACUUGC CUGAUGAG GCCGUUAGGC CGAA IGCAUCAU | 11773 | ATGATGCC A GCAAGTGG | 4710 |

220

| | | | | | |
|---|---|---|---|---|---|
| 2704 | CUCCCACU CUGAUGAG GCCGUUAGGC CGAA ICUGGCAU | 11774 | ATGCCAGC A AGTGGGAG | 4711 |
| 2718 | CUCUCCCG CUGAUGAG GCCGUUAGGC CGAA ICAAACUC | 11775 | GAGTTTGC C CGGGAGAG | 4712 |
| 2719 | UCUCUCCC CUGAUGAG GCCGUUAGGC CGAA IGCAAACU | 11776 | AGTTTGCC C GGGAGAGA | 4713 |
| 2729 | CCAGUUUA CUGAUGAG GCCGUUAGGC CGAA IUCUCUCC | 11777 | GGAGAGAC T TAAACTGG | 4714 |
| 2735 | AUUUGCCC CUGAUGAG GCCGUUAGGC CGAA IUUUAAGU | 11778 | ACTTAAAC T GGGCAAAT | 4715 |
| 2740 | AAGUGAUU CUGAUGAG GCCGUUAGGC CGAA ICCCAGUU | 11779 | AACTGGGC A AATCACTT | 4716 |
| 2745 | CUUCCAAG CUGAUGAG GCCGUUAGGC CGAA IAUUUGCC | 11780 | GGCAAATC A CTTGGAAG | 4717 |
| 2747 | CUCUUCCA CUGAUGAG GCCGUUAGGC CGAA IUGAUUUG | 11781 | CAAATCAC T TGGAAGAG | 4718 |
| 2760 | UUUCCAAA CUGAUGAG GCCGUUAGGC CGAA ICCCCUCU | 11782 | AGAGGGGC T TTTGGAAA | 4719 |
| 2777 | CUGAUGCU CUGAUGAG GCCGUUAGGC CGAA IAACCACU | 11783 | AGTGGTTC A AGCATCAG | 4720 |
| 2781 | AAUGCUGA CUGAUGAG GCCGUUAGGC CGAA ICUUGAAC | 11784 | GTTCAAGC A TCAGCATT | 4721 |
| 2784 | CCAAAUGC CUGAUGAG GCCGUUAGGC CGAA IAUGCUUG | 11785 | CAAGCATC A GCATTTGG | 4722 |
| 2787 | AUGCCAAA CUGAUGAG GCCGUUAGGC CGAA ICUGAUGC | 11786 | GCATCAGC A TTTGGCAT | 4723 |
| 2794 | UUUCUUAA CUGAUGAG GCCGUUAGGC CGAA ICCAAAUG | 11787 | CATTTGGC A TTAAGAAA | 4724 |
| 2805 | CACGUAGG CUGAUGAG GCCGUUAGGC CGAA IAUUUCUU | 11788 | AAGAAATC A CCTACGTG | 4725 |
| 2807 | GGCACGUA CUGAUGAG GCCGUUAGGC CGAA IUGAUUUC | 11789 | GAAATCAC C TACGTGCC | 4726 |
| 2808 | CGGCACGU CUGAUGAG GCCGUUAGGC CGAA IGUGAUUU | 11790 | AAATCACC T ACGTGCCG | 4727 |
| 2815 | CACAGUCC CUGAUGAG GCCGUUAGGC CGAA ICACGUAG | 11791 | CTACGTGC C GGACTGTG | 4728 |
| 2820 | ACAGCCAC CUGAUGAG GCCGUUAGGC CGAA IUCCGGCA | 11792 | TGCCGGAC T GTGGCTGT | 4729 |
| 2826 | AUUUUCAC CUGAUGAG GCCGUUAGGC CGAA ICCACAGU | 11793 | ACTGTGGC T GTGAAAAT | 4730 |
| 2837 | CCUCUUUC CUGAUGAG GCCGUUAGGC CGAA ICAUUUUC | 11794 | GAAAATGC T GAAAGAGG | 4731 |
| 2850 | CUGGCCGU CUGAUGAG GCCGUUAGGC CGAA ICCCCCUC | 11795 | GAGGGGGC C ACGGCCAG | 4732 |
| 2851 | GCUGGCCG CUGAUGAG GCCGUUAGGC CGAA IGCCCCCU | 11796 | AGGGGGCC A CGGCCAGC | 4733 |
| 2856 | UACUCGCU CUGAUGAG GCCGUUAGGC CGAA ICCGUGGC | 11797 | GCCACGGC C AGCGAGTA | 4734 |
| 2857 | GUACUCGC CUGAUGAG GCCGUUAGGC CGAA IGCCGUGG | 11798 | CCACGGCC A GCGAGTAC | 4735 |
| 2866 | CAGAGCUU CUGAUGAG GCCGUUAGGC CGAA IUACUCGC | 11799 | GCGAGTAC A AAGCTCTG | 4736 |
| 2871 | GUCAUCAG CUGAUGAG GCCGUUAGGC CGAA ICUUUGUA | 11800 | TACAAAGC T CTGATGAC | 4737 |
| 2873 | CAGUCAUC CUGAUGAG GCCGUUAGGC CGAA IAGCUUUG | 11801 | CAAAGCTC T GATGACTG | 4738 |
| 2880 | UUUAGCUC CUGAUGAG GCCGUUAGGC CGAA IUCAUCAG | 11802 | CTGATGAC T GAGCTAAA | 4739 |
| 2885 | AGAUUUUU CUGAUGAG GCCGUUAGGC CGAA ICUCAGUC | 11803 | GACTGAGC T AAAAATCT | 4740 |
| 2893 | GUGGGUCA CUGAUGAG GCCGUUAGGC CGAA IAUUUUUA | 11804 | TAAAAATC T TGACCCAC | 4741 |
| 2898 | CCAAUGUG CUGAUGAG GCCGUUAGGC CGAA IUCAAGAU | 11805 | ATCTTGAC C CACATTGG | 4742 |
| 2899 | GCCAAUGU CUGAUGAG GCCGUUAGGC CGAA IGUCAAGA | 11806 | TCTTGACC C ACATTGGC | 4743 |

221

| | | | | |
|---|---|---|---|---|
| 2900 | GGCCAAUG CUGAUGAG GCCGUUAGGC CGAA IGGUCAAG | 11807 | CTTGACCC A CATTGGCC | 4744 |
| 2902 | GUGGCCAA CUGAUGAG GCCGUUAGGC CGAA IUGGGUCA | 11808 | TGACCCAC A TTGGCCAC | 4745 |
| 2908 | CAGAUGGU CUGAUGAG GCCGUUAGGC CGAA ICCAAUGU | 11809 | ACATTGGC C ACCATCTG | 4746 |
| 2909 | UCAGAUGG CUGAUGAG GCCGUUAGGC CGAA IGCCAAUG | 11810 | CATTGGCC A CCATCTGA | 4747 |
| 2911 | GUUCAGAU CUGAUGAG GCCGUUAGGC CGAA IUGGCCAA | 11811 | TTGGCCAC C ATCTGAAC | 4748 |
| 2912 | CGUUCAGA CUGAUGAG GCCGUUAGGC CGAA IGUGGCCA | 11812 | TGGCCACC A TCTGAACG | 4749 |
| 2915 | CCACGUUC CUGAUGAG GCCGUUAGGC CGAA IAUGGUGG | 11813 | CCACCATC T GAACGTGG | 4750 |
| 2929 | UCCCAGCA CUGAUGAG GCCGUUAGGC CGAA IUUAACCA | 11814 | TGGTTAAC C TGCTGGGA | 4751 |
| 2930 | CUCCCAGC CUGAUGAG GCCGUUAGGC CGAA IGUUAACC | 11815 | GGTTAACC T GCTGGGAG | 4752 |
| 2933 | AGGCUCCC CUGAUGAG GCCGUUAGGC CGAA ICAGGUUA | 11816 | TAACCTGC T GGGAGCCT | 4753 |
| 2940 | UUGGUGCA CUGAUGAG GCCGUUAGGC CGAA ICUCCCAG | 11817 | CTGGGAGC C TGCACCAA | 4754 |
| 2941 | CUUGGUGC CUGAUGAG GCCGUUAGGC CGAA IGCUCCCA | 11818 | TGGGAGCC T GCACCAAG | 4755 |
| 2944 | UUGCUUGG CUGAUGAG GCCGUUAGGC CGAA ICAGGCUC | 11819 | GAGCCTGC A CCAAGCAA | 4756 |
| 2946 | CCUUGCUU CUGAUGAG GCCGUUAGGC CGAA IUGCAGGC | 11820 | GCCTGCAC C AAGCAAGG | 4757 |
| 2947 | UCCUUGCU CUGAUGAG GCCGUUAGGC CGAA IGUGCAGG | 11821 | CCTGCACC A AGCAAGGA | 4758 |
| 2951 | GCCCUCCU CUGAUGAG GCCGUUAGGC CGAA ICUUGGUG | 11822 | CACCAAGC A AGGAGGGC | 4759 |
| 2960 | CCAUCAGA CUGAUGAG GCCGUUAGGC CGAA ICCCUCCU | 11823 | AGGAGGGC C TCTGATGG | 4760 |
| 2961 | ACCAUCAG CUGAUGAG GCCGUUAGGC CGAA IGCCCUCC | 11824 | GGAGGGCC T CTGATGGT | 4761 |
| 2963 | UCACCAUC CUGAUGAG GCCGUUAGGC CGAA IAGGCCCU | 11825 | AGGGCCTC T GATGGTGA | 4762 |
| 2983 | AUAUUUGC CUGAUGAG GCCGUUAGGC CGAA IUAUUCAA | 11826 | TTGAATAC T GCAAATAT | 4763 |
| 2986 | UCCAUAUU CUGAUGAG GCCGUUAGGC CGAA ICAGUAUU | 11827 | AATACTGC A AATATGGA | 4764 |
| 2999 | AGUUGGAG CUGAUGAG GCCGUUAGGC CGAA IAUUUCCA | 11828 | TGGAAATC T CTCCAACT | 4765 |
| 3001 | GUAGUUGG CUGAUGAG GCCGUUAGGC CGAA IAGAUUUC | 11829 | GAAATCTC T CCAACTAC | 4766 |
| 3003 | AGGUAGUU CUGAUGAG GCCGUUAGGC CGAA IAGAGAUU | 11830 | AATCTCTC C AACTACCT | 4767 |
| 3004 | GAGGUAGU CUGAUGAG GCCGUUAGGC CGAA IGAGAGAU | 11831 | ATCTCTCC A ACTACCTC | 4768 |
| 3007 | CUUGAGGU CUGAUGAG GCCGUUAGGC CGAA IUUGGAGA | 11832 | TCTCCAAC T ACCTCAAG | 4769 |
| 3010 | GCUCUUGA CUGAUGAG GCCGUUAGGC CGAA IUAGUUGG | 11833 | CCAACTAC C TCAAGAGC | 4770 |
| 3011 | UGCUCUUG CUGAUGAG GCCGUUAGGC CGAA IGUAGUUG | 11834 | CAACTACC T CAAGAGCA | 4771 |
| 3013 | UUUGCUCU CUGAUGAG GCCGUUAGGC CGAA IAGGUAGU | 11835 | ACTACCTC A AGAGCAAA | 4772 |
| 3019 | GUCACGUU CUGAUGAG GCCGUUAGGC CGAA ICUCUUGA | 11836 | TCAAGAGC A AACGTGAC | 4773 |
| 3028 | AAAAAAUA CUGAUGAG GCCGUUAGGC CGAA IUCACGUU | 11837 | AACGTGAC T TATTTTTT | 4774 |
| 3038 | CCUUGUUG CUGAUGAG GCCGUUAGGC CGAA IAAAAAAU | 11838 | ATTTTTTC T CAACAAGG | 4775 |
| 3040 | AUCCUUGU CUGAUGAG GCCGUUAGGC CGAA IAGAAAAA | 11839 | TTTTTCTC A ACAAGGAT | 4776 |

222

| | | | | |
|---|---|---|---|---|
| 3043 | UGCAUCCU CUGAUGAG GCCGUUAGGC CGAA IUUGAGAA | 11840 | TTCTCAAC A AGGATGCA | 4777 |
| 3051 | UGUAGUGC CUGAUGAG GCCGUUAGGC CGAA ICAUCCUU | 11841 | AAGGATGC A GCACTACA | 4778 |
| 3054 | AUGUGUAG CUGAUGAG GCCGUUAGGC CGAA ICUGCAUC | 11842 | GATGCAGC A CTACACAT | 4779 |
| 3056 | CCAUGUGU CUGAUGAG GCCGUUAGGC CGAA IUGCUGCA | 11843 | TGCAGCAC T ACACATGG | 4780 |
| 3059 | GCUCCAUG CUGAUGAG GCCGUUAGGC CGAA IUAGUGCU | 11844 | AGCACTAC A CATGGAGC | 4781 |
| 3061 | AGGCUCCA CUGAUGAG GCCGUUAGGC CGAA IUGUAGUG | 11845 | CACTACAC A TGGAGCCT | 4782 |
| 3068 | CUUUCUUA CUGAUGAG GCCGUUAGGC CGAA ICUCCAUG | 11846 | CATGGAGC C TAAGAAAG | 4783 |
| 3069 | UCUUUCUU CUGAUGAG GCCGUUAGGC CGAA IGCUCCAU | 11847 | ATGGAGCC T AAGAAAGA | 4784 |
| 3089 | CCAGGCCU CUGAUGAG GCCGUUAGGC CGAA ICUCCAUU | 11848 | AATGGAGC C AGGCCTGG | 4785 |
| 3090 | UCCAGGCC CUGAUGAG GCCGUUAGGC CGAA IGCUCCAU | 11849 | ATGGAGCC A GGCCTGGA | 4786 |
| 3094 | UUGUUCCA CUGAUGAG GCCGUUAGGC CGAA ICCUGGCU | 11850 | AGCCAGGC C TGGAACAA | 4787 |
| 3095 | CUUGUUCC CUGAUGAG GCCGUUAGGC CGAA IGCCUGGC | 11851 | GCCAGGCC T GGAACAAG | 4788 |
| 3101 | UCUUGCCU CUGAUGAG GCCGUUAGGC CGAA IUUCCAGG | 11852 | CCTGGAAC A AGGCAAGA | 4789 |
| 3106 | UGGUUUCU CUGAUGAG GCCGUUAGGC CGAA ICCUUGUU | 11853 | AACAAGGC A AGAAACCA | 4790 |
| 3113 | CUAGUCUU CUGAUGAG GCCGUUAGGC CGAA IUUUCUUG | 11854 | CAAGAAAC C AAGACTAG | 4791 |
| 3114 | UCUAGUCU CUGAUGAG GCCGUUAGGC CGAA IGUUUCUU | 11855 | AAGAAACC A AGACTAGA | 4792 |
| 3119 | CGCUAUCU CUGAUGAG GCCGUUAGGC CGAA IUCUUGGU | 11856 | ACCAAGAC T AGATAGCG | 4793 |
| 3130 | GCUGCUGG CUGAUGAG GCCGUUAGGC CGAA IACGCUAU | 11857 | ATAGCGTC A CCAGCAGC | 4794 |
| 3132 | UCGCUGCU CUGAUGAG GCCGUUAGGC CGAA IUGACGCU | 11858 | AGCGTCAC C AGCAGCGA | 4795 |
| 3133 | UUCGCUGC CUGAUGAG GCCGUUAGGC CGAA IGUGACGC | 11859 | GCGTCACC A GCAGCGAA | 4796 |
| 3136 | GCUUUCGC CUGAUGAG GCCGUUAGGC CGAA ICUGGUGA | 11860 | TCACCAGC A GCGAAAGC | 4797 |
| 3145 | GCUCGCAA CUGAUGAG GCCGUUAGGC CGAA ICUUUCGC | 11861 | GCGAAAGC T TTGCGAGC | 4798 |
| 3154 | AAAGCCGG CUGAUGAG GCCGUUAGGC CGAA ICUCGCAA | 11862 | TTGCGAGC T CCGGCTTT | 4799 |
| 3156 | UGAAAGCC CUGAUGAG GCCGUUAGGC CGAA IAGCUCGC | 11863 | GCGAGCTC C GGCTTTCA | 4800 |
| 3160 | UUCCUGAA CUGAUGAG GCCGUUAGGC CGAA ICCGGAGC | 11864 | GCTCCGGC T TTCAGGAA | 4801 |
| 3164 | UAUCUUCC CUGAUGAG GCCGUUAGGC CGAA IAAAGCCG | 11865 | CGGCTTTC A GGAAGATA | 4802 |
| 3179 | CAUCACUC CUGAUGAG GCCGUUAGGC CGAA IACUUUUA | 11866 | TAAAAGTC T GAGTGATG | 4803 |
| 3207 | AAACCGUC CUGAUGAG GCCGUUAGGC CGAA IAAUCCUC | 11867 | GAGGATTC T GACGGTTT | 4804 |
| 3217 | CUCCUUGU CUGAUGAG GCCGUUAGGC CGAA IAAACCGU | 11868 | ACGGTTTC T ACAAGGAG | 4805 |
| 3220 | GGGCUCCU CUGAUGAG GCCGUUAGGC CGAA IUAGAAAC | 11869 | GTTTCTAC A AGGAGCCC | 4806 |
| 3227 | UAGUGAUG CUGAUGAG GCCGUUAGGC CGAA ICUCCUUG | 11870 | CAAGGAGC C CATCACTA | 4807 |
| 3228 | AUAGUGAU CUGAUGAG GCCGUUAGGC CGAA IGCUCCUU | 11871 | AAGGAGCC C ATCACTAT | 4808 |
| 3229 | CAUAGUGA CUGAUGAG GCCGUUAGGC CGAA IGGCUCCU | 11872 | AGGAGCCC A TCACTATG | 4809 |

| | | | | |
|---|---|---|---|---|
| 3232 | UUCCAUAG CUGAUGAG GCCGUUAGGC CGAA IAUGGGCU | 11873 | AGCCCATC A CTATGGAA | 4810 |
| 3234 | UCUUCCAU CUGAUGAG GCCGUUAGGC CGAA IUGAUGGG | 11874 | CCCATCAC T ATGGAAGA | 4811 |
| 3245 | AAGAAAUC CUGAUGAG GCCGUUAGGC CGAA IAUCUUCC | 11875 | GGAAGATC T GATTTCTT | 4812 |
| 3252 | AAACUGUA CUGAUGAG GCCGUUAGGC CGAA IAAAUCAG | 11876 | CTGATTTC T TACAGTTT | 4813 |
| 3256 | UUGAAAAC CUGAUGAG GCCGUUAGGC CGAA IUAAGAAA | 11877 | TTTCTTAC A GTTTTCAA | 4814 |
| 3263 | UGGCCACU CUGAUGAG GCCGUUAGGC CGAA IAAAACUG | 11878 | CAGTTTTC A AGTGGCCA | 4815 |
| 3270 | AUGCCUCU CUGAUGAG GCCGUUAGGC CGAA ICCACUUG | 11879 | CAAGTGGC C AGAGGCAT | 4816 |
| 3271 | CAUGCCUC CUGAUGAG GCCGUUAGGC CGAA IGCCACUU | 11880 | AAGTGGCC A GAGGCATG | 4817 |
| 3277 | GAACUCCA CUGAUGAG GCCGUUAGGC CGAA ICCUCUGG | 11881 | CCAGAGGC A TGGAGTTC | 4818 |
| 3286 | GGAAGACA CUGAUGAG GCCGUUAGGC CGAA IAACUCCA | 11882 | TGGAGTTC C TGTCTTCC | 4819 |
| 3287 | UGGAAGAC CUGAUGAG GCCGUUAGGC CGAA IGAACUCC | 11883 | GGAGTTCC T GTCTTCCA | 4820 |
| 3291 | UUUCUGGA CUGAUGAG GCCGUUAGGC CGAA IACAGGAA | 11884 | TTCCTGTC T TCCAGAAA | 4821 |
| 3294 | CACUUUCU CUGAUGAG GCCGUUAGGC CGAA IAAGACAG | 11885 | CTGTCTTC C AGAAAGTG | 4822 |
| 3295 | GCACUUUC CUGAUGAG GCCGUUAGGC CGAA IGAAGACA | 11886 | TGTCTTCC A GAAAGTGC | 4823 |
| 3304 | CCGAUGAA CUGAUGAG GCCGUUAGGC CGAA ICACUUUC | 11887 | GAAAGTGC A TTCATCGG | 4824 |
| 3308 | GGUCCCGA CUGAUGAG GCCGUUAGGC CGAA IAAUGCAC | 11888 | GTGCATTC A TCGGGACC | 4825 |
| 3316 | CGCUGCCA CUGAUGAG GCCGUUAGGC CGAA IUCCCGAU | 11889 | ATCGGGAC C TGGCAGCG | 4826 |
| 3317 | UCGCUGCC CUGAUGAG GCCGUUAGGC CGAA IGUCCCGA | 11890 | TCGGGACC T GGCAGCGA | 4827 |
| 3321 | UUUCUCGC CUGAUGAG GCCGUUAGGC CGAA ICCAGGUC | 11891 | GACCTGGC A GCGAGAAA | 4828 |
| 3331 | UAAAAGAA CUGAUGAG GCCGUUAGGC CGAA IUUUCUCG | 11892 | CGAGAAAC A TTCTTTTA | 4829 |
| 3335 | CAGAUAAA CUGAUGAG GCCGUUAGGC CGAA IAAUGUUU | 11893 | AAACATTC T TTTATCTG | 4830 |
| 3342 | UUGUUCUC CUGAUGAG GCCGUUAGGC CGAA IAUAAAAG | 11894 | CTTTTATC T GAGAACAA | 4831 |
| 3349 | CACCACGU CUGAUGAG GCCGUUAGGC CGAA IUUCUCAG | 11895 | CTGAGAAC A ACGTGGTG | 4832 |
| 3376 | CCGGGCAA CUGAUGAG GCCGUUAGGC CGAA ICCAAAAU | 11896 | ATTTTGGC C TTGCCCGG | 4833 |
| 3377 | CCCGGGCA CUGAUGAG GCCGUUAGGC CGAA IGCCAAAA | 11897 | TTTTGGCC T TGCCCGGG | 4834 |
| 3381 | AUAUCCCG CUGAUGAG GCCGUUAGGC CGAA ICAAGGCC | 11898 | GGCCTTGC C CGGGATAT | 4835 |
| 3382 | AAUAUCCC CUGAUGAG GCCGUUAGGC CGAA IGCAAGGC | 11899 | GCCTTGCC C GGGATATT | 4836 |
| 3400 | AUAAUCGG CUGAUGAG GCCGUUAGGC CGAA IUUCUUAU | 11900 | ATAAGAAC C CCGATTAT | 4837 |
| 3401 | CAUAAUCG CUGAUGAG GCCGUUAGGC CGAA IGUUCUUA | 11901 | TAAGAACC C CGATTATG | 4838 |
| 3402 | ACAUAAUC CUGAUGAG GCCGUUAGGC CGAA IGGUUCUU | 11902 | AAGAACCC C GATTATGT | 4839 |
| 3426 | GGAAGUCG CUGAUGAG GCCGUUAGGC CGAA IUAUCUCC | 11903 | GGAGATAC T CGACTTCC | 4840 |
| 3431 | UCAGAGGA CUGAUGAG GCCGUUAGGC CGAA IUCGAGUA | 11904 | TACTCGAC T TCCTCTGA | 4841 |
| 3434 | AUUUCAGA CUGAUGAG GCCGUUAGGC CGAA IAAGUCGA | 11905 | TCGACTTC C TCTGAAAT | 4842 |

| | | | | |
|---|---|---|---|---|
| 3435 | CAUUUCAG CUGAUGAG GCCGUUAGGC CGAA IGAAGUCG | 11906 | CGACTTCC T CTGAAATG | 4843 |
| 3437 | UCCAUUUC CUGAUGAG GCCGUUAGGC CGAA IAGGAAGU | 11907 | ACTTCCTC T GAAATGGA | 4844 |
| 3450 | GAUUCGGG CUGAUGAG GCCGUUAGGC CGAA ICCAUCCA | 11908 | TGGATGGC T CCCGAATC | 4845 |
| 3452 | UAGAUUCG CUGAUGAG GCCGUUAGGC CGAA IAGCCAUC | 11909 | GATGGCTC C CGAATCTA | 4846 |
| 3453 | AUAGAUUC CUGAUGAG GCCGUUAGGC CGAA IGAGCCAU | 11910 | ATGGCTCC C GAATCTAT | 4847 |
| 3459 | UCAAAGAU CUGAUGAG GCCGUUAGGC CGAA IAUUCGGG | 11911 | CCCGAATC T ATCTTTGA | 4848 |
| 3463 | UUUGUCAA CUGAUGAG GCCGUUAGGC CGAA IAUAGAUU | 11912 | AATCTATC T TTGACAAA | 4849 |
| 3469 | GUAGAUUU CUGAUGAG GCCGUUAGGC CGAA IUCAAAGA | 11913 | TCTTTGAC A AAATCTAC | 4850 |
| 3475 | GGUGCUGU CUGAUGAG GCCGUUAGGC CGAA IAUUUUGU | 11914 | ACAAAATC T ACAGCACC | 4851 |
| 3478 | CUUGGUGC CUGAUGAG GCCGUUAGGC CGAA IUAGAUUU | 11915 | AAATCTAC A GCACCAAG | 4852 |
| 3481 | GCUCUUGG CUGAUGAG GCCGUUAGGC CGAA ICUGUAGA | 11916 | TCTACAGC A CCAAGAGC | 4853 |
| 3483 | UCGCUCUU CUGAUGAG GCCGUUAGGC CGAA IUGCUGUA | 11917 | TACAGCAC C AAGAGCGA | 4854 |
| 3484 | GUCGCUCU CUGAUGAG GCCGUUAGGC CGAA IGUGCUGU | 11918 | ACAGCACC A AGAGCGAC | 4855 |
| 3501 | ACUCCGUA CUGAUGAG GCCGUUAGGC CGAA IACCACAC | 11919 | GTGTGGTC T TACGGAGT | 4856 |
| 3515 | UUUCCCAC CUGAUGAG GCCGUUAGGC CGAA ICAAUACU | 11920 | AGTATTGC T GTGGGAAA | 4857 |
| 3526 | UAAGGAGA CUGAUGAG GCCGUUAGGC CGAA IAUUUCCC | 11921 | GGGAAATC T TCTCCTTA | 4858 |
| 3529 | ACCUAAGG CUGAUGAG GCCGUUAGGC CGAA IAAGAUUU | 11922 | AAATCTTC T CCTTAGGT | 4859 |
| 3531 | CCACCUAA CUGAUGAG GCCGUUAGGC CGAA IAGAAGAU | 11923 | ATCTTCTC C TTAGGTGG | 4860 |
| 3532 | CCCACCUA CUGAUGAG GCCGUUAGGC CGAA IGAGAAGA | 11924 | TCTTCTCC T TAGGTGGG | 4861 |
| 3543 | GGGUAUGG CUGAUGAG GCCGUUAGGC CGAA IACCCACC | 11925 | GGTGGGTC T CCATACCC | 4862 |
| 3545 | CUGGGUAU CUGAUGAG GCCGUUAGGC CGAA IAGACCCA | 11926 | TGGGTCTC C ATACCCAG | 4863 |
| 3546 | CCUGGGUA CUGAUGAG GCCGUUAGGC CGAA IGAGACCC | 11927 | GGGTCTCC A TACCCAGG | 4864 |
| 3550 | UACUCCUG CUGAUGAG GCCGUUAGGC CGAA IUAUGGAG | 11928 | CTCCATAC C CAGGAGTA | 4865 |
| 3551 | GUACUCCU CUGAUGAG GCCGUUAGGC CGAA IGUAUGGA | 11929 | TCCATACC C AGGAGTAC | 4866 |
| 3552 | UGUACUCC CUGAUGAG GCCGUUAGGC CGAA IGGUAUGG | 11930 | CCATACCC A GGAGTACA | 4867 |
| 3560 | CAUCCAUU CUGAUGAG GCCGUUAGGC CGAA IUACUCCU | 11931 | AGGAGTAC A AATGGATG | 4868 |
| 3574 | ACUGCAAA CUGAUGAG GCCGUUAGGC CGAA IUCCUCAU | 11932 | ATGAGGAC T TTTGCAGT | 4869 |
| 3580 | CAGGCGAC CUGAUGAG GCCGUUAGGC CGAA ICAAAAGU | 11933 | ACTTTTGC A GTCGCCTG | 4870 |
| 3586 | UUCCCUCA CUGAUGAG GCCGUUAGGC CGAA ICGACUGC | 11934 | GCAGTCGC C TGAGGGAA | 4871 |
| 3587 | CUUCCCUC CUGAUGAG GCCGUUAGGC CGAA IGCGACUG | 11935 | CAGTCGCC T GAGGGAAG | 4872 |
| 3598 | CAUCCUCA CUGAUGAG GCCGUUAGGC CGAA ICCUUCCC | 11936 | GGGAAGGC A TGAGGATG | 4873 |
| 3612 | UACUCAGG CUGAUGAG GCCGUUAGGC CGAA ICUCUCAU | 11937 | ATGAGAGC T CCTGAGTA | 4874 |
| 3614 | AGUACUCA CUGAUGAG GCCGUUAGGC CGAA IAGCUCUC | 11938 | GAGAGCTC C TGAGTACT | 4875 |

| | | | | |
|---|---|---|---|---|
| 3615 | GAGUACUC CUGAUGAG GCCGUUAGGC CGAA IGAGCUCU | 11939 | AGAGCTCC T GAGTACTC | 4876 |
| 3622 | AGGAGUAG CUGAUGAG GCCGUUAGGC CGAA IUACUCAG | 11940 | CTGAGTAC T CTACTCCT | 4877 |
| 3624 | UCAGGAGU CUGAUGAG GCCGUUAGGC CGAA IAGUACUC | 11941 | GAGTACTC T ACTCCTGA | 4878 |
| 3627 | AUUUCAGG CUGAUGAG GCCGUUAGGC CGAA IUAGAGUA | 11942 | TACTCTAC T CCTGAAAT | 4879 |
| 3629 | AGAUUUCA CUGAUGAG GCCGUUAGGC CGAA IAGUAGAG | 11943 | CTCTACTC C TGAAATCT | 4880 |
| 3630 | UAGAUUUC CUGAUGAG GCCGUUAGGC CGAA IGAGUAGA | 11944 | TCTACTCC T GAAATCTA | 4881 |
| 3637 | GAUCUGAU CUGAUGAG GCCGUUAGGC CGAA IAUUUCAG | 11945 | CTGAAATC T ATCAGATC | 4882 |
| 3641 | GCAUGAUC CUGAUGAG GCCGUUAGGC CGAA IAUAGAUU | 11946 | AATCTATC A GATCATGC | 4883 |
| 3646 | GUCCAGCA CUGAUGAG GCCGUUAGGC CGAA IAUCUGAU | 11947 | ATCAGATC A TGCTGGAC | 4884 |
| 3650 | AGCAGUCC CUGAUGAG GCCGUUAGGC CGAA ICAUGAUC | 11948 | GATCATGC T GGACTGCT | 4885 |
| 3655 | GUGCCAGC CUGAUGAG GCCGUUAGGC CGAA IUCCAGCA | 11949 | TGCTGGAC T GCTGGCAC | 4886 |
| 3658 | UCUGUGCC CUGAUGAG GCCGUUAGGC CGAA ICAGUCCA | 11950 | TGGACTGC T GGCACAGA | 4887 |
| 3662 | GGUCUCUG CUGAUGAG GCCGUUAGGC CGAA ICCAGCAG | 11951 | CTGCTGGC A CAGAGACC | 4888 |
| 3664 | UGGGUCUC CUGAUGAG GCCGUUAGGC CGAA IUGCCAGC | 11952 | GCTGGCAC A GAGACCCA | 4889 |
| 3670 | UUCUUUUG CUGAUGAG GCCGUUAGGC CGAA IUCUCUGU | 11953 | ACAGAGAC C CAAAAGAA | 4890 |
| 3671 | UUUCUUUU CUGAUGAG GCCGUUAGGC CGAA IGUCUCUG | 11954 | CAGAGACC C AAAAGAAA | 4891 |
| 3672 | CUUUCUUU CUGAUGAG GCCGUUAGGC CGAA IGGUCUCU | 11955 | AGAGACCC A AAAGAAAG | 4892 |
| 3683 | CAAAUCUU CUGAUGAG GCCGUUAGGC CGAA ICCUUUCU | 11956 | AGAAAGGC C AAGATTTG | 4893 |
| 3684 | GCAAAUCU CUGAUGAG GCCGUUAGGC CGAA IGCCUUUC | 11957 | GAAAGGCC A AGATTTGC | 4894 |
| 3693 | ACAAGUUC CUGAUGAG GCCGUUAGGC CGAA ICAAAUCU | 11958 | AGATTTGC A GAACTTGT | 4895 |
| 3698 | UUUCCACA CUGAUGAG GCCGUUAGGC CGAA IUUCUGCA | 11959 | TGCAGAAC T TGTGGAAA | 4896 |
| 3710 | AAUCACCU CUGAUGAG GCCGUUAGGC CGAA IUUUUUCC | 11960 | GGAAAAAC T AGGTGATT | 4897 |
| 3722 | UUGCUUGA CUGAUGAG GCCGUUAGGC CGAA ICAAAUCA | 11961 | TGATTTGC T TCAAGCAA | 4898 |
| 3725 | CAUUUGCU CUGAUGAG GCCGUUAGGC CGAA IAAGCAAA | 11962 | TTTGCTTC A AGCAAATG | 4899 |
| 3729 | UGUACAUU CUGAUGAG GCCGUUAGGC CGAA ICUUGAAG | 11963 | CTTCAAGC A AATGTACA | 4900 |
| 3737 | CAUCCUGU CUGAUGAG GCCGUUAGGC CGAA IUACAUUU | 11964 | AAATGTAC A ACAGGATG | 4901 |
| 3740 | UACCAUCC CUGAUGAG GCCGUUAGGC CGAA IUUGUACA | 11965 | TGTACAAC A GGATGGTA | 4902 |
| 3754 | UGGGAUGU CUGAUGAG GCCGUUAGGC CGAA IUCUUUAC | 11966 | GTAAAGAC T ACATCCCA | 4903 |
| 3757 | GAUUGGGA CUGAUGAG GCCGUUAGGC CGAA IUAGUCUU | 11967 | AAGACTAC A TCCCAATC | 4904 |
| 3760 | AUUGAUUG CUGAUGAG GCCGUUAGGC CGAA IAUGUAGU | 11968 | ACTACATC C CAATCAAT | 4905 |
| 3761 | CAUUGAUU CUGAUGAG GCCGUUAGGC CGAA IGAUGUAG | 11969 | CTACATCC C AATCAATG | 4906 |
| 3762 | GCAUUGAU CUGAUGAG GCCGUUAGGC CGAA IGGAUGUA | 11970 | TACATCCC A ATCAATGC | 4907 |
| 3766 | UAUGGCAU CUGAUGAG GCCGUUAGGC CGAA IAUUGGGA | 11971 | TCCCAATC A ATGCCATA | 4908 |

| | | | | |
|---|---|---|---|---|
| 3771 | GUCAGUAU CUGAUGAG GCCGUUAGGC CGAA ICAUUGAU | 11972 | ATCAATGC C ATACTGAC | 4909 |
| 3772 | UGUCAGUA CUGAUGAG GCCGUUAGGC CGAA IGCAUUGA | 11973 | TCAATGCC A TACTGACA | 4910 |
| 3776 | UUCCUGUC CUGAUGAG GCCGUUAGGC CGAA IUAUGGCA | 11974 | TGCCATAC T GACAGGAA | 4911 |
| 3780 | CUAUUUCC CUGAUGAG GCCGUUAGGC CGAA IUCAGUAU | 11975 | ATACTGAC A GGAAATAG | 4912 |
| 3798 | GUUGAGUA CUGAUGAG GCCGUUAGGC CGAA IUAAACCC | 11976 | GGGTTTAC A TACTCAAC | 4913 |
| 3802 | AGGAGUUG CUGAUGAG GCCGUUAGGC CGAA IUAUGUAA | 11977 | TTACATAC T CAACTCCT | 4914 |
| 3804 | GCAGGAGU CUGAUGAG GCCGUUAGGC CGAA IAGUAUGU | 11978 | ACATACTC A ACTCCTGC | 4915 |
| 3807 | AAGGCAGG CUGAUGAG GCCGUUAGGC CGAA IUUGAGUA | 11979 | TACTCAAC T CCTGCCTT | 4916 |
| 3809 | AGAAGGCA CUGAUGAG GCCGUUAGGC CGAA IAGUUGAG | 11980 | CTCAACTC C TGCCTTCT | 4917 |
| 3810 | GAGAAGGC CUGAUGAG GCCGUUAGGC CGAA IGAGUUGA | 11981 | TCAACTCC T GCCTTCTC | 4918 |
| 3813 | UCAGAGAA CUGAUGAG GCCGUUAGGC CGAA ICAGGAGU | 11982 | ACTCCTGC C TTCTCTGA | 4919 |
| 3814 | CUCAGAGA CUGAUGAG GCCGUUAGGC CGAA IGCAGGAG | 11983 | CTCCTGCC T TCTCTGAG | 4920 |
| 3817 | GUCCUCAG CUGAUGAG GCCGUUAGGC CGAA IAAGGCAG | 11984 | CTGCCTTC T CTGAGGAC | 4921 |
| 3819 | AAGUCCUC CUGAUGAG GCCGUUAGGC CGAA IAGAAGGC | 11985 | GCCTTCTC T GAGGACTT | 4922 |
| 3826 | CUUGAAGA CUGAUGAG GCCGUUAGGC CGAA IUCCUCAG | 11986 | CTGAGGAC T TCTTCAAG | 4923 |
| 3829 | UUCCUUGA CUGAUGAG GCCGUUAGGC CGAA IAAGUCCU | 11987 | AGGACTTC T TCAAGGAA | 4924 |
| 3832 | ACUUUCCU CUGAUGAG GCCGUUAGGC CGAA IAAGAAGU | 11988 | ACTTCTTC A AGGAAAGT | 4925 |
| 3846 | UUCGGAGC CUGAUGAG GCCGUUAGGC CGAA IAAAUACU | 11989 | AGTATTTC A GCTCCGAA | 4926 |
| 3849 | AACUUCGG CUGAUGAG GCCGUUAGGC CGAA ICUGAAAU | 11990 | ATTTCAGC T CCGAAGTT | 4927 |
| 3851 | UAAACUUC CUGAUGAG GCCGUUAGGC CGAA IAGCUGAA | 11991 | TTCAGCTC C GAAGTTTA | 4928 |
| 3864 | GAGCUUCC CUGAUGAG GCCGUUAGGC CGAA IAAUUAAA | 11992 | TTTAATTC A GGAAGCTC | 4929 |
| 3871 | AUCAUCAG CUGAUGAG GCCGUUAGGC CGAA ICUUCCUG | 11993 | CAGGAAGC T CTGATGAT | 4930 |
| 3873 | ACAUCAUC CUGAUGAG GCCGUUAGGC CGAA IAGCUUCC | 11994 | GGAAGCTC T GATGATGT | 4931 |
| 3883 | UACAUAUC CUGAUGAG GCCGUUAGGC CGAA IACAUCAU | 11995 | ATGATGTC A GATATGTA | 4932 |
| 3897 | AACUUGAA CUGAUGAG GCCGUUAGGC CGAA ICAUUUAC | 11996 | GTAAATGC T TTCAAGTT | 4933 |
| 3901 | CAUGAACU CUGAUGAG GCCGUUAGGC CGAA IAAAGCAU | 11997 | ATGCTTTC A AGTTCATG | 4934 |
| 3907 | CAGGCUCA CUGAUGAG GCCGUUAGGC CGAA IAACUUGA | 11998 | TCAAGTTC A TGAGCCTG | 4935 |
| 3913 | UCUUUCCA CUGAUGAG GCCGUUAGGC CGAA ICUCAUGA | 11999 | TCATGAGC C TGGAAAGA | 4936 |
| 3914 | UUCUUUCC CUGAUGAG GCCGUUAGGC CGAA IGCUCAUG | 12000 | CATGAGCC T GGAAAGAA | 4937 |
| 3925 | AAAGGUUU CUGAUGAG GCCGUUAGGC CGAA IAUUCUUU | 12001 | AAAGAATC A AAACCTTT | 4938 |
| 3930 | UCUUCAAA CUGAUGAG GCCGUUAGGC CGAA IUUUUGAU | 12002 | ATCAAAAC C TTTGAAGA | 4939 |
| 3931 | UUCUUCAA CUGAUGAG GCCGUUAGGC CGAA IGUUUUGA | 12003 | TCAAAACC T TTGAAGAA | 4940 |
| 3941 | UCGGUAAA CUGAUGAG GCCGUUAGGC CGAA IUUCUUCA | 12004 | TGAAGAAC T TTTACCGA | 4941 |

| | | | | |
|---|---|---|---|---|
| 3947 | UGGCAUUC CUGAUGAG GCCGUUAGGC CGAA IUAAAAGU | 12005 | ACTTTTAC C GAATGCCA | 4942 |
| 3954 | AUGGAGGU CUGAUGAG GCCGUUAGGC CGAA ICAUUCGG | 12006 | CCGAATGC C ACCTCCAT | 4943 |
| 3955 | CAUGGAGG CUGAUGAG GCCGUUAGGC CGAA IGCAUUCG | 12007 | CGAATGCC A CCTCCATG | 4944 |
| 3957 | AACAUGGA CUGAUGAG GCCGUUAGGC CGAA IUGGCAUU | 12008 | AATGCCAC C TCCATGTT | 4945 |
| 3958 | AAACAUGG CUGAUGAG GCCGUUAGGC CGAA IGUGGCAU | 12009 | ATGCCACC T CCATGTTT | 4946 |
| 3960 | UCAAACAU CUGAUGAG GCCGUUAGGC CGAA IAGGUGGC | 12010 | GCCACCTC C ATGTTTGA | 4947 |
| 3961 | AUCAAACA CUGAUGAG GCCGUUAGGC CGAA IGAGGUGG | 12011 | CCACCTCC A TGTTTGAT | 4948 |
| 3973 | GCCCUGGU CUGAUGAG GCCGUUAGGC CGAA IUCAUCAA | 12012 | TTGATGAC T ACCAGGGC | 4949 |
| 3976 | GUCGCCCU CUGAUGAG GCCGUUAGGC CGAA IUAGUCAU | 12013 | ATGACTAC C AGGGCGAC | 4950 |
| 3977 | UGUCGCCC CUGAUGAG GCCGUUAGGC CGAA IGUAGUCA | 12014 | TGACTACC A GGGCGACA | 4951 |
| 3985 | AGUGCUGC CUGAUGAG GCCGUUAGGC CGAA IUCGCCCU | 12015 | AGGGCGAC A GCAGCACT | 4952 |
| 3988 | CAGAGUGC CUGAUGAG GCCGUUAGGC CGAA ICUGUCGC | 12016 | GCGACAGC A GCACTCTG | 4953 |
| 3991 | CAACAGAG CUGAUGAG GCCGUUAGGC CGAA ICUGCUGU | 12017 | ACAGCAGC A CTCTGTTG | 4954 |
| 3993 | GCCAACAG CUGAUGAG GCCGUUAGGC CGAA IUGCUGCU | 12018 | AGCAGCAC T CTGTTGGC | 4955 |
| 3995 | AGGCCAAC CUGAUGAG GCCGUUAGGC CGAA IAGUGCUG | 12019 | CAGCACTC T GTTGGCCT | 4956 |
| 4002 | AUGGGAGA CUGAUGAG GCCGUUAGGC CGAA ICCAACAG | 12020 | CTGTTGGC C TCTCCCAT | 4957 |
| 4003 | CAUGGGAG CUGAUGAG GCCGUUAGGC CGAA IGCCAACA | 12021 | TGTTGGCC T CTCCCATG | 4958 |
| 4005 | AGCAUGGG CUGAUGAG GCCGUUAGGC CGAA IAGGCCAA | 12022 | TTGGCCTC T CCCATGCT | 4959 |
| 4007 | UCAGCAUG CUGAUGAG GCCGUUAGGC CGAA IAGAGGCC | 12023 | GGCCTCTC C CATGCTGA | 4960 |
| 4008 | UUCAGCAU CUGAUGAG GCCGUUAGGC CGAA IGAGAGGC | 12024 | GCCTCTCC C ATGCTGAA | 4961 |
| 4009 | CUUCAGCA CUGAUGAG GCCGUUAGGC CGAA IGGAGAGG | 12025 | CCTCTCCC A TGCTGAAG | 4962 |
| 4013 | AGCGCUUC CUGAUGAG GCCGUUAGGC CGAA ICAUGGGA | 12026 | TCCCATGC T GAAGCGCT | 4963 |
| 4021 | CCAGGUGA CUGAUGAG GCCGUUAGGC CGAA ICGCUUCA | 12027 | TGAAGCGC T TCACCTGG | 4964 |
| 4024 | AGUCCAGG CUGAUGAG GCCGUUAGGC CGAA IAAGCGCU | 12028 | AGCGCTTC A CCTGGACT | 4965 |
| 4026 | UCAGUCCA CUGAUGAG GCCGUUAGGC CGAA IUGAAGCG | 12029 | CGCTTCAC C TGGACTGA | 4966 |
| 4027 | GUCAGUCC CUGAUGAG GCCGUUAGGC CGAA IGUGAAGC | 12030 | GCTTCACC T GGACTGAC | 4967 |
| 4032 | UUGCUGUC CUGAUGAG GCCGUUAGGC CGAA IUCCAGGU | 12031 | ACCTGGAC T GACAGCAA | 4968 |
| 4036 | GGGUUUGC CUGAUGAG GCCGUUAGGC CGAA IUCAGUCC | 12032 | GGACTGAC A GCAAACCC | 4969 |
| 4039 | CUUGGGUU CUGAUGAG GCCGUUAGGC CGAA ICUGUCAG | 12033 | CTGACAGC A AACCCAAG | 4970 |
| 4043 | AGGCCUUG CUGAUGAG GCCGUUAGGC CGAA IUUUGCUG | 12034 | CAGCAAAC C CAAGGCCT | 4971 |
| 4044 | GAGGCCUU CUGAUGAG GCCGUUAGGC CGAA IGUUUGCU | 12035 | AGCAAACC C AAGGCCTC | 4972 |
| 4045 | CGAGGCCU CUGAUGAG GCCGUUAGGC CGAA IGGUUUGC | 12036 | GCAAACCC A AGGCCTCG | 4973 |
| 4050 | UUGAGCGA CUGAUGAG GCCGUUAGGC CGAA ICCUUGGG | 12037 | CCCAAGGC C TCGCTCAA | 4974 |

| | | | | |
|---|---|---|---|---|
| 4051 | CUUGAGCG CUGAUGAG GCCGUUAGGC CGAA IGCCUUGG | 12038 | CCAAGGCC T CGCTCAAG | 4975 |
| 4055 | CAAUCUUG CUGAUGAG GCCGUUAGGC CGAA ICGAGGCC | 12039 | GGCCTCGC T CAAGATTG | 4976 |
| 4057 | GUCAAUCU CUGAUGAG GCCGUUAGGC CGAA IAGCGAGG | 12040 | CCTCGCTC A AGATTGAC | 4977 |
| 4066 | UACUCUCA CUGAUGAG GCCGUUAGGC CGAA IUCAAUCU | 12041 | AGATTGAC T TGAGAGTA | 4978 |
| 4077 | CUUUUACU CUGAUGAG GCCGUUAGGC CGAA IUUACUCU | 12042 | AGAGTAAC C AGTAAAAG | 4979 |
| 4078 | ACUUUUAC CUGAUGAG GCCGUUAGGC CGAA IGUUACUC | 12043 | GAGTAACC A GTAAAAGT | 4980 |
| 4100 | CAUCAGAC CUGAUGAG GCCGUUAGGC CGAA ICCCCGAC | 12044 | GTCGGGGC T GTCTGATG | 4981 |
| 4104 | CUGACAUC CUGAUGAG GCCGUUAGGC CGAA IACAGCCC | 12045 | GGGCTGTC T GATGTCAG | 4982 |
| 4111 | GGGCCUGC CUGAUGAG GCCGUUAGGC CGAA IACAUCAG | 12046 | CTGATGTC A GCAGGCCC | 4983 |
| 4114 | ACUGGGCC CUGAUGAG GCCGUUAGGC CGAA ICUGACAU | 12047 | ATGTCAGC A GGCCCAGT | 4984 |
| 4118 | AGAAACUG CUGAUGAG GCCGUUAGGC CGAA ICCUGCUG | 12048 | CAGCAGGC C CAGTTTCT | 4985 |
| 4119 | CAGAAACU CUGAUGAG GCCGUUAGGC CGAA IGCCUGCU | 12049 | AGCAGGCC C AGTTTCTG | 4986 |
| 4120 | GCAGAAAC CUGAUGAG GCCGUUAGGC CGAA IGGCCUGC | 12050 | GCAGGCCC A GTTTCTGC | 4987 |
| 4126 | GGAAUGGC CUGAUGAG GCCGUUAGGC CGAA IAAACUGG | 12051 | CCAGTTTC T GCCATTCC | 4988 |
| 4129 | GCUGGAAU CUGAUGAG GCCGUUAGGC CGAA ICAGAAAC | 12052 | GTTTCTGC C ATTCCAGC | 4989 |
| 4130 | AGCUGGAA CUGAUGAG GCCGUUAGGC CGAA IGCAGAAA | 12053 | TTTCTGCC A TTCCAGCT | 4990 |
| 4134 | CCACAGCU CUGAUGAG GCCGUUAGGC CGAA IAAUGGCA | 12054 | TGCCATTC C AGCTGTGG | 4991 |
| 4135 | CCCACAGC CUGAUGAG GCCGUUAGGC CGAA IGAAUGGC | 12055 | GCCATTCC A GCTGTGGG | 4992 |
| 4138 | GUGCCCAC CUGAUGAG GCCGUUAGGC CGAA ICUGGAAU | 12056 | ATTCCAGC T GTGGGCAC | 4993 |
| 4145 | CGCUGACG CUGAUGAG GCCGUUAGGC CGAA ICCCACAG | 12057 | CTGTGGGC A CGTCAGCG | 4994 |
| 4150 | GCCUUCGC CUGAUGAG GCCGUUAGGC CGAA IACGUGCC | 12058 | GGCACGTC A GCGAAGGC | 4995 |
| 4159 | CCUGCGCU CUGAUGAG GCCGUUAGGC CGAA ICCUUCGC | 12059 | GCGAAGGC A AGCGCAGG | 4996 |
| 4165 | GGUGAACC CUGAUGAG GCCGUUAGGC CGAA ICGCUUGC | 12060 | GCAAGCGC A GGTTCACC | 4997 |
| 4171 | GUCGUAGG CUGAUGAG GCCGUUAGGC CGAA IAACCUGC | 12061 | GCAGGTTC A CCTACGAC | 4998 |
| 4173 | UGGUCGUA CUGAUGAG GCCGUUAGGC CGAA IUGAACCU | 12062 | AGGTTCAC C TACGACCA | 4999 |
| 4174 | GUGGUCGU CUGAUGAG GCCGUUAGGC CGAA IGUGAACC | 12063 | GGTTCACC T ACGACCAC | 5000 |
| 4180 | CUCAGCGU CUGAUGAG GCCGUUAGGC CGAA IUCGUAGG | 12064 | CCTACGAC C ACGCTGAG | 5001 |
| 4181 | GCUCAGCG CUGAUGAG GCCGUUAGGC CGAA IGUCGUAG | 12065 | CTACGACC A CGCTGAGC | 5002 |
| 4185 | UCCAGCUC CUGAUGAG GCCGUUAGGC CGAA ICGUGGUC | 12066 | GACCACGC T GAGCTGGA | 5003 |
| 4190 | UCCUUUCC CUGAUGAG GCCGUUAGGC CGAA ICUCAGCG | 12067 | CGCTGAGC T GGAAAGGA | 5004 |
| 4210 | CGGGGAGC CUGAUGAG GCCGUUAGGC CGAA ICACGCGA | 12068 | TCGCGTGC T GCTCCCCG | 5005 |
| 4213 | GGGCGGGG CUGAUGAG GCCGUUAGGC CGAA ICAGCACG | 12069 | CGTGCTGC T CCCCGCCC | 5006 |
| 4215 | GGGGGCGG CUGAUGAG GCCGUUAGGC CGAA IAGCAGCA | 12070 | TGCTGCTC C CCGCCCCC | 5007 |

| | | | | |
|---|---|---|---|---|
| 4216 | UGGGGGCG CUGAUGAG GCCGUUAGGC CGAA IGAGCAGC | 12071 | GCTGCTCC C CGCCCCCA | 5008 |
| 4217 | CUGGGGGC CUGAUGAG GCCGUUAGGC CGAA IGGAGCAG | 12072 | CTGCTCCC C GCCCCCAG | 5009 |
| 4220 | AGUCUGGG CUGAUGAG GCCGUUAGGC CGAA ICGGGGAG | 12073 | CTCCCCGC C CCCAGACT | 5010 |
| 4221 | UAGUCUGG CUGAUGAG GCCGUUAGGC CGAA IGCGGGGA | 12074 | TCCCCGCC C CCAGACTA | 5011 |
| 4222 | GUAGUCUG CUGAUGAG GCCGUUAGGC CGAA IGGCGGGG | 12075 | CCCCGCCC C CAGACTAC | 5012 |
| 4223 | UGUAGUCU CUGAUGAG GCCGUUAGGC CGAA IGGGCGGG | 12076 | CCCGCCCC C AGACTACA | 5013 |
| 4224 | UUGUAGUC CUGAUGAG GCCGUUAGGC CGAA IGGGGCGG | 12077 | CCGCCCCC A GACTACAA | 5014 |
| 4228 | CGAGUUGU CUGAUGAG GCCGUUAGGC CGAA IUCUGGGG | 12078 | CCCCAGAC T ACAACTCG | 5015 |
| 4231 | CACCGAGU CUGAUGAG GCCGUUAGGC CGAA IUAGUCUG | 12079 | CAGACTAC A ACTCGGTG | 5016 |
| 4234 | GACCACCG CUGAUGAG GCCGUUAGGC CGAA IUUGUAGU | 12080 | ACTACAAC T CGGTGGTC | 5017 |
| 4243 | GGAGUACA CUGAUGAG GCCGUUAGGC CGAA IACCACCG | 12081 | CGGTGGTC C TGTACTCC | 5018 |
| 4244 | UGGAGUAC CUGAUGAG GCCGUUAGGC CGAA IGACCACC | 12082 | GGTGGTCC T GTACTCCA | 5019 |
| 4249 | UGGGGUGG CUGAUGAG GCCGUUAGGC CGAA IUACAGGA | 12083 | TCCTGTAC T CCACCCCA | 5020 |
| 4251 | GGUGGGGU CUGAUGAG GCCGUUAGGC CGAA IAGUACAG | 12084 | CTGTACTC C ACCCCACC | 5021 |
| 4252 | GGGUGGGG CUGAUGAG GCCGUUAGGC CGAA IGAGUACA | 12085 | TGTACTCC A CCCCACCC | 5022 |
| 4254 | AUGGGUGG CUGAUGAG GCCGUUAGGC CGAA IUGGAGUA | 12086 | TACTCCAC C CCACCCAT | 5023 |
| 4255 | GAUGGGUG CUGAUGAG GCCGUUAGGC CGAA IGUGGAGU | 12087 | ACTCCACC C CACCCATC | 5024 |
| 4256 | AGAUGGGU CUGAUGAG GCCGUUAGGC CGAA IGGUGGAG | 12088 | CTCCACCC C ACCCATCT | 5025 |
| 4257 | UAGAUGGG CUGAUGAG GCCGUUAGGC CGAA IGGGUGGA | 12089 | TCCACCCC A CCCATCTA | 5026 |
| 4259 | UCUAGAUG CUGAUGAG GCCGUUAGGC CGAA IUGGGGUG | 12090 | CACCCCAC C CATCTAGA | 5027 |
| 4260 | CUCUAGAU CUGAUGAG GCCGUUAGGC CGAA IGUGGGGU | 12091 | ACCCCACC C ATCTAGAG | 5028 |
| 4261 | ACUCUAGA CUGAUGAG GCCGUUAGGC CGAA IGGUGGGG | 12092 | CCCCACCC A TCTAGAGT | 5029 |
| 4264 | CAAACUCU CUGAUGAG GCCGUUAGGC CGAA IAUGGGUG | 12093 | CACCCATC T AGAGTTTG | 5030 |
| 4275 | AGGCUUCG CUGAUGAG GCCGUUAGGC CGAA IUCAAACU | 12094 | AGTTTGAC A CGAAGCCT | 5031 |
| 4282 | AGAAAUAA CUGAUGAG GCCGUUAGGC CGAA ICUUCGUG | 12095 | CACGAAGC C TTATTTCT | 5032 |
| 4283 | UAGAAAUA CUGAUGAG GCCGUUAGGC CGAA IGCUUCGU | 12096 | ACGAAGCC T TATTTCTA | 5033 |
| 4290 | GUGCUUCU CUGAUGAG GCCGUUAGGC CGAA IAAAUAAG | 12097 | CTTATTTC T AGAAGCAC | 5034 |
| 4297 | UACACAUG CUGAUGAG GCCGUUAGGC CGAA ICUUCUAG | 12098 | CTAGAAGC A CATGTGTA | 5035 |
| 4299 | AAUACACA CUGAUGAG GCCGUUAGGC CGAA IUGCUUCU | 12099 | AGAAGCAC A TGTGTATT | 5036 |
| 4313 | UUCCUGGG CUGAUGAG GCCGUUAGGC CGAA IUAUAAAU | 12100 | ATTTATAC C CCCAGGAA | 5037 |
| 4314 | UUUCCUGG CUGAUGAG GCCGUUAGGC CGAA IGUAUAAA | 12101 | TTTATACC C CCAGGAAA | 5038 |
| 4315 | GUUUCCUG CUGAUGAG GCCGUUAGGC CGAA IGGUAUAA | 12102 | TTATACCC C CAGGAAAC | 5039 |
| 4316 | AGUUUCCU CUGAUGAG GCCGUUAGGC CGAA IGGGUAUA | 12103 | TATACCCC C AGGAAACT | 5040 |

| | | | | | |
|---|---|---|---|---|---|
| 4317 | UAGUUUCC CUGAUGAG GCCGUUAGGC CGAA IGGGGUAU | 12104 | ATACCCCC A GGAAACTA | 5041 |
| 4324 | CAAAAGCU CUGAUGAG GCCGUUAGGC CGAA IUUUCCUG | 12105 | CAGGAAAC T AGCTTTTG | 5042 |
| 4328 | CUGGCAAA CUGAUGAG GCCGUUAGGC CGAA ICUAGUUU | 12106 | AAACTAGC T TTTGCCAG | 5043 |
| 4334 | AUAAUACU CUGAUGAG GCCGUUAGGC CGAA ICAAAAGC | 12107 | GCTTTTGC C AGTATTAT | 5044 |
| 4335 | CAUAAUAC CUGAUGAG GCCGUUAGGC CGAA IGCAAAAG | 12108 | CTTTTGCC A GTATTATG | 5045 |
| 4345 | CUUAUAUA CUGAUGAG GCCGUUAGGC CGAA ICAUAAUA | 12109 | TATTATGC A TATATAAG | 5046 |
| 4359 | GAUAAAGG CUGAUGAG GCCGUUAGGC CGAA IUAAACUU | 12110 | AAGTTTAC A CCTTTATC | 5047 |
| 4361 | AAGAUAAA CUGAUGAG GCCGUUAGGC CGAA IUGUAAAC | 12111 | GTTTACAC C TTTATCTT | 5048 |
| 4362 | AAAGAUAA CUGAUGAG GCCGUUAGGC CGAA IGUGUAAA | 12112 | TTTACACC T TTATCTTT | 5049 |
| 4368 | CCAUGGAA CUGAUGAG GCCGUUAGGC CGAA IAUAAAGG | 12113 | CCTTTATC T TTCCATGG | 5050 |
| 4372 | GCUCCCAU CUGAUGAG GCCGUUAGGC CGAA IAAAGAUA | 12114 | TATCTTTC C ATGGGAGC | 5051 |
| 4373 | GGCUCCCA CUGAUGAG GCCGUUAGGC CGAA IGAAAGAU | 12115 | ATCTTTCC A TGGGAGCC | 5052 |
| 4381 | AAGCAGCU CUGAUGAG GCCGUUAGGC CGAA ICUCCCAU | 12116 | ATGGGAGC C AGCTGCTT | 5053 |
| 4382 | AAAGCAGC CUGAUGAG GCCGUUAGGC CGAA IGCUCCCA | 12117 | TGGGAGCC A GCTGCTTT | 5054 |
| 4385 | CAAAAAGC CUGAUGAG GCCGUUAGGC CGAA ICUGGCUC | 12118 | GAGCCAGC T GCTTTTTG | 5055 |
| 4388 | UCACAAAA CUGAUGAG GCCGUUAGGC CGAA ICAGCUGG | 12119 | CCAGCTGC T TTTTGTGA | 5056 |
| 4412 | AAAAAAAA CUGAUGAG GCCGUUAGGC CGAA ICACUAUU | 12120 | AATAGTGC T TTTTTTTT | 5057 |
| 4426 | UUCUUGUU CUGAUGAG GCCGUUAGGC CGAA IUCAAAAA | 12121 | TTTTTGAC T AACAAGAA | 5058 |
| 4430 | UACAUUCU CUGAUGAG GCCGUUAGGC CGAA IUUAGUCA | 12122 | TGACTAAC A AGAATGTA | 5059 |
| 4441 | CUAUCUGG CUGAUGAG GCCGUUAGGC CGAA IUUACAUU | 12123 | AATGTAAC T CCAGATAG | 5060 |
| 4443 | CUCUAUCU CUGAUGAG GCCGUUAGGC CGAA IAGUUACA | 12124 | TGTAACTC C AGATAGAG | 5061 |
| 4444 | UCUCUAUC CUGAUGAG GCCGUUAGGC CGAA IGAGUUAC | 12125 | GTAACTCC A GATAGAGA | 5062 |
| 4462 | UCUUCACU CUGAUGAG GCCGUUAGGC CGAA IUCACUAU | 12126 | ATAGTGAC A AGTGAAGA | 5063 |
| 4473 | AGCAGUAG CUGAUGAG GCCGUUAGGC CGAA IUUCUUCA | 12127 | TGAAGAAC A CTACTGCT | 5064 |
| 4475 | UUAGCAGU CUGAUGAG GCCGUUAGGC CGAA IUGUUCUU | 12128 | AAGAACAC T ACTGCTAA | 5065 |
| 4478 | GAUUUAGC CUGAUGAG GCCGUUAGGC CGAA IUAGUGUU | 12129 | AACACTAC T GCTAAATC | 5066 |
| 4481 | GAGGAUUU CUGAUGAG GCCGUUAGGC CGAA ICAGUAGU | 12130 | ACTACTGC T AAATCCTC | 5067 |
| 4487 | UAACAUGA CUGAUGAG GCCGUUAGGC CGAA IAUUUAGC | 12131 | GCTAAATC C TCATGTTA | 5068 |
| 4488 | GUAACAUG CUGAUGAG GCCGUUAGGC CGAA IGAUUUAG | 12132 | CTAAATCC T CATGTTAC | 5069 |
| 4490 | GAGUAACA CUGAUGAG GCCGUUAGGC CGAA IAGGAUUU | 12133 | AAATCCTC A TGTTACTC | 5070 |
| 4497 | UAACACUG CUGAUGAG GCCGUUAGGC CGAA IUAACAUG | 12134 | CATGTTAC T CAGTGTTA | 5071 |
| 4499 | UCUAACAC CUGAUGAG GCCGUUAGGC CGAA IAGUAACA | 12135 | TGTTACTC A GTGTTAGA | 5072 |
| 4514 | UUUAGGAA CUGAUGAG GCCGUUAGGC CGAA IAUUUCUC | 12136 | GAGAAATC C TTCCTAAA | 5073 |

231

| | | | | |
|---|---|---|---|---|
| 4515 | GUUUAGGA CUGAUGAG GCCGUUAGGC CGAA IGAUUUCU | 12137 | AGAAATCC T TCCTAAAC | 5074 |
| 4518 | UGGGUUUA CUGAUGAG GCCGUUAGGC CGAA IAAGGAUU | 12138 | AATCCTTC C TAAACCCA | 5075 |
| 4519 | UUGGGUUU CUGAUGAG GCCGUUAGGC CGAA IGAAGGAU | 12139 | ATCCTTCC T AAACCCAA | 5076 |
| 4524 | AGUCAUUG CUGAUGAG GCCGUUAGGC CGAA IUUUAGGA | 12140 | TCCTAAAC C CAATGACT | 5077 |
| 4525 | AAGUCAUU CUGAUGAG GCCGUUAGGC CGAA IGUUUAGG | 12141 | CCTAAACC C AATGACTT | 5078 |
| 4526 | GAAGUCAU CUGAUGAG GCCGUUAGGC CGAA IGGUUUAG | 12142 | CTAAACCC A ATGACTTC | 5079 |
| 4532 | AGCAGGGA CUGAUGAG GCCGUUAGGC CGAA IUCAUUGG | 12143 | CCAATGAC T TCCCTGCT | 5080 |
| 4535 | UGGAGCAG CUGAUGAG GCCGUUAGGC CGAA IAAGUCAU | 12144 | ATGACTTC C CTGCTCCA | 5081 |
| 4536 | UUGGAGCA CUGAUGAG GCCGUUAGGC CGAA IGAAGUCA | 12145 | TGACTTCC C TGCTCCAA | 5082 |
| 4537 | GUUGGAGC CUGAUGAG GCCGUUAGGC CGAA IGGAAGUC | 12146 | GACTTCCC T GCTCCAAC | 5083 |
| 4540 | GGGGUUGG CUGAUGAG GCCGUUAGGC CGAA ICAGGGAA | 12147 | TTCCCTGC T CCAACCCC | 5084 |
| 4542 | CGGGGGUU CUGAUGAG GCCGUUAGGC CGAA IAGCAGGG | 12148 | CCCTGCTC C AACCCCCG | 5085 |
| 4543 | GCGGGGGU CUGAUGAG GCCGUUAGGC CGAA IGAGCAGG | 12149 | CCTGCTCC A ACCCCCGC | 5086 |
| 4546 | GUGGCGGG CUGAUGAG GCCGUUAGGC CGAA IUUGGAGC | 12150 | GCTCCAAC C CCCGCCAC | 5087 |
| 4547 | GGUGGCGG CUGAUGAG GCCGUUAGGC CGAA IGUUGGAG | 12151 | CTCCAACC C CCGCCACC | 5088 |
| 4548 | AGGUGGCG CUGAUGAG GCCGUUAGGC CGAA IGGUUGGA | 12152 | TCCAACCC C CGCCACCT | 5089 |
| 4549 | GAGGUGGC CUGAUGAG GCCGUUAGGC CGAA IGGGUUGG | 12153 | CCAACCCC C GCCACCTC | 5090 |
| 4552 | CCUGAGGU CUGAUGAG GCCGUUAGGC CGAA ICGGGGGU | 12154 | ACCCCCGC C ACCTCAGG | 5091 |
| 4553 | CCCUGAGG CUGAUGAG GCCGUUAGGC CGAA IGCGGGGG | 12155 | CCCCCGCC A CCTCAGGG | 5092 |
| 4555 | UGCCCUGA CUGAUGAG GCCGUUAGGC CGAA IUGGCGGG | 12156 | CCCGCCAC C TCAGGGCA | 5093 |
| 4556 | GUGCCCUG CUGAUGAG GCCGUUAGGC CGAA IGUGGCGG | 12157 | CCGCCACC T CAGGGCAC | 5094 |
| 4558 | GCGUGCCC CUGAUGAG GCCGUUAGGC CGAA IAGGUGGC | 12158 | GCCACCTC A GGGCACGC | 5095 |
| 4563 | GUCCUGCG CUGAUGAG GCCGUUAGGC CGAA ICCCUGAG | 12159 | CTCAGGGC A CGCAGGAC | 5096 |
| 4567 | ACUGGUCC CUGAUGAG GCCGUUAGGC CGAA ICGUGCCC | 12160 | GGGCACGC A GGACCAGT | 5097 |
| 4572 | AUCAAACU CUGAUGAG GCCGUUAGGC CGAA IUCCUGCG | 12161 | CGCAGGAC C AGTTTGAT | 5098 |
| 4573 | AAUCAAAC CUGAUGAG GCCGUUAGGC CGAA IGUCCUGC | 12162 | GCAGGACC A GTTTGATT | 5099 |
| 4589 | AUCAGUGC CUGAUGAG GCCGUUAGGC CGAA ICUCCUCA | 12163 | TGAGGAGC T GCACTGAT | 5100 |
| 4592 | GUGAUCAG CUGAUGAG GCCGUUAGGC CGAA ICAGCUCC | 12164 | GGAGCTGC A CTGATCAC | 5101 |
| 4594 | GGGUGAUC CUGAUGAG GCCGUUAGGC CGAA IUGCAGCU | 12165 | AGCTGCAC T GATCACCC | 5102 |
| 4599 | GCAUUGGG CUGAUGAG GCCGUUAGGC CGAA IAUCAGUG | 12166 | CACTGATC A CCCAATGC | 5103 |
| 4601 | AUGCAUUG CUGAUGAG GCCGUUAGGC CGAA IUGAUCAG | 12167 | CTGATCAC C CAATGCAT | 5104 |
| 4602 | GAUGCAUU CUGAUGAG GCCGUUAGGC CGAA IGUGAUCA | 12168 | TGATCACC C AATGCATC | 5105 |
| 4603 | UGAUGCAU CUGAUGAG GCCGUUAGGC CGAA IGGUGAUC | 12169 | GATCACCC A ATGCATCA | 5106 |

232

| | | | | |
|---|---|---|---|---|
| 4608 | GUACGUGA CUGAUGAG GCCGUUAGGC CGAA ICAUUGGG | 12170 | CCCAATGC A TCACGTAC | 5107 |
| 4611 | GGGGUACG CUGAUGAG GCCGUUAGGC CGAA IAUGCAUU | 12171 | AATGCATC A CGTACCCC | 5108 |
| 4617 | CCCAGUGG CUGAUGAG GCCGUUAGGC CGAA IUACGUGA | 12172 | TCACGTAC C CCACTGGG | 5109 |
| 4618 | GCCCAGUG CUGAUGAG GCCGUUAGGC CGAA IGUACGUG | 12173 | CACGTACC C CACTGGGC | 5110 |
| 4619 | GGCCCAGU CUGAUGAG GCCGUUAGGC CGAA IGGUACGU | 12174 | ACGTACCC C ACTGGGCC | 5111 |
| 4620 | UGGCCCAG CUGAUGAG GCCGUUAGGC CGAA IGGGUACG | 12175 | CGTACCCC A CTGGGCCA | 5112 |
| 4622 | GCUGGCCC CUGAUGAG GCCGUUAGGC CGAA IUGGGGUA | 12176 | TACCCCAC T GGGCCAGC | 5113 |
| 4627 | GCAGGGCU CUGAUGAG GCCGUUAGGC CGAA ICCCAGUG | 12177 | CACTGGGC C AGCCCTGC | 5114 |
| 4628 | UGCAGGGC CUGAUGAG GCCGUUAGGC CGAA IGCCCAGU | 12178 | ACTGGGCC A GCCCTGCA | 5115 |
| 4631 | GGCUGCAG CUGAUGAG GCCGUUAGGC CGAA ICUGGCCC | 12179 | GGGCCAGC C CTGCAGCC | 5116 |
| 4632 | GGGCUGCA CUGAUGAG GCCGUUAGGC CGAA IGCUGGCC | 12180 | GGCCAGCC C TGCAGCCC | 5117 |
| 4633 | UGGGCUGC CUGAUGAG GCCGUUAGGC CGAA IGGCUGGC | 12181 | GCCAGCCC T GCAGCCCA | 5118 |
| 4636 | UUUUGGGC CUGAUGAG GCCGUUAGGC CGAA ICAGGGCU | 12182 | AGCCCTGC A GCCCAAAA | 5119 |
| 4639 | GGGUUUUG CUGAUGAG GCCGUUAGGC CGAA ICUGCAGG | 12183 | CCTGCAGC C CAAAACCC | 5120 |
| 4640 | UGGGUUUU CUGAUGAG GCCGUUAGGC CGAA IGCUGCAG | 12184 | CTGCAGCC C AAAACCCA | 5121 |
| 4641 | CUGGGUUU CUGAUGAG GCCGUUAGGC CGAA IGGCUGCA | 12185 | TGCAGCCC A AAACCCAG | 5122 |
| 4646 | UUGCCCUG CUGAUGAG GCCGUUAGGC CGAA IUUUUGGG | 12186 | CCCAAAAC C CAGGGCAA | 5123 |
| 4647 | GUUGCCCU CUGAUGAG GCCGUUAGGC CGAA IGUUUUGG | 12187 | CCAAAACC C AGGGCAAC | 5124 |
| 4648 | UGUUGCCC CUGAUGAG GCCGUUAGGC CGAA IGGUUUUG | 12188 | CAAAACCC A GGGCAACA | 5125 |
| 4653 | GGGCUUGU CUGAUGAG GCCGUUAGGC CGAA ICCCUGGG | 12189 | CCCAGGGC A ACAAGCCC | 5126 |
| 4656 | AACGGGCU CUGAUGAG GCCGUUAGGC CGAA IUUGCCCU | 12190 | AGGGCAAC A AGCCCGTT | 5127 |
| 4660 | GGCUAACG CUGAUGAG GCCGUUAGGC CGAA ICUUGUUG | 12191 | CAACAAGC C CGTTAGCC | 5128 |
| 4661 | GGGCUAAC CUGAUGAG GCCGUUAGGC CGAA IGCUUGUU | 12192 | AACAAGCC C GTTAGCCC | 5129 |
| 4668 | UCCCCUGG CUGAUGAG GCCGUUAGGC CGAA ICUAACGG | 12193 | CCGTTAGC C CCAGGGGA | 5130 |
| 4669 | AUCCCCUG CUGAUGAG GCCGUUAGGC CGAA IGCUAACG | 12194 | CGTTAGCC C CAGGGGAT | 5131 |
| 4670 | GAUCCCCU CUGAUGAG GCCGUUAGGC CGAA IGGCUAAC | 12195 | GTTAGCCC C AGGGGATC | 5132 |
| 4671 | UGAUCCCC CUGAUGAG GCCGUUAGGC CGAA IGGGCUAA | 12196 | TTAGCCCC A GGGGATCA | 5133 |
| 4679 | CCAGCCAG CUGAUGAG GCCGUUAGGC CGAA IAUCCCCU | 12197 | AGGGGATC A CTGGCTGG | 5134 |
| 4681 | GGCCAGCC CUGAUGAG GCCGUUAGGC CGAA IUGAUCCC | 12198 | GGGATCAC T GGCTGGCC | 5135 |
| 4685 | CUCAGGCC CUGAUGAG GCCGUUAGGC CGAA ICCAGUGA | 12199 | TCACTGGC T GGCCTGAG | 5136 |
| 4689 | GUUGCUCA CUGAUGAG GCCGUUAGGC CGAA ICCAGCCA | 12200 | TGGCTGGC C TGAGCAAC | 5137 |
| 4690 | UGUUGCUC CUGAUGAG GCCGUUAGGC CGAA IGCCAGCC | 12201 | GGCTGGCC T GAGCAACA | 5138 |
| 4695 | CGAGAUGU CUGAUGAG GCCGUUAGGC CGAA ICUCAGGC | 12202 | GCCTGAGC A ACATCTCG | 5139 |

232

| | | | | |
|---|---|---|---|---|
| 4698 | UCCCGAGA CUGAUGAG GCCGUUAGGC CGAA IUUGCUCA | 12203 | TGAGCAAC A TCTCGGGA | 5140 |
| 4701 | GACUCCCG CUGAUGAG GCCGUUAGGC CGAA IAUGUUGC | 12204 | GCAACATC T CGGGAGTC | 5141 |
| 4710 | CUGCUAGA CUGAUGAG GCCGUUAGGC CGAA IACUCCCG | 12205 | CGGGAGTC C TCTAGCAG | 5142 |
| 4711 | CCUGCUAG CUGAUGAG GCCGUUAGGC CGAA IGACUCCC | 12206 | GGGAGTCC T CTAGCAGG | 5143 |
| 4713 | GGCCUGCU CUGAUGAG GCCGUUAGGC CGAA IAGGACUC | 12207 | GAGTCCTC T AGCAGGCC | 5144 |
| 4717 | CUUAGGCC CUGAUGAG GCCGUUAGGC CGAA ICUAGAGG | 12208 | CCTCTAGC A GGCCTAAG | 5145 |
| 4721 | AUGUCUUA CUGAUGAG GCCGUUAGGC CGAA ICCUGCUA | 12209 | TAGCAGGC C TAAGACAT | 5146 |
| 4722 | CAUGUCUU CUGAUGAG GCCGUUAGGC CGAA IGCCUGCU | 12210 | AGCAGGCC T AAGACATG | 5147 |
| 4728 | UCCUCACA CUGAUGAG GCCGUUAGGC CGAA IUCUUAGG | 12211 | CCTAAGAC A TGTGAGGA | 5148 |
| 4754 | UUGCUUUU CUGAUGAG GCCGUUAGGC CGAA ICUUUUUU | 12212 | AAAAAAGC A AAAAGCAA | 5149 |
| 4761 | UUCUCCCU CUGAUGAG GCCGUUAGGC CGAA ICUUUUUG | 12213 | CAAAAAGC A AGGGAGAA | 5150 |
| 4779 | CUUCUCCC CUGAUGAG GCCGUUAGGC CGAA IUUUCUCU | 12214 | AGAGAAAC C GGGAGAAG | 5151 |
| 4790 | CUUUCUCA CUGAUGAG GCCGUUAGGC CGAA ICCUUCUC | 12215 | GAGAAGGC A TGAGAAAG | 5152 |
| 4811 | CCACAUGG CUGAUGAG GCCGUUAGGC CGAA ICGUCUCA | 12216 | TGAGACGC A CCATGTGG | 5153 |
| 4813 | GCCCACAU CUGAUGAG GCCGUUAGGC CGAA IUGCGUCU | 12217 | AGACGCAC C ATGTGGGC | 5154 |
| 4814 | UGCCCACA CUGAUGAG GCCGUUAGGC CGAA IGUGCGUC | 12218 | GACGCACC A TGTGGGCA | 5155 |
| 4822 | CCCCUCCG CUGAUGAG GCCGUUAGGC CGAA ICCCACAU | 12219 | ATGTGGGC A CGGAGGGG | 5156 |
| 4839 | CAUUGCUG CUGAUGAG GCCGUUAGGC CGAA ICCCCGUC | 12220 | GACGGGGC T CAGCAATG | 5157 |
| 4841 | GGCAUUGC CUGAUGAG GCCGUUAGGC CGAA IAGCCCCG | 12221 | CGGGGCTC A GCAATGCC | 5158 |
| 4844 | AAUGGCAU CUGAUGAG GCCGUUAGGC CGAA ICUGAGCC | 12222 | GGCTCAGC A ATGCCATT | 5159 |
| 4849 | ACUGAAAU CUGAUGAG GCCGUUAGGC CGAA ICAUUGCU | 12223 | AGCAATGC C ATTTCAGT | 5160 |
| 4850 | CACUGAAA CUGAUGAG GCCGUUAGGC CGAA IGCAUUGC | 12224 | GCAATGCC A TTTCAGTG | 5161 |
| 4855 | GAAGCCAC CUGAUGAG GCCGUUAGGC CGAA IAAAUGGC | 12225 | GCCATTTC A GTGGCTTC | 5162 |
| 4861 | AGCUGGGA CUGAUGAG GCCGUUAGGC CGAA ICCACUGA | 12226 | TCAGTGGC T TCCCAGCT | 5163 |
| 4864 | CAGAGCUG CUGAUGAG GCCGUUAGGC CGAA IAAGCCAC | 12227 | GTGGCTTC C CAGCTCTG | 5164 |
| 4865 | UCAGAGCU CUGAUGAG GCCGUUAGGC CGAA IGAAGCCA | 12228 | TGGCTTCC C AGCTCTGA | 5165 |
| 4866 | GUCAGAGC CUGAUGAG GCCGUUAGGC CGAA IGGAAGCC | 12229 | GGCTTCCC A GCTCTGAC | 5166 |
| 4869 | AGGGUCAG CUGAUGAG GCCGUUAGGC CGAA ICUGGGAA | 12230 | TTCCCAGC T CTGACCCT | 5167 |
| 4871 | GAAGGGUC CUGAUGAG GCCGUUAGGC CGAA IAGCUGGG | 12231 | CCCAGCTC T GACCCTTC | 5168 |
| 4875 | UGUAGAAG CUGAUGAG GCCGUUAGGC CGAA IUCAGAGC | 12232 | GCTCTGAC C CTTCTACA | 5169 |
| 4876 | AUGUAGAA CUGAUGAG GCCGUUAGGC CGAA IGUCAGAG | 12233 | CTCTGACC C TTCTACAT | 5170 |
| 4877 | AAUGUAGA CUGAUGAG GCCGUUAGGC CGAA IGGUCAGA | 12234 | TCTGACCC T TCTACATT | 5171 |
| 4880 | UCAAAUGU CUGAUGAG GCCGUUAGGC CGAA IAAGGGUC | 12235 | GACCCTTC T ACATTTGA | 5172 |

| | | | | |
|---|---|---|---|---|
| 4883 | CCCUCAAA CUGAUGAG GCCGUUAGGC CGAA IUAGAAGG | 12236 | CCTTCTAC A TTTGAGGG | 5173 |
| 4893 | CCUGGCUG CUGAUGAG GCCGUUAGGC CGAA ICCCUCAA | 12237 | TTGAGGGC C CAGCCAGG | 5174 |
| 4894 | UCCUGGCU CUGAUGAG GCCGUUAGGC CGAA IGCCCUCA | 12238 | TGAGGGCC C AGCCAGGA | 5175 |
| 4895 | CUCCUGGC CUGAUGAG GCCGUUAGGC CGAA IGGCCCUC | 12239 | GAGGGCCC A GCCAGGAG | 5176 |
| 4898 | CUGCUCCU CUGAUGAG GCCGUUAGGC CGAA ICUGGGCC | 12240 | GGCCCAGC C AGGAGCAG | 5177 |
| 4899 | UCUGCUCC CUGAUGAG GCCGUUAGGC CGAA IGCUGGGC | 12241 | GCCCAGCC A GGAGCAGA | 5178 |
| 4905 | UGUCCAUC CUGAUGAG GCCGUUAGGC CGAA ICUCCUGG | 12242 | CCAGGAGC A GATGGACA | 5179 |
| 4913 | CUCAUCGC CUGAUGAG GCCGUUAGGC CGAA IUCCAUCU | 12243 | AGATGGAC A GCGATGAG | 5180 |
| 4927 | CCAGAAAA CUGAUGAG GCCGUUAGGC CGAA IUCCCCUC | 12244 | GAGGGGAC A TTTTCTGG | 5181 |
| 4933 | CAGAAUCC CUGAUGAG GCCGUUAGGC CGAA IAAAAUGU | 12245 | ACATTTTC T GGATTCTG | 5182 |
| 4940 | UGCCUCCC CUGAUGAG GCCGUUAGGC CGAA IAAUCCAG | 12246 | CTGGATTC T GGGAGGCA | 5183 |
| 4948 | CCUUUUCU CUGAUGAG GCCGUUAGGC CGAA ICCUCCCA | 12247 | TGGGAGGC A AGAAAAGG | 5184 |
| 4959 | AAGAUAUU CUGAUGAG GCCGUUAGGC CGAA IUCCUUUU | 12248 | AAAAGGAC A AATATCTT | 5185 |
| 4966 | UCCAAAAA CUGAUGAG GCCGUUAGGC CGAA IAUAUUUG | 12249 | CAAATATC T TTTTTGGA | 5186 |
| 4977 | UUUGCUUU CUGAUGAG GCCGUUAGGC CGAA IUUCCAAA | 12250 | TTTGGAAC T AAAGCAAA | 5187 |
| 4983 | CUAAAAUU CUGAUGAG GCCGUUAGGC CGAA ICUUUAGU | 12251 | ACTAAAGC A AATTTTAG | 5188 |
| 4994 | UAGGUAAA CUGAUGAG GCCGUUAGGC CGAA IUCUAAAA | 12252 | TTTTAGAC C TTTACCTA | 5189 |
| 4995 | AUAGGUAA CUGAUGAG GCCGUUAGGC CGAA IGUCUAAA | 12253 | TTTAGACC T TTACCTAT | 5190 |
| 5000 | CUUCCAUA CUGAUGAG GCCGUUAGGC CGAA IUAAAGGU | 12254 | ACCTTTAC C TATGGAAG | 5191 |
| 5001 | ACUUCCAU CUGAUGAG GCCGUUAGGC CGAA IGUAAAGG | 12255 | CCTTTACC T ATGGAAGT | 5192 |
| 5015 | AUGGACAU CUGAUGAG GCCGUUAGGC CGAA IAACCACU | 12256 | AGTGGTTC T ATGTCCAT | 5193 |
| 5021 | AUGAGAAU CUGAUGAG GCCGUUAGGC CGAA IACAUAGA | 12257 | TCTATGTC C ATTCTCAT | 5194 |
| 5022 | AAUGAGAA CUGAUGAG GCCGUUAGGC CGAA IGACAUAG | 12258 | CTATGTCC A TTCTCATT | 5195 |
| 5026 | CACGAAUG CUGAUGAG GCCGUUAGGC CGAA IAAUGGAC | 12259 | GTCCATTC T CATTCGTG | 5196 |
| 5028 | GCCACGAA CUGAUGAG GCCGUUAGGC CGAA IAGAAUGG | 12260 | CCATTCTC A TTCGTGGC | 5197 |
| 5037 | UCAAAACA CUGAUGAG GCCGUUAGGC CGAA ICCACGAA | 12261 | TTCGTGGC A TGTTTTGA | 5198 |
| 5054 | ACCCUCAG CUGAUGAG GCCGUUAGGC CGAA ICUACAAA | 12262 | TTTGTAGC A CTGAGGGT | 5199 |
| 5056 | CCACCCUC CUGAUGAG GCCGUUAGGC CGAA IUGCUACA | 12263 | TGTAGCAC T GAGGGTGG | 5200 |
| 5066 | GAGUUGAG CUGAUGAG GCCGUUAGGC CGAA ICCACCCU | 12264 | AGGGTGGC A CTCAACTC | 5201 |
| 5068 | CAGAGUUG CUGAUGAG GCCGUUAGGC CGAA IUGCCACC | 12265 | GGTGGCAC T CAACTCTG | 5202 |
| 5070 | CUCAGAGU CUGAUGAG GCCGUUAGGC CGAA IAGUGCCA | 12266 | TGGCACTC A ACTCTGAG | 5203 |
| 5073 | GGGCUCAG CUGAUGAG GCCGUUAGGC CGAA IUUGAGUG | 12267 | CACTCAAC T CTGAGCCC | 5204 |
| 5075 | AUGGGCUC CUGAUGAG GCCGUUAGGC CGAA IAGUUGAG | 12268 | CTCAACTC T GAGCCCAT | 5205 |

| | | | | |
|---|---|---|---|---|
| 5080 | AAAGUAUG CUGAUGAG GCCGUUAGGC CGAA ICUCAGAG | 12269 | CTCTGAGC C CATACTTT | 5206 |
| 5081 | AAAAGUAU CUGAUGAG GCCGUUAGGC CGAA IGCUCAGA | 12270 | TCTGAGCC C ATACTTTT | 5207 |
| 5082 | CAAAAGUA CUGAUGAG GCCGUUAGGC CGAA IGGCUCAG | 12271 | CTGAGCCC A TACTTTTG | 5208 |
| 5086 | GAGCCAAA CUGAUGAG GCCGUUAGGC CGAA IUAUGGGC | 12272 | GCCCATAC T TTTGGCTC | 5209 |
| 5093 | ACUAGAGG CUGAUGAG GCCGUUAGGC CGAA ICCAAAAG | 12273 | CTTTTGGC T CCTCTAGT | 5210 |
| 5095 | UUACUAGA CUGAUGAG GCCGUUAGGC CGAA IAGCCAAA | 12274 | TTTGGCTC C TCTAGTAA | 5211 |
| 5096 | CUUACUAG CUGAUGAG GCCGUUAGGC CGAA IGAGCCAA | 12275 | TTGGCTCC T CTAGTAAG | 5212 |
| 5098 | AUCUUACU CUGAUGAG GCCGUUAGGC CGAA IAGGAGCC | 12276 | GGCTCCTC T AGTAAGAT | 5213 |
| 5109 | GUUUUCAG CUGAUGAG GCCGUUAGGC CGAA ICAUCUUA | 12277 | TAAGATGC A CTGAAAAC | 5214 |
| 5111 | AAGUUUUC CUGAUGAG GCCGUUAGGC CGAA IUGCAUCU | 12278 | AGATGCAC T GAAAACTT | 5215 |
| 5118 | UCUGGCUA CUGAUGAG GCCGUUAGGC CGAA IUUUUCAG | 12279 | CTGAAAAC T TAGCCAGA | 5216 |
| 5123 | CUAACUCU CUGAUGAG GCCGUUAGGC CGAA ICUAAGUU | 12280 | AACTTAGC C AGAGTTAG | 5217 |
| 5124 | CCUAACUC CUGAUGAG GCCGUUAGGC CGAA IGCUAAGU | 12281 | ACTTAGCC A GAGTTAGG | 5218 |
| 5138 | UGGCCUGG CUGAUGAG GCCGUUAGGC CGAA IACAACCU | 12282 | AGGTTGTC T CCAGGCCA | 5219 |
| 5140 | CAUGGCCU CUGAUGAG GCCGUUAGGC CGAA IAGACAAC | 12283 | GTTGTCTC C AGGCCATG | 5220 |
| 5141 | UCAUGGCC CUGAUGAG GCCGUUAGGC CGAA IGAGACAA | 12284 | TTGTCTCC A GGCCATGA | 5221 |
| 5145 | GCCAUCAU CUGAUGAG GCCGUUAGGC CGAA ICCUGGAG | 12285 | CTCCAGGC C ATGATGGC | 5222 |
| 5146 | GGCCAUCA CUGAUGAG GCCGUUAGGC CGAA IGCCUGGA | 12286 | TCCAGGCC A TGATGGCC | 5223 |
| 5154 | CAGUGUAA CUGAUGAG GCCGUUAGGC CGAA ICCAUCAU | 12287 | ATGATGGC C TTACACTG | 5224 |
| 5155 | UCAGUGUA CUGAUGAG GCCGUUAGGC CGAA IGCCAUCA | 12288 | TGATGGCC T TACACTGA | 5225 |
| 5159 | AUUUUCAG CUGAUGAG GCCGUUAGGC CGAA IUAAGGCC | 12289 | GGCCTTAC A CTGAAAAT | 5226 |
| 5161 | ACAUUUUC CUGAUGAG GCCGUUAGGC CGAA IUGUAAGG | 12290 | CCTTACAC T GAAAATGT | 5227 |
| 5171 | AUAGAAUG CUGAUGAG GCCGUUAGGC CGAA IACAUUUU | 12291 | AAAATGTC A CATTCTAT | 5228 |
| 5173 | AAAUAGAA CUGAUGAG GCCGUUAGGC CGAA IUGACAUU | 12292 | AATGTCAC A TTCTATTT | 5229 |
| 5177 | CCCAAAAU CUGAUGAG GCCGUUAGGC CGAA IAAUGUGA | 12293 | TCACATTC T ATTTTGGG | 5230 |
| 5201 | AAGUGUCU CUGAUGAG GCCGUUAGGC CGAA IACUAUAU | 12294 | ATATAGTC C AGACACTT | 5231 |
| 5202 | UAAGUGUC CUGAUGAG GCCGUUAGGC CGAA IGACUAUA | 12295 | TATAGTCC A GACACTTA | 5232 |
| 5206 | GAGUUAAG CUGAUGAG GCCGUUAGGC CGAA IUCUGGAC | 12296 | GTCCAGAC A CTTAACTC | 5233 |
| 5208 | UUGAGUUA CUGAUGAG GCCGUUAGGC CGAA IUGUCUGG | 12297 | CCAGACAC T TAACTCAA | 5234 |
| 5213 | AGAAAUUG CUGAUGAG GCCGUUAGGC CGAA IUUAAGUG | 12298 | CACTTAAC T CAATTTCT | 5235 |
| 5215 | CAAGAAAU CUGAUGAG GCCGUUAGGC CGAA IAGUUAAG | 12299 | CTTAACTC A ATTTCTTG | 5236 |
| 5221 | UAAUACCA CUGAUGAG GCCGUUAGGC CGAA IAAAUUGA | 12300 | TCAATTTC T TGGTATTA | 5237 |
| 5233 | UGCAAAAC CUGAUGAG GCCGUUAGGC CGAA IAAUAAUA | 12301 | TATTATTC T GTTTTGCA | 5238 |

| | | | | |
|---|---|---|---|---|
| 5241 | ACUAACUG CUGAUGAG GCCGUUAGGC CGAA ICAAAACA | 12302 | TGTTTTGC A CAGTTAGT | 5239 |
| 5243 | CAACUAAC CUGAUGAG GCCGUUAGGC CGAA IUGCAAAA | 12303 | TTTTGCAC A GTTAGTTG | 5240 |
| 5263 | UUCUUCUC CUGAUGAG GCCGUUAGGC CGAA ICUUUCUU | 12304 | AAGAAAGC T GAGAAGAA | 5241 |
| 5281 | CUCAGGAC CUGAUGAG GCCGUUAGGC CGAA ICAUUUUC | 12305 | GAAAATGC A GTCCTGAG | 5242 |
| 5285 | UCUCCUCA CUGAUGAG GCCGUUAGGC CGAA IACUGCAU | 12306 | ATGCAGTC C TGAGGAGA | 5243 |
| 5286 | CUCUCCUC CUGAUGAG GCCGUUAGGC CGAA IGACUGCA | 12307 | TGCAGTCC T GAGGAGAG | 5244 |
| 5300 | UGAUAUGG CUGAUGAG GCCGUUAGGC CGAA IAAAACUC | 12308 | GAGTTTTC T CCATATCA | 5245 |
| 5302 | UUUGAUAU CUGAUGAG GCCGUUAGGC CGAA IAGAAAAC | 12309 | GTTTTCTC C ATATCAAA | 5246 |
| 5303 | UUUUGAUA CUGAUGAG GCCGUUAGGC CGAA IGAGAAAA | 12310 | TTTTCTCC A TATCAAAA | 5247 |
| 5308 | CCUCGUUU CUGAUGAG GCCGUUAGGC CGAA IAUAUGGA | 12311 | TCCATATC A AAACGAGG | 5248 |
| 5319 | CCUCCAUC CUGAUGAG GCCGUUAGGC CGAA ICCCUCGU | 12312 | ACGAGGGC T GATGGAGG | 5249 |
| 5337 | GACCUUAU CUGAUGAG GCCGUUAGGC CGAA IACCUUUU | 12313 | AAAAGGTC A ATAAGGTC | 5250 |
| 5346 | UCUUCCCU CUGAUGAG GCCGUUAGGC CGAA IACCUUAU | 12314 | ATAAGGTC A AGGGAAGA | 5251 |
| 5356 | AGAGACGG CUGAUGAG GCCGUUAGGC CGAA IUCUUCCC | 12315 | GGGAAGAC C CCGTCTCT | 5252 |
| 5357 | UAGAGACG CUGAUGAG GCCGUUAGGC CGAA IGUCUUCC | 12316 | GGAAGACC C CGTCTCTA | 5253 |
| 5358 | AUAGAGAC CUGAUGAG GCCGUUAGGC CGAA IGGUCUUC | 12317 | GAAGACCC C GTCTCTAT | 5254 |
| 5362 | UGGUAUAG CUGAUGAG GCCGUUAGGC CGAA IACGGGGU | 12318 | ACCCCGTC T CTATACCA | 5255 |
| 5364 | GUUGGUAU CUGAUGAG GCCGUUAGGC CGAA IAGACGGG | 12319 | CCCGTCTC T ATACCAAC | 5256 |
| 5369 | GUUUGGUU CUGAUGAG GCCGUUAGGC CGAA IUAUAGAG | 12320 | CTCTATAC C AACCAAAC | 5257 |
| 5370 | GGUUUGGU CUGAUGAG GCCGUUAGGC CGAA IGUAUAGA | 12321 | TCTATACC A ACCAAACC | 5258 |
| 5373 | AUUGGUUU CUGAUGAG GCCGUUAGGC CGAA IUUGGUAU | 12322 | ATACCAAC C AAACCAAT | 5259 |
| 5374 | AAUUGGUU CUGAUGAG GCCGUUAGGC CGAA IGUUGGUA | 12323 | TACCAACC A AACCAATT | 5260 |
| 5378 | GGUGAAUU CUGAUGAG GCCGUUAGGC CGAA IUUUGGUU | 12324 | AACCAAAC C AATTCACC | 5261 |
| 5379 | UGGUGAAU CUGAUGAG GCCGUUAGGC CGAA IGUUUGGU | 12325 | ACCAAACC A ATTCACCA | 5262 |
| 5384 | UGUGUUGG CUGAUGAG GCCGUUAGGC CGAA IAAUUGGU | 12326 | ACCAATTC A CCAACACA | 5263 |
| 5386 | ACUGUGUU CUGAUGAG GCCGUUAGGC CGAA IUGAAUUG | 12327 | CAATTCAC C AACACAGT | 5264 |
| 5387 | AACUGUGU CUGAUGAG GCCGUUAGGC CGAA IGUGAAUU | 12328 | AATTCACC A ACACAGTT | 5265 |
| 5390 | CCCAACUG CUGAUGAG GCCGUUAGGC CGAA IUUGGUGA | 12329 | TCACCAAC A CAGTTGGG | 5266 |
| 5392 | GUCCCAAC CUGAUGAG GCCGUUAGGC CGAA IUGUUGGU | 12330 | ACCAACAC A GTTGGGAC | 5267 |
| 5401 | GUGUUUUG CUGAUGAG GCCGUUAGGC CGAA IUCCCAAC | 12331 | GTTGGGAC C CAAAACAC | 5268 |
| 5402 | UGUGUUUU CUGAUGAG GCCGUUAGGC CGAA IGUCCCAA | 12332 | TTGGGACC C AAAACACA | 5269 |
| 5403 | CUGUGUUU CUGAUGAG GCCGUUAGGC CGAA IGGUCCCA | 12333 | TGGGACCC A AAACACAG | 5270 |
| 5408 | ACUUCCUG CUGAUGAG GCCGUUAGGC CGAA IUUUUGGG | 12334 | CCCAAAAC A CAGGAAGT | 5271 |

237

| | | | | |
|---|---|---|---|---|
| 5410 | UGACUUCC CUGAUGAG GCCGUUAGGC CGAA IUGUUUUG | 12335 | CAAAACAC A GGAAGTCA | 5272 |
| 5418 | AACGUGAC CUGAUGAG GCCGUUAGGC CGAA IACUUCCU | 12336 | AGGAAGTC A GTCACGTT | 5273 |
| 5422 | AGGAAACG CUGAUGAG GCCGUUAGGC CGAA IACUGACU | 12337 | AGTCAGTC A CGTTTCCT | 5274 |
| 5429 | AAUGAAAA CUGAUGAG GCCGUUAGGC CGAA IAAACGUG | 12338 | CACGTTTC C TTTTCATT | 5275 |
| 5430 | AAAUGAAA CUGAUGAG GCCGUUAGGC CGAA IGAAACGU | 12339 | ACGTTTCC T TTTCATTT | 5276 |
| 5435 | CCAUUAAA CUGAUGAG GCCGUUAGGC CGAA IAAAAGGA | 12340 | TCCTTTTC A TTTAATGG | 5277 |
| 5450 | GAGAUAGU CUGAUGAG GCCGUUAGGC CGAA IAAUCCCC | 12341 | GGGGATTC C ACTATCTC | 5278 |
| 5451 | UGAGAUAG CUGAUGAG GCCGUUAGGC CGAA IGAAUCCC | 12342 | GGGATTCC A CTATCTCA | 5279 |
| 5453 | UGUGAGAU CUGAUGAG GCCGUUAGGC CGAA IUGGAAUC | 12343 | GATTCCAC T ATCTCACA | 5280 |
| 5457 | UUAGUGUG CUGAUGAG GCCGUUAGGC CGAA IAUAGUGG | 12344 | CCACTATC T CACACTAA | 5281 |
| 5459 | GAUUAGUG CUGAUGAG GCCGUUAGGC CGAA IAGAUAGU | 12345 | ACTATCTC A CACTAATC | 5282 |
| 5461 | CAGAUUAG CUGAUGAG GCCGUUAGGC CGAA IUGAGAUA | 12346 | TATCTCAC A CTAATCTG | 5283 |
| 5463 | UUCAGAUU CUGAUGAG GCCGUUAGGC CGAA IUGUGAGA | 12347 | TCTCACAC T AATCTGAA | 5284 |
| 5468 | AUCCUUUC CUGAUGAG GCCGUUAGGC CGAA IAUUAGUG | 12348 | CACTAATC T GAAAGGAT | 5285 |
| 5487 | CCAGCUAA CUGAUGAG GCCGUUAGGC CGAA ICUCUUCC | 12349 | GGAAGAGC A TTAGCTGG | 5286 |
| 5493 | UAUGCGCC CUGAUGAG GCCGUUAGGC CGAA ICUAAUGC | 12350 | GCATTAGC T GGCGCATA | 5287 |
| 5499 | GCUUAAUA CUGAUGAG GCCGUUAGGC CGAA ICGCCAGC | 12351 | GCTGGCGC A TATTAAGC | 5288 |
| 5508 | GCUUAAAG CUGAUGAG GCCGUUAGGC CGAA ICUUAAUA | 12352 | TATTAAGC A CTTTAAGC | 5289 |
| 5510 | GAGCUUAA CUGAUGAG GCCGUUAGGC CGAA IUGCUUAA | 12353 | TTAAGCAC T TTAAGCTC | 5290 |
| 5517 | ACUCAAGG CUGAUGAG GCCGUUAGGC CGAA ICUUAAAG | 12354 | CTTTAAGC T CCTTGAGT | 5291 |
| 5519 | UUACUCAA CUGAUGAG GCCGUUAGGC CGAA IAGCUUAA | 12355 | TTAAGCTC C TTGAGTAA | 5292 |
| 5520 | UUUACUCA CUGAUGAG GCCGUUAGGC CGAA IGAGCUUA | 12356 | TAAGCTCC T TGAGTAAA | 5293 |
| 5550 | AAAUACCU CUGAUGAG GCCGUUAGGC CGAA ICAUAAAU | 12357 | ATTTATGC A AGGTATTT | 5294 |
| 5560 | CCAACUGG CUGAUGAG GCCGUUAGGC CGAA IAAAUACC | 12358 | GGTATTTC T CCAGTTGG | 5295 |
| 5562 | UCCCAACU CUGAUGAG GCCGUUAGGC CGAA IAGAAAUA | 12359 | TATTTCTC C AGTTGGGA | 5296 |
| 5563 | GUCCCAAC CUGAUGAG GCCGUUAGGC CGAA IGAGAAAU | 12360 | ATTTCTCC A GTTGGGAC | 5297 |
| 5572 | AUAUCCUG CUGAUGAG GCCGUUAGGC CGAA IUCCCAAC | 12361 | GTTGGGAC T CAGGATAT | 5298 |
| 5574 | UAAUAUCC CUGAUGAG GCCGUUAGGC CGAA IAGUCCCA | 12362 | TGGGACTC A GGATATTA | 5299 |
| 5593 | CUAGUGAU CUGAUGAG GCCGUUAGGC CGAA ICUCAUUA | 12363 | TAATGAGC C ATCACTAG | 5300 |
| 5594 | UCUAGUGA CUGAUGAG GCCGUUAGGC CGAA IGCUCAUU | 12364 | AATGAGCC A TCACTAGA | 5301 |
| 5597 | UCUUCUAG CUGAUGAG GCCGUUAGGC CGAA IAUGGCUC | 12365 | GAGCCATC A CTAGAAGA | 5302 |
| 5599 | UUUCUUCU CUGAUGAG GCCGUUAGGC CGAA IUGAUGGC | 12366 | GCCATCAC T AGAAGAAA | 5303 |
| 5611 | UGAAAAUG CUGAUGAG GCCGUUAGGC CGAA ICUUUUCU | 12367 | AGAAAAGC C CATTTTCA | 5304 |

| | | | | |
|---|---|---|---|---|
| 5612 | UUGAAAAU CUGAUGAG GCCGUUAGGC CGAA IGCUUUUC | 12368 | GAAAAGCC C ATTTTCAA | 5305 |
| 5613 | GUUGAAAA CUGAUGAG GCCGUUAGGC CGAA IGGCUUUU | 12369 | AAAAGCCC A TTTTCAAC | 5306 |
| 5619 | AAAGCAGU CUGAUGAG GCCGUUAGGC CGAA IAAAAUGG | 12370 | CCATTTTC A ACTGCTTT | 5307 |
| 5622 | UUCAAAGC CUGAUGAG GCCGUUAGGC CGAA IUUGAAAA | 12371 | TTTTCAAC T GCTTTGAA | 5308 |
| 5625 | AGUUUCAA CUGAUGAG GCCGUUAGGC CGAA ICAGUUGA | 12372 | TCAACTGC T TTGAAACT | 5309 |
| 5633 | CCCAGGCA CUGAUGAG GCCGUUAGGC CGAA IUUUCAAA | 12373 | TTTGAAAC T TGCCTGGG | 5310 |
| 5637 | AGACCCCA CUGAUGAG GCCGUUAGGC CGAA ICAAGUUU | 12374 | AAACTTGC C TGGGGTCT | 5311 |
| 5638 | CAGACCCC CUGAUGAG GCCGUUAGGC CGAA IGCAAGUU | 12375 | AACTTGCC T GGGGTCTG | 5312 |
| 5645 | UCAUGCUC CUGAUGAG GCCGUUAGGC CGAA IACCCCAG | 12376 | CTGGGGTC T GAGCATGA | 5313 |
| 5650 | UCCCAUCA CUGAUGAG GCCGUUAGGC CGAA ICUCAGAC | 12377 | GTCTGAGC A TGATGGGA | 5314 |
| 5669 | UCCUACCC CUGAUGAG GCCGUUAGGC CGAA IUCUCCCU | 12378 | AGGGAGAC A GGGTAGGA | 5315 |
| 5686 | GAAGAGUA CUGAUGAG GCCGUUAGGC CGAA ICGCCCUU | 12379 | AAGGGCGC C TACTCTTC | 5316 |
| 5687 | UGAAGAGU CUGAUGAG GCCGUUAGGC CGAA IGCGCCCU | 12380 | AGGGCGCC T ACTCTTCA | 5317 |
| 5690 | CCCUGAAG CUGAUGAG GCCGUUAGGC CGAA IUAGGCGC | 12381 | GCGCCTAC T CTTCAGGG | 5318 |
| 5692 | GACCCUGA CUGAUGAG GCCGUUAGGC CGAA IAGUAGGC | 12382 | GCCTACTC T TCAGGGTC | 5319 |
| 5695 | UUAGACCC CUGAUGAG GCCGUUAGGC CGAA IAAGAGUA | 12383 | TACTCTTC A GGGTCTAA | 5320 |
| 5701 | UGAUCUUU CUGAUGAG GCCGUUAGGC CGAA IACCCUGA | 12384 | TCAGGGTC T AAAGATCA | 5321 |
| 5709 | GGCCCACU CUGAUGAG GCCGUUAGGC CGAA IAUCUUUA | 12385 | TAAAGATC A AGTGGGCC | 5322 |
| 5717 | CGAUCCAA CUGAUGAG GCCGUUAGGC CGAA ICCCACUU | 12386 | AAGTGGGC C TTGGATCG | 5323 |
| 5718 | GCGAUCCA CUGAUGAG GCCGUUAGGC CGAA IGCCCACU | 12387 | AGTGGGCC T TGGATCGC | 5324 |
| 5727 | GCCAGCUU CUGAUGAG GCCGUUAGGC CGAA ICGAUCCA | 12388 | TGGATCGC T AAGCTGGC | 5325 |
| 5732 | ACAGAGCC CUGAUGAG GCCGUUAGGC CGAA ICUUAGCG | 12389 | CGCTAAGC T GGCTCTGT | 5326 |
| 5736 | UCAAACAG CUGAUGAG GCCGUUAGGC CGAA ICCAGCUU | 12390 | AAGCTGGC T CTGTTTGA | 5327 |
| 5738 | CAUCAAAC CUGAUGAG GCCGUUAGGC CGAA IAGCCAGC | 12391 | GCTGGCTC T GTTTGATG | 5328 |
| 5748 | GCAUAAAU CUGAUGAG GCCGUUAGGC CGAA ICAUCAAA | 12392 | TTTGATGC T ATTTATGC | 5329 |
| 5757 | CCCUAACU CUGAUGAG GCCGUUAGGC CGAA ICAUAAAU | 12393 | ATTTATGC A AGTTAGGG | 5330 |
| 5768 | AAAUACAU CUGAUGAG GCCGUUAGGC CGAA IACCCUAA | 12394 | TTAGGGTC T ATGTATTT | 5331 |
| 5786 | GAAGAGUA CUGAUGAG GCCGUUAGGC CGAA ICGCAUCC | 12395 | GGATGCGC C TACTCTTC | 5332 |
| 5787 | UGAAGAGU CUGAUGAG GCCGUUAGGC CGAA IGCGCAUC | 12396 | GATGCGCC T ACTCTTCA | 5333 |
| 5790 | CCCUGAAG CUGAUGAG GCCGUUAGGC CGAA IUAGGCGC | 12381 | GCGCCTAC T CTTCAGGG | 5318 |
| 5792 | GACCCUGA CUGAUGAG GCCGUUAGGC CGAA IAGUAGGC | 12382 | GCCTACTC T TCAGGGTC | 5319 |
| 5795 | UUAGACCC CUGAUGAG GCCGUUAGGC CGAA IAAGAGUA | 12383 | TACTCTTC A GGGTCTAA | 5320 |
| 5801 | UGAUCUUU CUGAUGAG GCCGUUAGGC CGAA IACCCUGA | 12384 | TCAGGGTC T AAAGATCA | 5321 |

| | | | | |
|---|---|---|---|---|
| 5809 | GGCCCACU CUGAUGAG GCCGUUAGGC CGAA IAUCUUUA | 12385 | TAAAGATC A AGTGGGCC | 5322 |
| 5817 | CGAUCCAA CUGAUGAG GCCGUUAGGC CGAA ICCCACUU | 12386 | AAGTGGGC C TTGGATCG | 5323 |
| 5818 | GCGAUCCA CUGAUGAG GCCGUUAGGC CGAA IGCCCACU | 12387 | AGTGGGCC T TGGATCGC | 5324 |
| 5827 | GCCAGCUU CUGAUGAG GCCGUUAGGC CGAA ICGAUCCA | 12388 | TGGATCGC T AAGCTGGC | 5325 |
| 5832 | ACAGAGCC CUGAUGAG GCCGUUAGGC CGAA ICUUAGCG | 12389 | CGCTAAGC T GGCTCTGT | 5326 |
| 5836 | UCAAACAG CUGAUGAG GCCGUUAGGC CGAA ICCAGCUU | 12390 | AAGCTGGC T CTGTTTGA | 5327 |
| 5838 | CAUCAAAC CUGAUGAG GCCGUUAGGC CGAA IAGCCAGC | 12391 | GCTGGCTC T GTTTGATG | 5328 |
| 5848 | GCAUAAAU CUGAUGAG GCCGUUAGGC CGAA ICAUCAAA | 12392 | TTTGATGC T ATTTATGC | 5329 |
| 5857 | CCCUAACU CUGAUGAG GCCGUUAGGC CGAA ICAUAAAU | 12393 | ATTTATGC A AGTTAGGG | 5330 |
| 5868 | AAAUACAU CUGAUGAG GCCGUUAGGC CGAA IACCCUAA | 12394 | TTAGGGTC T ATGTATTT | 5331 |
| 5885 | GAAGGUGC CUGAUGAG GCCGUUAGGC CGAA IACAUCCU | 12397 | AGGATGTC T GCACCTTC | 5334 |
| 5888 | GCAGAAGG CUGAUGAG GCCGUUAGGC CGAA ICAGACAU | 12398 | ATGTCTGC A CCTTCTGC | 5335 |
| 5890 | CUGCAGAA CUGAUGAG GCCGUUAGGC CGAA IUGCAGAC | 12399 | GTCTGCAC C TTCTGCAG | 5336 |
| 5891 | GCUGCAGA CUGAUGAG GCCGUUAGGC CGAA IGUGCAGA | 12400 | TCTGCACC T TCTGCAGC | 5337 |
| 5894 | CUGGCUGC CUGAUGAG GCCGUUAGGC CGAA IAAGGUGC | 12401 | GCACCTTC T GCAGCCAG | 5338 |
| 5897 | UGACUGGC CUGAUGAG GCCGUUAGGC CGAA ICAGAAGG | 12402 | CCTTCTGC A GCCAGTCA | 5339 |
| 5900 | UUCUGACU CUGAUGAG GCCGUUAGGC CGAA ICUGCAGA | 12403 | TCTGCAGC C AGTCAGAA | 5340 |
| 5901 | CUUCUGAC CUGAUGAG GCCGUUAGGC CGAA IGCUGCAG | 12404 | CTGCAGCC A GTCAGAAG | 5341 |
| 5905 | CCAGCUUC CUGAUGAG GCCGUUAGGC CGAA IACUGGCU | 12405 | AGCCAGTC A GAAGCTGG | 5342 |
| 5911 | GCCUCUCC CUGAUGAG GCCGUUAGGC CGAA ICUUCUGA | 12406 | TCAGAAGC T GGAGAGGC | 5343 |
| 5920 | UCCACUGU CUGAUGAG GCCGUUAGGC CGAA ICCUCUCC | 12407 | GGAGAGGC A ACAGTGGA | 5344 |
| 5923 | CAAUCCAC CUGAUGAG GCCGUUAGGC CGAA IUUGCCUC | 12408 | GAGGCAAC A GTGGATTG | 5345 |
| 5933 | CAAGAAGC CUGAUGAG GCCGUUAGGC CGAA ICAAUCCA | 12409 | TGGATTGC T GCTTCTTG | 5346 |
| 5936 | CCCCAAGA CUGAUGAG GCCGUUAGGC CGAA ICAGCAAU | 12410 | ATTGCTGC T TCTTGGGG | 5347 |
| 5939 | UCUCCCCA CUGAUGAG GCCGUUAGGC CGAA IAAGCAGC | 12411 | GCTGCTTC T TGGGGAGA | 5348 |
| 5957 | UAAAAGGA CUGAUGAG GCCGUUAGGC CGAA ICAUACUC | 12412 | GAGTATGC T TCCTTTTA | 5349 |
| 5960 | GGAUAAAA CUGAUGAG GCCGUUAGGC CGAA IAAGCAUA | 12413 | TATGCTTC C TTTTATCC | 5350 |
| 5961 | UGGAUAAA CUGAUGAG GCCGUUAGGC CGAA IGAAGCAU | 12414 | ATGCTTCC T TTTATCCA | 5351 |
| 5968 | AAUUACAU CUGAUGAG GCCGUUAGGC CGAA IAUAAAAG | 12415 | CTTTTATC C ATGTAATT | 5352 |
| 5969 | AAAUUACA CUGAUGAG GCCGUUAGGC CGAA IGAUAAAA | 12416 | TTTTATCC A TGTAATTT | 5353 |
| 5981 | GGUUCUAC CUGAUGAG GCCGUUAGGC CGAA IUUAAAUU | 12417 | AATTTAAC T GTAGAACC | 5354 |
| 5989 | AGAGCUCA CUGAUGAG GCCGUUAGGC CGAA IUUCUACA | 12418 | TGTAGAAC C TGAGCTCT | 5355 |
| 5990 | UAGAGCUC CUGAUGAG GCCGUUAGGC CGAA IGUUCUAC | 12419 | GTAGAACC T GAGCTCTA | 5356 |

240

| | | | | |
|---|---|---|---|---|
| 5995 | UUACUUAG CUGAUGAG GCCGUUAGGC CGAA ICUCAGGU | 12420 | ACCTGAGC T CTAAGTAA | 5357 |
| 5997 | GGUUACUU CUGAUGAG GCCGUUAGGC CGAA IAGCUCAG | 12421 | CTGAGCTC T AAGTAACC | 5358 |
| 6005 | CAUUCUUC CUGAUGAG GCCGUUAGGC CGAA IUUACUUA | 12422 | TAAGTAAC C GAAGAATG | 5359 |
| 6019 | AGAACAGA CUGAUGAG GCCGUUAGGC CGAA ICAUACAU | 12423 | ATGTATGC C TCTGTTCT | 5360 |
| 6020 | AAGAACAG CUGAUGAG GCCGUUAGGC CGAA IGCAUACA | 12424 | TGTATGCC T CTGTTCTT | 5361 |
| 6022 | AUAAGAAC CUGAUGAG GCCGUUAGGC CGAA IAGGCAUA | 12425 | TATGCCTC T GTTCTTAT | 5362 |
| 6027 | GGCACAUA CUGAUGAG GCCGUUAGGC CGAA IAACAGAG | 12426 | CTCTGTTC T TATGTGCC | 5363 |
| 6035 | AAGGAUGU CUGAUGAG GCCGUUAGGC CGAA ICACAUAA | 12427 | TTATGTGC C ACATCCTT | 5364 |
| 6036 | CAAGGAUG CUGAUGAG GCCGUUAGGC CGAA IGCACAUA | 12428 | TATGTGCC A CATCCTTG | 5365 |
| 6038 | AACAAGGA CUGAUGAG GCCGUUAGGC CGAA IUGGCACA | 12429 | TGTGCCAC A TCCTTGTT | 5366 |
| 6041 | UUAAACAA CUGAUGAG GCCGUUAGGC CGAA IAUGUGGC | 12430 | GCCACATC C TTGTTTAA | 5367 |
| 6042 | UUUAAACA CUGAUGAG GCCGUUAGGC CGAA IGAUGUGG | 12431 | CCACATCC T TGTTTAAA | 5368 |
| 6054 | AUACAGAG CUGAUGAG GCCGUUAGGC CGAA ICCUUUAA | 12432 | TTAAAGGC T CTCTGTAT | 5369 |
| 6056 | UCAUACAG CUGAUGAG GCCGUUAGGC CGAA IAGCCUUU | 12433 | AAAGGCTC T CTGTATGA | 5370 |
| 6058 | CUUCAUAC CUGAUGAG GCCGUUAGGC CGAA IAGAGCCU | 12434 | AGGCTCTC T GTATGAAG | 5371 |
| 6076 | CUGAUGAC CUGAUGAG GCCGUUAGGC CGAA IUCCCAUC | 12435 | GATGGGAC C GTCATCAG | 5372 |
| 6080 | UGUGCUGA CUGAUGAG GCCGUUAGGC CGAA IACGGUCC | 12436 | GGACCGTC A TCAGCACA | 5373 |
| 6083 | GAAUGUGC CUGAUGAG GCCGUUAGGC CGAA IAUGACGG | 12437 | CCGTCATC A GCACATTC | 5374 |
| 6086 | AGGGAAUG CUGAUGAG GCCGUUAGGC CGAA ICUGAUGA | 12438 | TCATCAGC A CATTCCCT | 5375 |
| 6088 | CUAGGGAA CUGAUGAG GCCGUUAGGC CGAA IUGCUGAU | 12439 | ATCAGCAC A TTCCCTAG | 5376 |
| 6092 | CUCACUAG CUGAUGAG GCCGUUAGGC CGAA IAAUGUGC | 12440 | GCACATTC C CTAGTGAG | 5377 |
| 6093 | GCUCACUA CUGAUGAG GCCGUUAGGC CGAA IGAAUGUG | 12441 | CACATTCC C TAGTGAGC | 5378 |
| 6094 | GGCUCACU CUGAUGAG GCCGUUAGGC CGAA IGGAAUGU | 12442 | ACATTCCC T AGTGAGCC | 5379 |
| 6102 | AGCCAGUA CUGAUGAG GCCGUUAGGC CGAA ICUCACUA | 12443 | TAGTGAGC C TACTGGCT | 5380 |
| 6103 | GAGCCAGU CUGAUGAG GCCGUUAGGC CGAA IGCUCACU | 12444 | AGTGAGCC T ACTGGCTC | 5381 |
| 6106 | CAGGAGCC CUGAUGAG GCCGUUAGGC CGAA IUAGGCUC | 12445 | GAGCCTAC T GGCTCCTG | 5382 |
| 6110 | CUGCCAGG CUGAUGAG GCCGUUAGGC CGAA ICCAGUAG | 12446 | CTACTGGC T CCTGGCAG | 5383 |
| 6112 | CGCUGCCA CUGAUGAG GCCGUUAGGC CGAA IAGCCAGU | 12447 | ACTGGCTC C TGGCAGCG | 5384 |
| 6113 | CCGCUGCC CUGAUGAG GCCGUUAGGC CGAA IGAGCCAG | 12448 | CTGGCTCC T GGCAGCGG | 5385 |
| 6117 | AAAGCCGC CUGAUGAG GCCGUUAGGC CGAA ICCAGGAG | 12449 | CTCCTGGC A GCGGCTTT | 5386 |
| 6123 | UCCACAAA CUGAUGAG GCCGUUAGGC CGAA ICCGCUGC | 12450 | GCAGCGGC T TTTGTGGA | 5387 |
| 6136 | GGCUAGUG CUGAUGAG GCCGUUAGGC CGAA IUCUUCCA | 12451 | TGGAAGAC T CACTAGCC | 5388 |
| 6138 | CUGGCUAG CUGAUGAG GCCGUUAGGC CGAA IAGUCUUC | 12452 | GAAGACTC A CTAGCCAG | 5389 |

240

| | | | | |
|---|---|---|---|---|
| 6140 | UUCUGGCU CUGAUGAG GCCGUUAGGC CGAA IUGAGUCU | 12453 | AGACTCAC T AGCCAGAA | 5390 |
| 6144 | UCUCUUCU CUGAUGAG GCCGUUAGGC CGAA ICUAGUGA | 12454 | TCACTAGC C AGAAGAGA | 5391 |
| 6145 | CUCUCUUC CUGAUGAG GCCGUUAGGC CGAA IGCUAGUG | 12455 | CACTAGCC A GAAGAGAG | 5392 |
| 6163 | GAGAGGAC CUGAUGAG GCCGUUAGGC CGAA IUCCCACU | 12456 | AGTGGGAC A GTCCTCTC | 5393 |
| 6167 | GGUGGAGA CUGAUGAG GCCGUUAGGC CGAA IACUGUCC | 12457 | GGACAGTC C TCTCCACC | 5394 |
| 6168 | UGGUGGAG CUGAUGAG GCCGUUAGGC CGAA IGACUGUC | 12458 | GACAGTCC T CTCCACCA | 5395 |
| 6170 | CUUGGUGG CUGAUGAG GCCGUUAGGC CGAA IAGGACUG | 12459 | CAGTCCTC T CCACCAAG | 5396 |
| 6172 | AUCUUGGU CUGAUGAG GCCGUUAGGC CGAA IAGAGGAC | 12460 | GTCCTCTC C ACCAAGAT | 5397 |
| 6173 | GAUCUUGG CUGAUGAG GCCGUUAGGC CGAA IGAGAGGA | 12461 | TCCTCTCC A CCAAGATC | 5398 |
| 6175 | UAGAUCUU CUGAUGAG GCCGUUAGGC CGAA IUGGAGAG | 12462 | CTCTCCAC C AAGATCTA | 5399 |
| 6176 | UUAGAUCU CUGAUGAG GCCGUUAGGC CGAA IGUGGAGA | 12463 | TCTCCACC A AGATCTAA | 5400 |
| 6182 | UUGGAUUU CUGAUGAG GCCGUUAGGC CGAA IAUCUUGG | 12464 | CCAAGATC T AAATCCAA | 5401 |
| 6188 | UUUUGUUU CUGAUGAG GCCGUUAGGC CGAA IAUUUAGA | 12465 | TCTAAATC C AAACAAAA | 5402 |
| 6189 | CUUUUGUU CUGAUGAG GCCGUUAGGC CGAA IGAUUUAG | 12466 | CTAAATCC A AACAAAAG | 5403 |
| 6193 | CCUGCUUU CUGAUGAG GCCGUUAGGC CGAA IUUUGGAU | 12467 | ATCCAAAC A AAAGCAGG | 5404 |
| 6199 | CUCUAGCC CUGAUGAG GCCGUUAGGC CGAA ICUUUUGU | 12468 | ACAAAAGC A GGCTAGAG | 5405 |
| 6203 | CUGGCUCU CUGAUGAG GCCGUUAGGC CGAA ICCUGCUU | 12469 | AAGCAGGC T AGAGCCAG | 5406 |
| 6209 | UCUCUUCU CUGAUGAG GCCGUUAGGC CGAA ICUCUAGC | 12470 | GCTAGAGC C AGAAGAGA | 5407 |
| 6210 | CUCUCUUC CUGAUGAG GCCGUUAGGC CGAA IGCUCUAG | 12471 | CTAGAGCC A GAAGAGAG | 5408 |
| 6222 | CAAAGAUU CUGAUGAG GCCGUUAGGC CGAA IUCCUCUC | 12472 | GAGAGGAC A AATCTTTG | 5409 |
| 6227 | AACAACAA CUGAUGAG GCCGUUAGGC CGAA IAUUUGUC | 12473 | GACAAATC T TTGTTGTT | 5410 |
| 6237 | AAAGAAGA CUGAUGAG GCCGUUAGGC CGAA IAACAACA | 12474 | TGTTGTTC C TCTTCTTT | 5411 |
| 6238 | UAAAGAAG CUGAUGAG GCCGUUAGGC CGAA IGAACAAC | 12475 | GTTGTTCC T CTTCTTTA | 5412 |
| 6240 | UGUAAAGA CUGAUGAG GCCGUUAGGC CGAA IAGGAACA | 12476 | TGTTCCTC T TCTTTACA | 5413 |
| 6243 | AUGUGUAA CUGAUGAG GCCGUUAGGC CGAA IAAGAGGA | 12477 | TCCTCTTC T TTACACAT | 5414 |
| 6248 | UGCGUAUG CUGAUGAG GCCGUUAGGC CGAA IUAAAGAA | 12478 | TTCTTTAC A CATACGCA | 5415 |
| 6250 | UUUGCGUA CUGAUGAG GCCGUUAGGC CGAA IUGUAAAG | 12479 | CTTTACAC A TACGCAAA | 5416 |
| 6256 | AGGUGGUU CUGAUGAG GCCGUUAGGC CGAA ICGUAUGU | 12480 | ACATACGC A AACCACCT | 5417 |
| 6260 | UCACAGGU CUGAUGAG GCCGUUAGGC CGAA IUUUGCGU | 12481 | ACGCAAAC C ACCTGTGA | 5418 |
| 6261 | GUCACAGG CUGAUGAG GCCGUUAGGC CGAA IGUUUGCG | 12482 | CGCAAACC A CCTGTGAC | 5419 |
| 6263 | CUGUCACA CUGAUGAG GCCGUUAGGC CGAA IUGGUUUG | 12483 | CAAACCAC C TGTGACAG | 5420 |
| 6264 | GCUGUCAC CUGAUGAG GCCGUUAGGC CGAA IGUGGUUU | 12484 | AAACCACC T GTGACAGC | 5421 |
| 6270 | UUGCCAGC CUGAUGAG GCCGUUAGGC CGAA IUCACAGG | 12485 | CCTGTGAC A GCTGGCAA | 5422 |

| | | | | |
|---|---|---|---|---|
| 6273 | AAAUUGCC CUGAUGAG GCCGUUAGGC CGAA ICUGUCAC | 12486 | GTGACAGC T GGCAATTT | 5423 |
| 6277 | UAUAAAAU CUGAUGAG GCCGUUAGGC CGAA ICCAGCUG | 12487 | CAGCTGGC A ATTTTATA | 5424 |
| 6290 | CAGUUACC CUGAUGAG GCCGUUAGGC CGAA IAUUUAUA | 12488 | TATAAATC A GGTAACTG | 5425 |
| 6297 | CUCCUUCC CUGAUGAG GCCGUUAGGC CGAA IUUACCUG | 12489 | CAGGTAAC T GGAAGGAG | 5426 |
| 6313 | UUUUUCUG CUGAUGAG GCCGUUAGGC CGAA IUUUAACC | 12490 | GGTTAAAC T CAGAAAAA | 5427 |
| 6315 | CUUUUUUC CUGAUGAG GCCGUUAGGC CGAA IAGUUUAA | 12491 | TTAAACTC A GAAAAAAG | 5428 |
| 6329 | UUGACUGA CUGAUGAG GCCGUUAGGC CGAA IUCUUCUU | 12492 | AAGAAGAC C TCAGTCAA | 5429 |
| 6330 | AUUGACUG CUGAUGAG GCCGUUAGGC CGAA IGUCUUCU | 12493 | AGAAGACC T CAGTCAAT | 5430 |
| 6332 | GAAUUGAC CUGAUGAG GCCGUUAGGC CGAA IAGGUCUU | 12494 | AAGACCTC A GTCAATTC | 5431 |
| 6336 | UAGAGAAU CUGAUGAG GCCGUUAGGC CGAA IACUGAGG | 12495 | CCTCAGTC A ATTCTCTA | 5432 |
| 6341 | AAAAGUAG CUGAUGAG GCCGUUAGGC CGAA IAAUUGAC | 12496 | GTCAATTC T CTACTTTT | 5433 |
| 6343 | AAAAAAGU CUGAUGAG GCCGUUAGGC CGAA IAGAAUUG | 12497 | CAATTCTC T ACTTTTTT | 5434 |
| 6346 | AAAAAAAA CUGAUGAG GCCGUUAGGC CGAA IUAGAGAA | 12498 | TTCTCTAC T TTTTTTTT | 5435 |
| 6363 | UCUGAUUU CUGAUGAG GCCGUUAGGC CGAA IAAAAAAA | 12499 | TTTTTTTC C AAATCAGA | 5436 |
| 6364 | AUCUGAUU CUGAUGAG GCCGUUAGGC CGAA IGAAAAAA | 12500 | TTTTTTCC A AATCAGAT | 5437 |
| 6369 | CUAUUAUC CUGAUGAG GCCGUUAGGC CGAA IAUUUGGA | 12501 | TCCAAATC A GATAATAG | 5438 |
| 6379 | AUUUGCUG CUGAUGAG GCCGUUAGGC CGAA ICUAUUAU | 12502 | ATAATAGC C CAGCAAAT | 5439 |
| 6380 | UAUUUGCU CUGAUGAG GCCGUUAGGC CGAA IGCUAUUA | 12503 | TAATAGCC C AGCAAATA | 5440 |
| 6381 | CUAUUUGC CUGAUGAG GCCGUUAGGC CGAA IGGCUAUU | 12504 | AATAGCCC A GCAAATAG | 5441 |
| 6384 | UCACUAUU CUGAUGAG GCCGUUAGGC CGAA ICUGGGCU | 12505 | AGCCCAGC A AATAGTGA | 5442 |
| 6397 | GUUUUAUU CUGAUGAG GCCGUUAGGC CGAA IUUAUCAC | 12506 | GTGATAAC A AATAAAAC | 5443 |
| 6406 | ACAGCUAA CUGAUGAG GCCGUUAGGC CGAA IUUUUAUU | 12507 | AATAAAAC C TTAGCTGT | 5444 |
| 6407 | AACAGCUA CUGAUGAG GCCGUUAGGC CGAA IGUUUUAU | 12508 | ATAAAACC T TAGCTGTT | 5445 |
| 6412 | ACAUGAAC CUGAUGAG GCCGUUAGGC CGAA ICUAAGGU | 12509 | ACCTTAGC T GTTCATGT | 5446 |
| 6417 | UCAAGACA CUGAUGAG GCCGUUAGGC CGAA IAACAGCU | 12510 | AGCTGTTC A TGTCTTGA | 5447 |
| 6422 | UGAAAUCA CUGAUGAG GCCGUUAGGC CGAA IACAUGAA | 12511 | TTCATGTC T TGATTTCA | 5448 |
| 6430 | UUAAUUAU CUGAUGAG GCCGUUAGGC CGAA IAAAUCAA | 12512 | TTGATTTC A ATAATTAA | 5449 |
| 6442 | AAUGAUUA CUGAUGAG GCCGUUAGGC CGAA IAAUUAAU | 12513 | ATTAATTC T TAATCATT | 5450 |
| 6448 | UCUCUUAA CUGAUGAG GCCGUUAGGC CGAA IAUUAAGA | 12514 | TCTTAATC A TTAAGAGA | 5451 |
| 6458 | UUUAUUAU CUGAUGAG GCCGUUAGGC CGAA IUCUCUUA | 12515 | TAAGAGAC C ATAATAAA | 5452 |
| 6459 | AUUUAUUA CUGAUGAG GCCGUUAGGC CGAA IGUCUCUU | 12516 | AAGAGACC A TAATAAAT | 5453 |
| 6470 | UGAAAAGG CUGAUGAG GCCGUUAGGC CGAA IUAUUUAU | 12517 | ATAAATAC T CCTTTTCA | 5454 |
| 6472 | CUUGAAAA CUGAUGAG GCCGUUAGGC CGAA IAGUAUUU | 12518 | AAATACTC C TTTTCAAG | 5455 |

| | | | | |
|---|---|---|---|---|
| 6473 | UCUUGAAA CUGAUGAG GCCGUUAGGC CGAA IGAGUAUU | 12519 | AATACTCC T TTTCAAGA | 5456 |
| 6478 | UUUUCUCU CUGAUGAG GCCGUUAGGC CGAA IAAAAGGA | 12520 | TCCTTTTC A AGAGAAAA | 5457 |
| 6489 | AAUGGUUU CUGAUGAG GCCGUUAGGC CGAA ICUUUUCU | 12521 | AGAAAAGC A AAACCATT | 5458 |
| 6494 | AUUCUAAU CUGAUGAG GCCGUUAGGC CGAA IUUUUGCU | 12522 | AGCAAAAC C ATTAGAAT | 5459 |
| 6495 | AAUUCUAA CUGAUGAG GCCGUUAGGC CGAA IGUUUUGC | 12523 | GCAAAACC A TTAGAATT | 5460 |
| 6509 | AGGAGCUG CUGAUGAG GCCGUUAGGC CGAA IUAACAAU | 12524 | ATTGTTAC T CAGCTCCT | 5461 |
| 6511 | GAAGGAGC CUGAUGAG GCCGUUAGGC CGAA IAGUAACA | 12525 | TGTTACTC A GCTCCTTC | 5462 |
| 6514 | UUUGAAGG CUGAUGAG GCCGUUAGGC CGAA ICUGAGUA | 12526 | TACTCAGC T CCTTCAAA | 5463 |
| 6516 | AGUUUGAA CUGAUGAG GCCGUUAGGC CGAA IAGCUGAG | 12527 | CTCAGCTC C TTCAAACT | 5464 |
| 6517 | GAGUUUGA CUGAUGAG GCCGUUAGGC CGAA IGAGCUGA | 12528 | TCAGCTCC T TCAAACTC | 5465 |
| 6520 | CCUGAGUU CUGAUGAG GCCGUUAGGC CGAA IAAGGAGC | 12529 | GCTCCTTC A AACTCAGG | 5466 |
| 6524 | CAAACCUG CUGAUGAG GCCGUUAGGC CGAA IUUUGAAG | 12530 | CTTCAAAC T CAGGTTTG | 5467 |
| 6526 | UACAAACC CUGAUGAG GCCGUUAGGC CGAA IAGUUUGA | 12531 | TCAAACTC A GGTTTGTA | 5468 |
| 6537 | CUCAUGUA CUGAUGAG GCCGUUAGGC CGAA ICUACAAA | 12532 | TTTGTAGC A TACATGAG | 5469 |
| 6541 | UGGACUCA CUGAUGAG GCCGUUAGGC CGAA IUAUGCUA | 12533 | TAGCATAC A TGAGTCCA | 5470 |
| 6548 | UGAUGGAU CUGAUGAG GCCGUUAGGC CGAA IACUCAUG | 12534 | CATGAGTC C ATCCATCA | 5471 |
| 6549 | CUGAUGGA CUGAUGAG GCCGUUAGGC CGAA IGACUCAU | 12535 | ATGAGTCC A TCCATCAG | 5472 |
| 6552 | UGACUGAU CUGAUGAG GCCGUUAGGC CGAA IAUGGACU | 12536 | AGTCCATC C ATCAGTCA | 5473 |
| 6553 | UUGACUGA CUGAUGAG GCCGUUAGGC CGAA IGAUGGAC | 12537 | GTCCATCC A TCAGTCAA | 5474 |
| 6556 | UCUUUGAC CUGAUGAG GCCGUUAGGC CGAA IAUGGAUG | 12538 | CATCCATC A GTCAAAGA | 5475 |
| 6560 | CCAUUCUU CUGAUGAG GCCGUUAGGC CGAA IACUGAUG | 12539 | CATCAGTC A AAGAATGG | 5476 |
| 6572 | CUCCAGAU CUGAUGAG GCCGUUAGGC CGAA IAACCAUU | 12540 | AATGGTTC C ATCTGGAG | 5477 |
| 6573 | ACUCCAGA CUGAUGAG GCCGUUAGGC CGAA IGAACCAU | 12541 | ATGGTTCC A TCTGGAGT | 5478 |
| 6576 | AAGACUCC CUGAUGAG GCCGUUAGGC CGAA IAUGGAAC | 12542 | GTTCCATC T GGAGTCTT | 5479 |
| 6583 | CUACAUUA CUGAUGAG GCCGUUAGGC CGAA IACUCCAG | 12543 | CTGGAGTC T TAATGTAG | 5480 |
| 6608 | UUAUUACA CUGAUGAG GCCGUUAGGC CGAA IUCUCCAU | 12544 | ATGGAGAC T TGTAATAA | 5481 |
| 6622 | UUGUAACU CUGAUGAG GCCGUUAGGC CGAA ICUCAUUA | 12545 | TAATGAGC T AGTTACAA | 5482 |
| 6629 | AAGCACUU CUGAUGAG GCCGUUAGGC CGAA IUAACUAG | 12546 | CTAGTTAC A AAGTGCTT | 5483 |
| 6636 | AAUGAACA CUGAUGAG GCCGUUAGGC CGAA ICACUUUG | 12547 | CAAAGTGC T TGTTCATT | 5484 |
| 6642 | UAUUUUAA CUGAUGAG GCCGUUAGGC CGAA IAACAAGC | 12548 | GCTTGTTC A TTAAAATA | 5485 |
| 6653 | AUUUUCAG CUGAUGAG GCCGUUAGGC CGAA ICUAUUUU | 12549 | AAAATAGC A CTGAAAAT | 5486 |
| 6655 | CAAUUUUC CUGAUGAG GCCGUUAGGC CGAA IUGCUAUU | 12550 | AATAGCAC T GAAAATTG | 5487 |
| 6668 | UUAAUUCA CUGAUGAG GCCGUUAGGC CGAA IUUUCAAU | 12551 | ATTGAAAC A TGAATTAA | 5488 |

| | | | | |
|---|---|---|---|---|
| 6678 | AUAUUAUC CUGAUGAG GCCGUUAGGC CGAA IUUAAUUC | 12552 | GAATTAAC T GATAATAT | 5489 |
| 6689 | AAAUGAUU CUGAUGAG GCCGUUAGGC CGAA IAAUAUUA | 12553 | TAATATTC C AATCATTT | 5490 |
| 6690 | CAAAUGAU CUGAUGAG GCCGUUAGGC CGAA IGAAUAUU | 12554 | AATATTCC A ATCATTTG | 5491 |
| 6694 | AUGGCAAA CUGAUGAG GCCGUUAGGC CGAA IAUUGGAA | 12555 | TTCCAATC A TTTGCCAT | 5492 |
| 6700 | UCAUAAAU CUGAUGAG GCCGUUAGGC CGAA ICAAAUGA | 12556 | TCATTTGC C ATTTATGA | 5493 |
| 6701 | GUCAUAAA CUGAUGAG GCCGUUAGGC CGAA IGCAAAUG | 12557 | CATTTGCC A TTTATGAC | 5494 |
| 6710 | ACCAUUUU CUGAUGAG GCCGUUAGGC CGAA IUCAUAAA | 12558 | TTTATGAC A AAAATGGT | 5495 |
| 6723 | UUUGUUAG CUGAUGAG GCCGUUAGGC CGAA ICCAACCA | 12559 | TGGTTGGC A CTAACAAA | 5496 |
| 6725 | UCUUUGUU CUGAUGAG GCCGUUAGGC CGAA IUGCCAAC | 12560 | GTTGGCAC T AACAAAGA | 5497 |
| 6729 | UCGUUCUU CUGAUGAG GCCGUUAGGC CGAA IUUAGUGC | 12561 | GCACTAAC A AAGAACGA | 5498 |
| 6740 | AAAGGAAG CUGAUGAG GCCGUUAGGC CGAA ICUCGUUC | 12562 | GAACGAGC A CTTCCTTT | 5499 |
| 6742 | UGAAAGGA CUGAUGAG GCCGUUAGGC CGAA IUGCUCGU | 12563 | ACGAGCAC T TCCTTTCA | 5500 |
| 6745 | CUCUGAAA CUGAUGAG GCCGUUAGGC CGAA IAAGUGCU | 12564 | AGCACTTC C TTTCAGAG | 5501 |
| 6746 | ACUCUGAA CUGAUGAG GCCGUUAGGC CGAA IGAAGUGC | 12565 | GCACTTCC T TTCAGAGT | 5502 |
| 6750 | AGAAACUC CUGAUGAG GCCGUUAGGC CGAA IAAAGGAA | 12566 | TTCCTTTC A GAGTTTCT | 5503 |
| 6758 | AUUAUCUC CUGAUGAG GCCGUUAGGC CGAA IAAACUCU | 12567 | AGAGTTTC T GAGATAAT | 5504 |
| 6778 | ACCCAGAC CUGAUGAG GCCGUUAGGC CGAA IUUCCACG | 12568 | CGTGGAAC A GTCTGGGT | 5505 |
| 6782 | UUCCACCC CUGAUGAG GCCGUUAGGC CGAA IACUGUUC | 12569 | GAACAGTC T GGGTGGAA | 5506 |
| 6797 | AUGGUUUC CUGAUGAG GCCGUUAGGC CGAA ICCCCAUU | 12570 | AATGGGGC T GAAACCAT | 5507 |
| 6803 | UUGCACAU CUGAUGAG GCCGUUAGGC CGAA IUUUCAGC | 12571 | GCTGAAAC C ATGTGCAA | 5508 |
| 6804 | CUUGCACA CUGAUGAG GCCGUUAGGC CGAA IGUUUCAG | 12572 | CTGAAACC A TGTGCAAG | 5509 |
| 6810 | CACAGACU CUGAUGAG GCCGUUAGGC CGAA ICACAUGG | 12573 | CCATGTGC A AGTCTGTG | 5510 |
| 6815 | CAAGACAC CUGAUGAG GCCGUUAGGC CGAA IACUUGCA | 12574 | TGCAAGTC T GTGTCTTG | 5511 |
| 6821 | GACUGACA CUGAUGAG GCCGUUAGGC CGAA IACACAGA | 12575 | TCTGTGTC T TGTCAGTC | 5512 |
| 6826 | UCUUGGAC CUGAUGAG GCCGUUAGGC CGAA IACAAGAC | 12576 | GTCTTGTC A GTCCAAGA | 5513 |
| 6830 | CACUUCUU CUGAUGAG GCCGUUAGGC CGAA IACUGACA | 12577 | TGTCAGTC C AAGAAGTG | 5514 |
| 6831 | UCACUUCU CUGAUGAG GCCGUUAGGC CGAA IGACUGAC | 12578 | GTCAGTCC A AGAAGTGA | 5515 |
| 6841 | CAUCUCGG CUGAUGAG GCCGUUAGGC CGAA IUCACUUC | 12579 | GAAGTGAC A CCGAGATG | 5516 |
| 6843 | AACAUCUC CUGAUGAG GCCGUUAGGC CGAA IUGUCACU | 12580 | AGTGACAC C GAGATGTT | 5517 |
| 6864 | AAGGCACG CUGAUGAG GCCGUUAGGC CGAA IUCCCUAA | 12581 | TTAGGGAC C CGTGCCTT | 5518 |
| 6865 | CAAGGCAC CUGAUGAG GCCGUUAGGC CGAA IGUCCCUA | 12582 | TAGGGACC C GTGCCTTG | 5519 |
| 6870 | GGAAACAA CUGAUGAG GCCGUUAGGC CGAA ICACGGGU | 12583 | ACCCGTGC C TTGTTTCC | 5520 |
| 6871 | AGGAAACA CUGAUGAG GCCGUUAGGC CGAA IGCACGGG | 12584 | CCCGTGCC T TGTTTCCT | 5521 |

245

| | | | | |
|---|---|---|---|---|
| 6878 | GUGGGCUA CUGAUGAG GCCGUUAGGC CGAA IAAACAAG | 12585 | CTTGTTTC C TAGCCCAC | 5522 |
| 6879 | UGUGGGCU CUGAUGAG GCCGUUAGGC CGAA IGAAACAA | 12586 | TTGTTTCC T AGCCCACA | 5523 |
| 6883 | UUCUUGUG CUGAUGAG GCCGUUAGGC CGAA ICUAGGAA | 12587 | TTCCTAGC C CACAAGAA | 5524 |
| 6884 | AUUCUUGU CUGAUGAG GCCGUUAGGC CGAA IGCUAGGA | 12588 | TCCTAGCC C ACAAGAAT | 5525 |
| 6885 | CAUUCUUG CUGAUGAG GCCGUUAGGC CGAA IGGCUAGG | 12589 | CCTAGCCC A CAAGAATG | 5526 |
| 6887 | UGCAUUCU CUGAUGAG GCCGUUAGGC CGAA IUGGGCUA | 12590 | TAGCCCAC A AGAATGCA | 5527 |
| 6895 | UUGAUGUU CUGAUGAG GCCGUUAGGC CGAA ICAUUCUU | 12591 | AAGAATGC A AACATCAA | 5528 |
| 6899 | CUGUUUGA CUGAUGAG GCCGUUAGGC CGAA IUUUGCAU | 12592 | ATGCAAAC A TCAAACAG | 5529 |
| 6902 | UAUCUGUU CUGAUGAG GCCGUUAGGC CGAA IAUGUUUG | 12593 | CAAACATC A AACAGATA | 5530 |
| 6906 | CGAGUAUC CUGAUGAG GCCGUUAGGC CGAA IUUUGAUG | 12594 | CATCAAAC A GATACTCG | 5531 |
| 6912 | GGCUAGCG CUGAUGAG GCCGUUAGGC CGAA IUAUCUGU | 12595 | ACAGATAC T CGCTAGCC | 5532 |
| 6916 | AUGAGGCU CUGAUGAG GCCGUUAGGC CGAA ICGAGUAU | 12596 | ATACTCGC T AGCCTCAT | 5533 |
| 6920 | UUAAAUGA CUGAUGAG GCCGUUAGGC CGAA ICUAGCGA | 12597 | TCGCTAGC C TCATTTAA | 5534 |
| 6921 | UUUAAAUG CUGAUGAG GCCGUUAGGC CGAA IGCUAGCG | 12598 | CGCTAGCC T CATTTAAA | 5535 |
| 6923 | AAUUUAAA CUGAUGAG GCCGUUAGGC CGAA IAGGCUAG | 12599 | CTAGCCTC A TTTAAATT | 5536 |
| 6949 | GCCAAAGA CUGAUGAG GCCGUUAGGC CGAA ICACUCCU | 12600 | AGGAGTGC A TCTTTGGC | 5537 |
| 6952 | UCGGCCAA CUGAUGAG GCCGUUAGGC CGAA IAUGCACU | 12601 | AGTGCATC T TTGGCCGA | 5538 |
| 6958 | CCACUGUC CUGAUGAG GCCGUUAGGC CGAA ICCAAAGA | 12602 | TCTTTGGC C GACAGTGG | 5539 |
| 6962 | UACACCAC CUGAUGAG GCCGUUAGGC CGAA IUCGGCCA | 12603 | TGGCCGAC A GTGGTGTA | 5540 |
| 6973 | ACACACAC CUGAUGAG GCCGUUAGGC CGAA IUUACACC | 12604 | GGTGTAAC T GTGTGTGT | 5541 |
| 7041 | AAUAGUUA CUGAUGAG GCCGUUAGGC CGAA ICACAAAA | 12605 | TTTTGTGC A TAACTATT | 5542 |
| 7046 | CCUUAAAU CUGAUGAG GCCGUUAGGC CGAA IUUAUGCA | 12606 | TGCATAAC T ATTTAAGG | 5543 |
| 7059 | AAAAUUCC CUGAUGAG GCCGUUAGGC CGAA IUUUCCUU | 12607 | AAGGAAAC T GGAATTTT | 5544 |
| 7076 | UGUAUAAA CUGAUGAG GCCGUUAGGC CGAA IUAACUUU | 12608 | AAAGTTAC T TTTATACA | 5545 |
| 7084 | UCUUGGUU CUGAUGAG GCCGUUAGGC CGAA IUAUAAAA | 12609 | TTTTATAC A AACCAAGA | 5546 |
| 7088 | AUAUUCUU CUGAUGAG GCCGUUAGGC CGAA IUUUGUAU | 12610 | ATACAAAC C AAGAATAT | 5547 |
| 7089 | UAUAUUCU CUGAUGAG GCCGUUAGGC CGAA IGUUUGUA | 12611 | TACAAACC A AGAATATA | 5548 |
| 7101 | AUAUCUGU CUGAUGAG GCCGUUAGGC CGAA ICAUAUAU | 12612 | ATATATGC T ACAGATAT | 5549 |
| 7104 | CUUAUAUC CUGAUGAG GCCGUUAGGC CGAA IUAGCAUA | 12613 | TATGCTAC A GATATAAG | 5550 |
| 7115 | ACCAUGUC CUGAUGAG GCCGUUAGGC CGAA IUCUUAUA | 12614 | TATAAGAC A GACATGGT | 5551 |
| 7119 | CCAAACCA CUGAUGAG GCCGUUAGGC CGAA IUCUGUCU | 12615 | AGACAGAC A TGGTTTGG | 5552 |
| 7130 | GAAAUAUA CUGAUGAG GCCGUUAGGC CGAA IACCAAAC | 12616 | GTTTGGTC C TATATTTC | 5553 |
| 7131 | AGAAAUAU CUGAUGAG GCCGUUAGGC CGAA IGACCAAA | 12617 | TTTGGTCC T ATATTTCT | 5554 |

| | | | | |
|---|---|---|---|---|
| 7139 | UCAUGACU CUGAUGAG GCCGUUAGGC CGAA IAAAUAUA | 12618 | TATATTTC T AGTCATGA | 5555 |
| 7144 | AUUCAUCA CUGAUGAG GCCGUUAGGC CGAA IACUAGAA | 12619 | TTCTAGTC A TGATGAAT | 5556 |
| 7166 | AUGAAGAU CUGAUGAG GCCGUUAGGC CGAA IUAUACAA | 12620 | TTGTATAC C ATCTTCAT | 5557 |
| 7167 | UAUGAAGA CUGAUGAG GCCGUUAGGC CGAA IGUAUACA | 12621 | TGTATACC A TCTTCATA | 5558 |
| 7170 | UUAUAUGA CUGAUGAG GCCGUUAGGC CGAA IAUGGUAU | 12622 | ATACCATC T TCATATAA | 5559 |
| 7173 | AUAUUAUA CUGAUGAG GCCGUUAGGC CGAA IAAGAUGG | 12623 | CCATCTTC A TATAATAT | 5560 |
| 7184 | UAUUUUUA CUGAUGAG GCCGUUAGGC CGAA IUAUAUUA | 12624 | TAATATAC T TAAAAATA | 5561 |
| 7197 | CCCAAUUA CUGAUGAG GCCGUUAGGC CGAA IAAAUAUU | 12625 | AATATTTC T TAATTGGG | 5562 |
| 7220 | AUUAAGUU CUGAUGAG GCCGUUAGGC CGAA IUACGAUU | 12626 | AATCGTAC C AACTTAAT | 5563 |
| 7221 | AAUUAAGU CUGAUGAG GCCGUUAGGC CGAA IGUACGAU | 12627 | ATCGTACC A ACTTAATT | 5564 |
| 7224 | AUCAAUUA CUGAUGAG GCCGUUAGGC CGAA IUUGGUAC | 12628 | GTACCAAC T TAATTGAT | 5565 |
| 7237 | AGUUGCCA CUGAUGAG GCCGUUAGGC CGAA IUUUAUCA | 12629 | TGATAAAC T TGGCAACT | 5566 |
| 7242 | AAAGCAGU CUGAUGAG GCCGUUAGGC CGAA ICCAAGUU | 12630 | AACTTGGC A ACTGCTTT | 5567 |
| 7245 | AUAAAAGC CUGAUGAG GCCGUUAGGC CGAA IUUGCCAA | 12631 | TTGGCAAC T GCTTTTAT | 5568 |
| 7248 | AACAUAAA CUGAUGAG GCCGUUAGGC CGAA ICAGUUGC | 12632 | GCAACTGC T TTTATGTT | 5569 |
| 7258 | AAGGAGAC CUGAUGAG GCCGUUAGGC CGAA IAACAUAA | 12633 | TTATGTTC T GTCTCCTT | 5570 |
| 7262 | AUGGAAGG CUGAUGAG GCCGUUAGGC CGAA IACAGAAC | 12634 | GTTCTGTC T CCTTCCAT | 5571 |
| 7264 | UUAUGGAA CUGAUGAG GCCGUUAGGC CGAA IAGACAGA | 12635 | TCTGTCTC C TTCCATAA | 5572 |
| 7265 | UUUAUGGA CUGAUGAG GCCGUUAGGC CGAA IGAGACAG | 12636 | CTGTCTCC T TCCATAAA | 5573 |
| 7268 | AAAUUUAU CUGAUGAG GCCGUUAGGC CGAA IAAGGAGA | 12637 | TCTCCTTC C ATAAATTT | 5574 |
| 7269 | AAAAUUUA CUGAUGAG GCCGUUAGGC CGAA IGAAGGAG | 12638 | CTCCTTCC A TAAATTTT | 5575 |
| 7280 | UAGUAUUU CUGAUGAG GCCGUUAGGC CGAA IAAAAAUU | 12639 | AATTTTTC A AAATACTA | 5576 |
| 7287 | GUUGAAUU CUGAUGAG GCCGUUAGGC CGAA IUAUUUUG | 12640 | CAAAATAC T AATTCAAC | 5577 |
| 7293 | UUCUUUGU CUGAUGAG GCCGUUAGGC CGAA IAAUUAGU | 12641 | ACTAATTC A ACAAAGAA | 5578 |
| 7296 | UUUUUCUU CUGAUGAG GCCGUUAGGC CGAA IUUGAAUU | 12642 | AATTCAAC A AAGAAAAA | 5579 |
| 7307 | AAAAAAAG CUGAUGAG GCCGUUAGGC CGAA ICUUUUUC | 12643 | GAAAAAGC T CTTTTTTT | 5580 |
| 7309 | GAAAAAAA CUGAUGAG GCCGUUAGGC CGAA IAGCUUUU | 12644 | AAAAGCTC T TTTTTTTC | 5581 |
| 7318 | UUAUUUUA CUGAUGAG GCCGUUAGGC CGAA IAAAAAAA | 12645 | TTTTTTTC C TAAAATAA | 5582 |
| 7319 | UUUAUUUU CUGAUGAG GCCGUUAGGC CGAA IGAAAAAA | 12646 | TTTTTTCC T AAAATAAA | 5583 |
| 7329 | UAAAUUUG CUGAUGAG GCCGUUAGGC CGAA IUUUAUUU | 12647 | AAATAAAC T CAAATTTA | 5584 |
| 7331 | GAUAAAUU CUGAUGAG GCCGUUAGGC CGAA IAGUUUAU | 12648 | ATAAACTC A AATTTATC | 5585 |
| 7340 | CUAAACAA CUGAUGAG GCCGUUAGGC CGAA IAUAAAUU | 12649 | AATTTATC C TTGTTTAG | 5586 |
| 7341 | UCUAAACA CUGAUGAG GCCGUUAGGC CGAA IGAUAAAU | 12650 | ATTTATCC T TGTTTAGA | 5587 |

247

| | | | | |
|---|---|---|---|---|
| 7352 | UUUUUCUC CUGAUGAG GCCGUUAGGC CGAA ICUCUAAA | 12651 | TTTAGAGC A GAGAAAAA | 5588 |
| 7372 | CAUUUCAA CUGAUGAG GCCGUUAGGC CGAA IUUUUUCU | 12652 | AGAAAAAC T TTGAAATG | 5589 |
| 7384 | AUUUUUUG CUGAUGAG GCCGUUAGGC CGAA IACCAUUU | 12653 | AAATGGTC T CAAAAAAT | 5590 |
| 7386 | CAAUUUUU CUGAUGAG GCCGUUAGGC CGAA IAGACCAU | 12654 | ATGGTCTC A AAAAATTG | 5591 |
| 7396 | AAAUAUUU CUGAUGAG GCCGUUAGGC CGAA ICAAUUUU | 12655 | AAAATTGC T AAATATTT | 5592 |
| 7407 | UUUUCCAU CUGAUGAG GCCGUUAGGC CGAA IAAAAUAU | 12656 | ATATTTTC A ATGGAAAA | 5593 |
| 7417 | UAACAUUU CUGAUGAG GCCGUUAGGC CGAA IUUUUCCA | 12657 | TGGAAAAC T AAATGTTA | 5594 |
| 7433 | AUACAAUC CUGAUGAG GCCGUUAGGC CGAA ICUAAACU | 12658 | AGTTTAGC T GATTGTAT | 5595 |
| 7455 | AAGUGAAA CUGAUGAG GCCGUUAGGC CGAA IUUCGAAA | 12659 | TTTCGAAC C TTTCACTT | 5596 |
| 7456 | AAAGUGAA CUGAUGAG GCCGUUAGGC CGAA IGUUCGAA | 12660 | TTCGAACC T TTCACTTT | 5597 |
| 7460 | ACAAAAAG CUGAUGAG GCCGUUAGGC CGAA IAAAGGUU | 12661 | AACCTTTC A CTTTTTGT | 5598 |
| 7462 | AAACAAAA CUGAUGAG GCCGUUAGGC CGAA IUGAAAGG | 12662 | CCTTTCAC T TTTTGTTT | 5599 |
| 7478 | GUGAAAUA CUGAUGAG GCCGUUAGGC CGAA IUAAAACA | 12663 | TGTTTTAC C TATTTCAC | 5600 |
| 7479 | UGUGAAAU CUGAUGAG GCCGUUAGGC CGAA IGUAAAAC | 12664 | GTTTTACC T ATTTCACA | 5601 |
| 7485 | CACAGUUG CUGAUGAG GCCGUUAGGC CGAA IAAAUAGG | 12665 | CCTATTTC A CAACTGTG | 5602 |
| 7487 | UACACAGU CUGAUGAG GCCGUUAGGC CGAA IUGAAAUA | 12666 | TATTTCAC A ACTGTGTA | 5603 |
| 7490 | AUUUACAC CUGAUGAG GCCGUUAGGC CGAA IUUGUGAA | 12667 | TTCACAAC T GTGTAAAT | 5604 |
| 7502 | GAAUUAUU CUGAUGAG GCCGUUAGGC CGAA ICAAUUUA | 12668 | TAAATTGC C AATAATTC | 5605 |
| 7503 | GGAAUUAU CUGAUGAG GCCGUUAGGC CGAA IGCAAUUU | 12669 | AAATTGCC A ATAATTCC | 5606 |
| 7511 | CAUGGACA CUGAUGAG GCCGUUAGGC CGAA IAAUUAUU | 12670 | AATAATTC C TGTCCATG | 5607 |
| 7512 | UCAUGGAC CUGAUGAG GCCGUUAGGC CGAA IGAAUUAU | 12671 | ATAATTCC T GTCCATGA | 5608 |
| 7516 | AUUUUCAU CUGAUGAG GCCGUUAGGC CGAA IACAGGAA | 12672 | TTCCTGTC C ATGAAAAT | 5609 |
| 7517 | CAUUUUCA CUGAUGAG GCCGUUAGGC CGAA IGACAGGA | 12673 | TCCTGTCC A TGAAAATG | 5610 |
| 7527 | GGAUAAUU CUGAUGAG GCCGUUAGGC CGAA ICAUUUUC | 12674 | GAAAATGC A AATTATCC | 5611 |
| 7535 | UCUACACU CUGAUGAG GCCGUUAGGC CGAA IAUAAUUU | 12675 | AAATTATC C AGTGTAGA | 5612 |
| 7536 | AUCUACAC CUGAUGAG GCCGUUAGGC CGAA IGAUAAUU | 12676 | AATTATCC A GTGTAGAT | 5613 |
| 7554 | AGGGUGAU CUGAUGAG GCCGUUAGGC CGAA IUCAAAUA | 12677 | TATTTGAC C ATCACCCT | 5614 |
| 7555 | UAGGGUGA CUGAUGAG GCCGUUAGGC CGAA IGUCAAAU | 12678 | ATTTGACC A TCACCCTA | 5615 |
| 7558 | CCAUAGGG CUGAUGAG GCCGUUAGGC CGAA IAUGGUCA | 12679 | TGACCATC A CCCTATGG | 5616 |
| 7560 | AUCCAUAG CUGAUGAG GCCGUUAGGC CGAA IUGAUGGU | 12680 | ACCATCAC C CTATGGAT | 5617 |
| 7561 | UAUCCAUA CUGAUGAG GCCGUUAGGC CGAA IGUGAUGG | 12681 | CCATCACC C TATGGATA | 5618 |
| 7562 | AUAUCCAU CUGAUGAG GCCGUUAGGC CGAA IGGUGAUG | 12682 | CATCACCC T ATGGATAT | 5619 |
| 7575 | GCAAAACU CUGAUGAG GCCGUUAGGC CGAA ICCAAUAU | 12683 | ATATTGGC T AGTTTTGC | 5620 |

| | | | | |
|---|---|---|---|---|
| 7584 | UUAAUAAA CUGAUGAG GCCGUUAGGC CGAA ICAAAACU | 12684 | AGTTTTGC C TTTATTAA | 5621 |
| 7585 | CUUAAUAA CUGAUGAG GCCGUUAGGC CGAA IGCAAAAC | 12685 | GTTTTGCC T TTATTAAG | 5622 |
| 7595 | AAUGAAUU CUGAUGAG GCCGUUAGGC CGAA ICUUAAUA | 12686 | TATTAAGC A AATTCATT | 5623 |
| 7601 | GGCUGAAA CUGAUGAG GCCGUUAGGC CGAA IAAUUUGC | 12687 | GCAAATTC A TTTCAGCC | 5624 |
| 7606 | AUUCAGGC CUGAUGAG GCCGUUAGGC CGAA IAAAUGAA | 12688 | TTCATTTC A GCCTGAAT | 5625 |
| 7609 | GACAUUCA CUGAUGAG GCCGUUAGGC CGAA ICUGAAAU | 12689 | ATTTCAGC C TGAATGTC | 5626 |
| 7610 | AGACAUUC CUGAUGAG GCCGUUAGGC CGAA IGCUGAAA | 12690 | TTTCAGCC T GAATGTCT | 5627 |
| 7618 | AUAUAGGC CUGAUGAG GCCGUUAGGC CGAA IACAUUCA | 12691 | TGAATGTC T GCCTATAT | 5628 |
| 7621 | AAUAUAUA CUGAUGAG GCCGUUAGGC CGAA ICAGACAU | 12692 | ATGTCTGC C TATATATT | 5629 |
| 7622 | GAAUAUAU CUGAUGAG GCCGUUAGGC CGAA IGCAGACA | 12693 | TGTCTGCC T ATATATTC | 5630 |
| 7631 | AAGAGCAG CUGAUGAG GCCGUUAGGC CGAA IAAUAUAU | 12694 | ATATATTC T CTGCTCTT | 5631 |
| 7633 | CAAAGAGC CUGAUGAG GCCGUUAGGC CGAA IAGAAUAU | 12695 | ATATTCTC T GCTCTTTG | 5632 |
| 7636 | AUACAAAG CUGAUGAG GCCGUUAGGC CGAA ICAGAGAA | 12696 | TTCTCTGC T CTTTGTAT | 5633 |
| 7638 | GAAUACAA CUGAUGAG GCCGUUAGGC CGAA IAGCAGAG | 12697 | CTCTGCTC T TTGTATTC | 5634 |
| 7647 | UUCAAAGG CUGAUGAG GCCGUUAGGC CGAA IAAUACAA | 12698 | TTGTATTC T CCTTTGAA | 5635 |
| 7649 | GGUUCAAA CUGAUGAG GCCGUUAGGC CGAA IAGAAUAC | 12699 | GTATTCTC C TTTGAACC | 5636 |
| 7650 | GGGUUCAA CUGAUGAG GCCGUUAGGC CGAA IGAGAAUA | 12700 | TATTCTCC T TTGAACCC | 5637 |
| 7657 | UUUUAACG CUGAUGAG GCCGUUAGGC CGAA IUUCAAAG | 12701 | CTTTGAAC C CGTTAAAA | 5638 |
| 7658 | GUUUUAAC CUGAUGAG GCCGUUAGGC CGAA IGUUCAAA | 12702 | TTTGAACC C GTTAAAAC | 5639 |
| 7667 | CCACAGGA CUGAUGAG GCCGUUAGGC CGAA IUUUUAAC | 12703 | GTTAAAAC A TCCTGTGG | 5640 |
| 7670 | GUGCCACA CUGAUGAG GCCGUUAGGC CGAA IAUGUUUU | 12704 | AAAACATC C TGTGGCAC | 5641 |
| 7671 | AGUGCCAC CUGAUGAG GCCGUUAGGC CGAA IGAUGUUU | 12705 | AAACATCC T GTGGCACT | 5642 |

Table XV: G-Cleaver Ribozyme and Target Sequences 237.198

| nt. Position | Ribozyme Sequence | Seq. ID Nos | Target | Seq. ID Nos |
|---|---|---|---|---|
| 67 | CGCUG UGAUG GCAUGCACUAUGC GCG ACCCGAGCCC | 12706 | GGGCTCGGGT G CAGCG | 5643 |
| 91 | AUCCU UGAUG GCAUGCACUAUGC GCG GCCGCCAGGC | 12707 | GCCTGGCGGC G AGGAT | 5644 |
| 114 | GGAGA UGAUG GCAUGCACUAUGC GCG AACCACUUCC | 12708 | GGAAGTGGTT G TCTCC | 5645 |
| 131 | UCUCG UGAUG GCAUGCACUAUGC GCG GGCUCCAGCC | 12709 | GGCTGGAGCC G CGAGA | 5646 |
| 133 | CGUCU UGAUG GCAUGCACUAUGC GCG GCGGCUCCAG | 12710 | CTGGAGCCGC G AGACG | 5647 |
| 142 | CUGAG UGAUG GCAUGCACUAUGC GCG GCCCGUCUCG | 12711 | CGAGACGGGC G CTCAG | 5648 |
| 151 | CCCCG UGAUG GCAUGCACUAUGC GCG GCCCUGAGCG | 12712 | CGCTCAGGGC G CGGGG | 5649 |
| 168 | UCGUU UGAUG GCAUGCACUAUGC GCG GCCGCCGCCG | 12713 | CGGCGGCGGC G AACGA | 5650 |
| 172 | CCUCU UGAUG GCAUGCACUAUGC GCG GUUCGCCGCC | 12714 | GGCGGCGAAC G AGAGG | 5651 |
| 214 | GCCCG UGAUG GCAUGCACUAUGC GCG GCUCCCCCGG | 12715 | CCGGGGGAGC G CGGGC | 5652 |
| 227 | CUGCU UGAUG GCAUGCACUAUGC GCG GCCCGGUGCC | 12716 | GGCACCGGGC G AGCAG | 5653 |
| 236 | CGACG UGAUG GCAUGCACUAUGC GCG GGCCUGCUCG | 12717 | CGAGCAGGCC G CGTCG | 5654 |
| 241 | GAGCG UGAUG GCAUGCACUAUGC GCG GACGCGGCCU | 12718 | AGGCCGCGTC G CGCTC | 5655 |
| 243 | GUGAG UGAUG GCAUGCACUAUGC GCG GCGACGCGGC | 12719 | GCCGCGTCGC G CTCAC | 5656 |
| 279 | CACAG UGAUG GCAUGCACUAUGC GCG AGGACCCCGG | 12720 | CCGGGGTCCT G CTGTG | 5657 |
| 282 | GCGCA UGAUG GCAUGCACUAUGC GCG AGCAGGACCC | 12721 | GGGTCCTGCT G TGCGC | 5658 |
| 284 | GCGCG UGAUG GCAUGCACUAUGC GCG ACAGCAGGAC | 12722 | GTCCTGCTGT G CGCGC | 5659 |
| 286 | CAGCG UGAUG GCAUGCACUAUGC GCG GCACAGCAGG | 12723 | CCTGCTGTGC G CGCTG | 5660 |
| 288 | AGCAG UGAUG GCAUGCACUAUGC GCG GCGCACAGCA | 12724 | TGCTGTGCGC G CTGCT | 5661 |
| 291 | CUGAG UGAUG GCAUGCACUAUGC GCG AGCGCGCACA | 12725 | TGTGCGCGCT G CTCAG | 5662 |
| 299 | GCAGA UGAUG GCAUGCACUAUGC GCG AGCUGAGCAG | 12726 | CTGCTCAGCT G TCTGC | 5663 |
| 303 | AGAAG UGAUG GCAUGCACUAUGC GCG AGACAGCUGA | 12727 | TCAGCTGTCT G CTTCT | 5664 |
| 346 | CAGUU UGAUG GCAUGCACUAUGC GCG AGGAUCUUUU | 12728 | AAAAGATCCT G AACTG | 5665 |
| 351 | AAACU UGAUG GCAUGCACUAUGC GCG AGUUCAGGAU | 12729 | ATCCTGAACT G AGTTT | 5666 |
| 378 | GCUUG UGAUG GCAUGCACUAUGC GCG AUGAUGUGCU | 12730 | AGCACATCAT G CAAGC | 5667 |
| 396 | AGAUG UGAUG GCAUGCACUAUGC GCG AGUGUCUGGC | 12731 | GCCAGACACT G CATCT | 5668 |
| 407 | CCCUG UGAUG GCAUGCACUAUGC GCG AUUGGAGAUG | 12732 | CATCTCCAAT G CAGGG | 5669 |
| 438 | UCAGG UGAUG GCAUGCACUAUGC GCG AAAGACCAUU | 12733 | AATGGTCTTT G CCTGA | 5670 |
| 442 | CAUUU UGAUG GCAUGCACUAUGC GCG AGGCAAAGAC | 12734 | GTCTTTGCCT G AAATG | 5671 |

| | | | | |
|---|---|---|---|---|
| 450 | UUACU UGAUG GCAUGCACUAUGC GCG ACCAUUUCAG | 12735 | CTGAAATGGT G AGTAA | 5672 |
| 463 | CCUUU UGAUG GCAUGCACUAUGC GCG GCUUUCCUUA | 12736 | TAAGGAAAGC G AAAGG | 5673 |
| 471 | AUGCU UGAUG GCAUGCACUAUGC GCG AGCCUUUCGC | 12737 | GCGAAAGGCT G AGCAT | 5674 |
| 487 | ACAGG UGAUG GCAUGCACUAUGC GCG AGAUUUAGUU | 12738 | AACTAAATCT G CCTGT | 5675 |
| 491 | UUCCA UGAUG GCAUGCACUAUGC GCG AGGCAGAUUU | 12739 | AAATCTGCCT G TGGAA | 5676 |
| 515 | UACUG UGAUG GCAUGCACUAUGC GCG AGAAUUGUUU | 12740 | AAACAATTCT G CAGTA | 5677 |
| 531 | GUGUU UGAUG GCAUGCACUAUGC GCG AAGGUUAAAG | 12741 | CTTTAACCTT G AACAC | 5678 |
| 569 | AUUUG UGAUG GCAUGCACUAUGC GCG AGCUGUAGAA | 12742 | TTCTACAGCT G CAAAT | 5679 |
| 583 | AGGUA UGAUG GCAUGCACUAUGC GCG AGCUAGAUAU | 12743 | ATATCTAGCT G TACCT | 5680 |
| 616 | GAUUG UGAUG GCAUGCACUAUGC GCG AGAUUCUGUU | 12744 | AACAGAATCT G CAATC | 5681 |
| 637 | UGUAU UGAUG GCAUGCACUAUGC GCG ACUAAUAAAU | 12745 | ATTTATTAGT G ATACA | 5682 |
| 663 | CUGUA UGAUG GCAUGCACUAUGC GCG AUCUCUACGA | 12746 | TCGTAGAGAT G TACAG | 5683 |
| 670 | GAUUU UGAUG GCAUGCACUAUGC GCG ACUGUACAUC | 12747 | GATGTACAGT G AAATC | 5684 |
| 679 | AAUUU UGAUG GCAUGCACUAUGC GCG GGGGAUUUCA | 12748 | TGAAATCCCC G AAATT | 5685 |
| 693 | UCAGU UGAUG GCAUGCACUAUGC GCG AUGUGUAUAA | 12749 | TTATACACAT G ACTGA | 5686 |
| 697 | UCCUU UGAUG GCAUGCACUAUGC GCG AGUCAUGUGU | 12750 | ACACATGACT G AAGGA | 5687 |
| 722 | CCCGG UGAUG GCAUGCACUAUGC GCG AGGGAAUGAC | 12751 | GTCATTCCCT G CCGGG | 5688 |
| 748 | AGUAA UGAUG GCAUGCACUAUGC GCG AGUGAUGUUA | 12752 | TAACATCACT G TTACT | 5689 |
| 772 | AGUGU UGAUG GCAUGCACUAUGC GCG AAGUGGAAAC | 12753 | GTTTCCACTT G ACACT | 5690 |
| 780 | GGGAU UGAUG GCAUGCACUAUGC GCG AAAGUGUCAA | 12754 | TTGACACTTT G ATCCC | 5691 |
| 787 | UCCAU UGAUG GCAUGCACUAUGC GCG AGGGAUCAAA | 12755 | TTTGATCCCT G ATGGA | 5692 |
| 797 | UUAUG UGAUG GCAUGCACUAUGC GCG GUUUUCCAUC | 12756 | GATGGAAAAC G CATAA | 5693 |
| 838 | CGUUG UGAUG GCAUGCACUAUGC GCG AUUUGAUAUG | 12757 | CATATCAAAT G CAACG | 5694 |
| 864 | CAGGU UGAUG GCAUGCACUAUGC GCG AGAAGCCCUA | 12758 | TAGGGCTTCT G ACCTG | 5695 |
| 869 | CUUCA UGAUG GCAUGCACUAUGC GCG AGGUCAGAAG | 12759 | CTTCTGACCT G TGAAG | 5696 |
| 871 | UGCUU UGAUG GCAUGCACUAUGC GCG ACAGGUCAGA | 12760 | TCTGACCTGT G AAGCA | 5697 |
| 894 | UUAUA UGAUG GCAUGCACUAUGC GCG AAAUGCCCAU | 12761 | ATGGGCATTT G TATAA | 5698 |
| 920 | UUUGU UGAUG GCAUGCACUAUGC GCG GAUGUGUGAG | 12762 | CTCACACATC G ACAAA | 5699 |
| 943 | UUGGA UGAUG GCAUGCACUAUGC GCG AUCUAUGAUU | 12763 | AATCATAGAT G TCCAA | 5700 |
| 962 | CUGGG UGAUG GCAUGCACUAUGC GCG GUGGUGUGCU | 12764 | AGCACACCAC G CCCAG | 5701 |
| 994 | GAGGA UGAUG GCAUGCACUAUGC GCG AAGAGUAUGG | 12765 | CCATACTCTT G TCCTC | 5702 |
| 1004 | CAGUA UGAUG GCAUGCACUAUGC GCG AAUUGAGGAC | 12766 | GTCCTCAATT G TACTG | 5703 |
| 1009 | GGUAG UGAUG GCAUGCACUAUGC GCG AGUACAAUUG | 12767 | CAATTGTACT G CTACC | 5704 |

| | | | | |
|---|---|---|---|---|
| 1023 | GUGUU UGAUG GCAUGCACUAUGC GCG AAGGGAGUGG | 12768 | CCACTCCCTT G AACAC | 5705 |
| 1029 | ACUCU UGAUG GCAUGCACUAUGC GCG GUGUUCAAGG | 12769 | CCTTGAACAC G AGAGT | 5706 |
| 1041 | CAGGU UGAUG GCAUGCACUAUGC GCG AUUUGAACUC | 12770 | GAGTTCAAAT G ACCTG | 5707 |
| 1057 | UUCAU UGAUG GCAUGCACUAUGC GCG AGGGUAACUC | 12771 | GAGTTACCCT G ATGAA | 5708 |
| 1060 | UUUUU UGAUG GCAUGCACUAUGC GCG AUCAGGGUAA | 12772 | TTACCCTGAT G AAAAA | 5709 |
| 1088 | UUCGU UGAUG GCAUGCACUAUGC GCG GCCUUACGGA | 12773 | TCCGTAAGGC G ACGAA | 5710 |
| 1091 | CAAUU UGAUG GCAUGCACUAUGC GCG GUCGCCUUAC | 12774 | GTAAGGCGAC G AATTG | 5711 |
| 1096 | UUGGU UGAUG GCAUGCACUAUGC GCG AAUUCGUCGC | 12775 | GCGACGAATT G ACCAA | 5712 |
| 1114 | GUUGG UGAUG GCAUGCACUAUGC GCG AUGGGAAUUG | 12776 | CAATTCCCAT G CCAAC | 5713 |
| 1132 | AAGAA UGAUG GCAUGCACUAUGC GCG ACUGUAGAAU | 12777 | ATTCTACAGT G TTCTT | 5714 |
| 1144 | UUUGU UGAUG GCAUGCACUAUGC GCG AAUAGUAAGA | 12778 | TCTTACTATT G ACAAA | 5715 |
| 1152 | UUCUG UGAUG GCAUGCACUAUGC GCG AUUUUGUCAA | 12779 | TTGACAAAAT G CAGAA | 5716 |
| 1181 | CACGA UGAUG GCAUGCACUAUGC GCG AAGUAUAAAG | 12780 | CTTTATACTT G TCGTG | 5717 |
| 1186 | CCUUA UGAUG GCAUGCACUAUGC GCG ACGACAAGUA | 12781 | TACTTGTCGT G TAAGG | 5718 |
| 1213 | GUUAA UGAUG GCAUGCACUAUGC GCG AGAUUUGAAU | 12782 | ATTCAAATCT G TTAAC | 5719 |
| 1227 | AUAUG UGAUG GCAUGCACUAUGC GCG ACUGAGGUGU | 12783 | ACACCTCAGT G CATAT | 5720 |
| 1237 | UUUAU UGAUG GCAUGCACUAUGC GCG AUAUAUAUGC | 12784 | GCATATATAT G ATAAA | 5721 |
| 1255 | UUUCA UGAUG GCAUGCACUAUGC GCG AGUGAUGAAU | 12785 | ATTCATCACT G TGAAA | 5722 |
| 1257 | UGUUU UGAUG GCAUGCACUAUGC GCG ACAGUGAUGA | 12786 | TCATCACTGT G AAACA | 5723 |
| 1265 | GUUUU UGAUG GCAUGCACUAUGC GCG GAUGUUUCAC | 12787 | GTGAAACATC G AAAAC | 5724 |
| 1278 | UCAAG UGAUG GCAUGCACUAUGC GCG ACCUGCUGUU | 12788 | AACAGCAGGT G CTTGA | 5725 |
| 1282 | GGUUU UGAUG GCAUGCACUAUGC GCG AAGCACCUGC | 12789 | GCAGGTGCTT G AAACC | 5726 |
| 1320 | ACUUU UGAUG GCAUGCACUAUGC GCG AUAGAGAGCC | 12790 | GGCTCTCTAT G AAAGT | 5727 |
| 1326 | GCCUU UGAUG GCAUGCACUAUGC GCG ACUUUCAUAG | 12791 | CTATGAAAGT G AAGGC | 5728 |
| 1341 | UCCGG UGAUG GCAUGCACUAUGC GCG GAGGGAAAUG | 12792 | CATTTCCCTC G CCGGA | 5729 |
| 1351 | CCAUA UGAUG GCAUGCACUAUGC GCG AACUUCCGGC | 12793 | GCCGGAAGTT G TATGG | 5730 |
| 1375 | AGUCG UGAUG GCAUGCACUAUGC GCG AGGUAACCCA | 12794 | TGGGTTACCT G CGACT | 5731 |
| 1377 | UCAGU UGAUG GCAUGCACUAUGC GCG GCAGGUAACC | 12795 | GGTTACCTGC G ACTGA | 5732 |
| 1381 | UUUCU UGAUG GCAUGCACUAUGC GCG AGUCGCAGGU | 12796 | ACCTGCGACT G AGAAA | 5733 |
| 1390 | GCGAG UGAUG GCAUGCACUAUGC GCG AGAUUUCUCA | 12797 | TGAGAAATCT G CTCGC | 5734 |
| 1394 | AAUAG UGAUG GCAUGCACUAUGC GCG GAGCAGAUUU | 12798 | AAATCTGCTC G CTATT | 5735 |
| 1401 | CGAGU UGAUG GCAUGCACUAUGC GCG AAAUAGCGAG | 12799 | CTCGCTATTT G ACTCG | 5736 |
| 1438 | CUCUU UGAUG GCAUGCACUAUGC GCG AGUUACGUCC | 12800 | GGACGTAACT G AAGAG | 5737 |

| | | | | |
|---|---|---|---|---|
| 1447 | CCCUG UGAUG GCAUGCACUAUGC GCG AUCCUCUUCA | 12801 | TGAAGAGGAT G CAGGG | 5738 |
| 1467 | CUCAG UGAUG GCAUGCACUAUGC GCG AAGAUUGUAU | 12802 | ATACAATCTT G CTGAG | 5739 |
| 1470 | AUGCU UGAUG GCAUGCACUAUGC GCG AGCAAGAUUG | 12803 | CAATCTTGCT G AGCAT | 5740 |
| 1489 | AAACA UGAUG GCAUGCACUAUGC GCG AUUUGACUGU | 12804 | ACAGTCAAAT G TGTTT | 5741 |
| 1491 | UUAAA UGAUG GCAUGCACUAUGC GCG ACAUUUGACU | 12805 | AGTCAAATGT G TTTAA | 5742 |
| 1507 | AGUGG UGAUG GCAUGCACUAUGC GCG AGUGAGGUUU | 12806 | AAACCTCACT G CCACT | 5743 |
| 1519 | AUUGA UGAUG GCAUGCACUAUGC GCG AAUUAGAGUG | 12807 | CACTCTAATT G TCAAT | 5744 |
| 1525 | UUUCA UGAUG GCAUGCACUAUGC GCG AUUGACAAUU | 12808 | AATTGTCAAT G TGAAA | 5745 |
| 1527 | GGUUU UGAUG GCAUGCACUAUGC GCG ACAUUGACAA | 12809 | TTGTCAATGT G AAACC | 5746 |
| 1543 | CUUUU UGAUG GCAUGCACUAUGC GCG GUAAAUCUGG | 12810 | CCAGATTTAC G AAAAG | 5747 |
| 1554 | GAUGA UGAUG GCAUGCACUAUGC GCG ACGGCCUUUU | 12811 | AAAAGGCCGT G TCATC | 5748 |
| 1605 | CAAGU UGAUG GCAUGCACUAUGC GCG AGGAUUUGUC | 12812 | GACAAATCCT G ACTTG | 5749 |
| 1610 | CGGUA UGAUG GCAUGCACUAUGC GCG AAGUCAGGAU | 12813 | ATCCTGACTT G TACCG | 5750 |
| 1615 | AUAUG UGAUG GCAUGCACUAUGC GCG GGUACAAGUC | 12814 | GACTTGTACC G CATAT | 5751 |
| 1661 | GGUUA UGAUG GCAUGCACUAUGC GCG AGGGGUGCCA | 12815 | TGGCACCCCT G TAACC | 5752 |
| 1678 | UGCUU UGAUG GCAUGCACUAUGC GCG GGAAUGAUUA | 12816 | TAATCATTCC G AAGCA | 5753 |
| 1688 | AGUCA UGAUG GCAUGCACUAUGC GCG ACCUUGCUUC | 12817 | GAAGCAAGGT G TGACT | 5754 |
| 1690 | AAAGU UGAUG GCAUGCACUAUGC GCG ACACCUUGCU | 12818 | AGCAAGGTGT G ACTTT | 5755 |
| 1697 | UGGAA UGAUG GCAUGCACUAUGC GCG AAAAGUCACA | 12819 | TGTGACTTTT G TTCCA | 5756 |
| 1708 | CUCUU UGAUG GCAUGCACUAUGC GCG AUUAUUGGAA | 12820 | TTCCAATAAT G AAGAG | 5757 |
| 1729 | GUCAG UGAUG GCAUGCACUAUGC GCG AUCCAGGAUA | 12821 | TATCCTGGAT G CTGAC | 5758 |
| 1732 | GCUGU UGAUG GCAUGCACUAUGC GCG AGCAUCCAGG | 12822 | CCTGGATGCT G ACAGC | 5759 |
| 1756 | GCUCU UGAUG GCAUGCACUAUGC GCG AAUUCUGUUU | 12823 | AAACAGAATT G AGAGC | 5760 |
| 1772 | CCAUG UGAUG GCAUGCACUAUGC GCG GCUGAGUGAU | 12824 | ATCACTCAGC G CATGG | 5761 |
| 1819 | AGCCA UGAUG GCAUGCACUAUGC GCG AACCAAGGUG | 12825 | CACCTTGGTT G TGGCT | 5762 |
| 1825 | AGAGU UGAUG GCAUGCACUAUGC GCG AGCCACAACC | 12826 | GGTTGTGGCT G ACTCT | 5763 |
| 1853 | CUAUG UGAUG GCAUGCACUAUGC GCG AAAUGUAGAU | 12827 | ATCTACATTT G CATAG | 5764 |
| 1879 | UCCCA UGAUG GCAUGCACUAUGC GCG AGUCCCAACU | 12828 | AGTTGGGACT G TGGGA | 5765 |
| 1912 | UGGCA UGAUG GCAUGCACUAUGC GCG AUCUGUGAUA | 12829 | TATCACAGAT G TGCCA | 5766 |
| 1914 | UUUGG UGAUG GCAUGCACUAUGC GCG ACAUCUGUGA | 12830 | TCACAGATGT G CCAAA | 5767 |
| 1930 | GUUAA UGAUG GCAUGCACUAUGC GCG AUGAAACCCA | 12831 | TGGGTTTCAT G TTAAC | 5768 |
| 1947 | GUCGG UGAUG GCAUGCACUAUGC GCG AUUUUUUCCA | 12832 | TGGAAAAAAT G CCGAC | 5769 |
| 1950 | UCCGU UGAUG GCAUGCACUAUGC GCG GGCAUUUUUU | 12833 | AAAAAATGCC G ACGGA | 5770 |

253

| | | | | |
|---|---|---|---|---|
| 1968 | AGUUU UGAUG GCAUGCACUAUGC GCG AGGUCCUCUC | 12834 | GAGAGGACCT G AAACT | 5771 |
| 1974 | CAAGA UGAUG GCAUGCACUAUGC GCG AGUUUCAGGU | 12835 | ACCTGAAACT G TCTTG | 5772 |
| 1979 | CUGUG UGAUG GCAUGCACUAUGC GCG AAGACAGUUU | 12836 | AAACTGTCTT G CACAG | 5773 |
| 2025 | GUCCG UGAUG GCAUGCACUAUGC GCG AGUAAAAUCC | 12837 | GGATTTTACT G CGGAC | 5774 |
| 2049 | UAGUG UGAUG GCAUGCACUAUGC GCG AUUGUUCUGU | 12838 | ACAGAACAAT G CACTA | 5775 |
| 2121 | ACAUU UGAUG GCAUGCACUAUGC GCG AUGAUGGUAA | 12839 | TTACCATCAT G AATGT | 5776 |
| 2125 | GGAAA UGAUG GCAUGCACUAUGC GCG AUUCAUGAUG | 12840 | CATCATGAAT G TTTCC | 5777 |
| 2133 | UCUUG UGAUG GCAUGCACUAUGC GCG AGGGAAACAU | 12841 | ATGTTTCCCT G CAAGA | 5778 |
| 2152 | GCAGG UGAUG GCAUGCACUAUGC GCG AUAGGUGCCU | 12842 | AGGCACCTAT G CCTGC | 5779 |
| 2156 | CUCUG UGAUG GCAUGCACUAUGC GCG AGGCAUAGGU | 12843 | ACCTATGCCT G CAGAG | 5780 |
| 2170 | GUAUA UGAUG GCAUGCACUAUGC GCG AUUCCUGGCU | 12844 | AGCCAGGAAT G TATAC | 5781 |
| 2241 | UUUCG UGAUG GCAUGCACUAUGC GCG AGGAGGUAUG | 12845 | CATACCTCCT G CGAAA | 5782 |
| 2243 | GGUUU UGAUG GCAUGCACUAUGC GCG GCAGGAGGUA | 12846 | TACCTCCTGC G AAACC | 5783 |
| 2254 | GUGAU UGAUG GCAUGCACUAUGC GCG ACUGAGGUUU | 12847 | AAACCTCAGT G ATCAC | 5784 |
| 2294 | CAUGA UGAUG GCAUGCACUAUGC GCG AGUCUAAAGU | 12848 | ACTTTAGACT G TCATG | 5785 |
| 2299 | AUUAG UGAUG GCAUGCACUAUGC GCG AUGACAGUCU | 12849 | AGACTGTCAT G CTAAT | 5786 |
| 2308 | GGGGA UGAUG GCAUGCACUAUGC GCG ACCAUUAGCA | 12850 | TGCTAATGGT G TCCCC | 5787 |
| 2314 | AGGCU UGAUG GCAUGCACUAUGC GCG GGGGACACCA | 12851 | TGGTGTCCCC G AGCCT | 5788 |
| 2394 | AACAG UGAUG GCAUGCACUAUGC GCG GUGCUGCUUC | 12852 | GAAGCAGCAC G CTGTT | 5789 |
| 2397 | AUAAA UGAUG GCAUGCACUAUGC GCG AGCGUGCUGC | 12853 | GCAGCACGCT G TTTAT | 5790 |
| 2404 | UCUUU UGAUG GCAUGCACUAUGC GCG AAUAAACAGC | 12854 | GCTGTTTATT G AAAGA | 5791 |
| 2425 | ACCUU UGAUG GCAUGCACUAUGC GCG AUCCUCUUCU | 12855 | AGAAGAGGAT G AAGGT | 5792 |
| 2431 | AUAGA UGAUG GCAUGCACUAUGC GCG ACCUUCAUCC | 12856 | GGATGAAGGT G TCTAT | 5793 |
| 2441 | CUUUG UGAUG GCAUGCACUAUGC GCG AGUGAUAGAC | 12857 | GTCTATCACT G CAAAG | 5794 |
| 2467 | UUCCA UGAUG GCAUGCACUAUGC GCG AGAGCCCUUC | 12858 | GAAGGGCTCT G TGGAA | 5795 |
| 2491 | UUGAA UGAUG GCAUGCACUAUGC GCG AGUGAGGUAU | 12859 | ATACCTCACT G TTCAA | 5796 |
| 2526 | GUGAU UGAUG GCAUGCACUAUGC GCG AGCUCCAGAU | 12860 | ATCTGGAGCT G ATCAC | 5797 |
| 2540 | AGGUG UGAUG GCAUGCACUAUGC GCG AUGUUAGAGU | 12861 | ACTCTAACAT G CACCT | 5798 |
| 2546 | CCACA UGAUG GCAUGCACUAUGC GCG AGGUGCAUGU | 12862 | ACATGCACCT G TGTGG | 5799 |
| 2548 | AGCCA UGAUG GCAUGCACUAUGC GCG ACAGGUGCAU | 12863 | ATGCACCTGT G TGGCT | 5800 |
| 2554 | AGUCG UGAUG GCAUGCACUAUGC GCG AGCCACACAG | 12864 | CTGTGTGGCT G CGACT | 5801 |
| 2556 | AGAGU UGAUG GCAUGCACUAUGC GCG GCAGCCACAC | 12865 | GTGTGGCTGC G ACTCT | 5802 |
| 2591 | UUUUU UGAUG GCAUGCACUAUGC GCG GGAUAAGGAG | 12866 | CTCCTTATCC G AAAAA | 5803 |

254

| | | | | |
|---|---|---|---|---|
| 2598 | CUUUU UGAUG GCAUGCACUAUGC GCG AUUUUUCGGA | 12867 | TCCGAAAAAT G AAAAG | 5804 |
| 2614 | UAUUU UGAUG GCAUGCACUAUGC GCG AGAAGAAGAC | 12868 | GTCTTCTTCT G AAATA | 5805 |
| 2626 | GUAGU UGAUG GCAUGCACUAUGC GCG AGUCUUUAUU | 12869 | AATAAAGACT G ACTAC | 5806 |
| 2656 | AACUU UGAUG GCAUGCACUAUGC GCG AUCUGGGUCC | 12870 | GGACCCAGAT G AAGTT | 5807 |
| 2671 | CUGCU UGAUG GCAUGCACUAUGC GCG AUCCAAAGGA | 12871 | TCCTTTGGAT G AGCAG | 5808 |
| 2678 | GCUCA UGAUG GCAUGCACUAUGC GCG ACUGCUCAUC | 12872 | GATGAGCAGT G TGAGC | 5809 |
| 2680 | CCGCU UGAUG GCAUGCACUAUGC GCG ACACUGCUCA | 12873 | TGAGCAGTGT G AGCGG | 5810 |
| 2695 | GGCAU UGAUG GCAUGCACUAUGC GCG AUAAGGGAGC | 12874 | GCTCCCTTAT G ATGCC | 5811 |
| 2698 | GCUGG UGAUG GCAUGCACUAUGC GCG AUCAUAAGGG | 12875 | CCCTTATGAT G CCAGC | 5812 |
| 2716 | CCGGG UGAUG GCAUGCACUAUGC GCG AAACUCCCAC | 12876 | GTGGGAGTTT G CCCGG | 5813 |
| 2813 | UCCGG UGAUG GCAUGCACUAUGC GCG ACGUAGGUGA | 12877 | TCACCTACGT G CCGGA | 5814 |
| 2821 | AGCCA UGAUG GCAUGCACUAUGC GCG AGUCCGGCAC | 12878 | GTGCCGGACT G TGGCT | 5815 |
| 2827 | UUUCA UGAUG GCAUGCACUAUGC GCG AGCCACAGUC | 12879 | GACTGTGGCT G TGAAA | 5816 |
| 2829 | AUUUU UGAUG GCAUGCACUAUGC GCG ACAGCCACAG | 12880 | CTGTGGCTGT G AAAAT | 5817 |
| 2835 | UUCAG UGAUG GCAUGCACUAUGC GCG AUUUUCACAG | 12881 | CTGTGAAAAT G CTGAA | 5818 |
| 2838 | UCUUU UGAUG GCAUGCACUAUGC GCG AGCAUUUUCA | 12882 | TGAAAATGCT G AAAGA | 5819 |
| 2860 | GUACU UGAUG GCAUGCACUAUGC GCG GCUGGCCGUG | 12883 | CACGGCCAGC G AGTAC | 5820 |
| 2874 | GUCAU UGAUG GCAUGCACUAUGC GCG AGAGCUUUGU | 12884 | ACAAAGCTCT G ATGAC | 5821 |
| 2877 | UCAGU UGAUG GCAUGCACUAUGC GCG AUCAGAGCUU | 12885 | AAGCTCTGAT G ACTGA | 5822 |
| 2881 | UAGCU UGAUG GCAUGCACUAUGC GCG AGUCAUCAGA | 12886 | TCTGATGACT G AGCTA | 5823 |
| 2895 | UGGGU UGAUG GCAUGCACUAUGC GCG AAGAUUUUUA | 12887 | TAAAAATCTT G ACCCA | 5824 |
| 2916 | ACGUU UGAUG GCAUGCACUAUGC GCG AGAUGGUGGC | 12888 | GCCACCATCT G AACGT | 5825 |
| 2931 | CCCAG UGAUG GCAUGCACUAUGC GCG AGGUUAACCA | 12889 | TGGTTAACCT G CTGGG | 5826 |
| 2942 | UGGUG UGAUG GCAUGCACUAUGC GCG AGGCUCCCAG | 12890 | CTGGGAGCCT G CACCA | 5827 |
| 2964 | ACCAU UGAUG GCAUGCACUAUGC GCG AGAGGCCCUC | 12891 | GAGGGCCTCT G ATGGT | 5828 |
| 2970 | ACAAU UGAUG GCAUGCACUAUGC GCG ACCAUCAGAG | 12892 | CTCTGATGGT G ATTGT | 5829 |
| 2974 | UUCAA UGAUG GCAUGCACUAUGC GCG AAUCACCAUC | 12893 | GATGGTGATT G TTGAA | 5830 |
| 2977 | GUAUU UGAUG GCAUGCACUAUGC GCG AACAAUCACC | 12894 | GGTGATTGTT G AATAC | 5831 |
| 2984 | AUUUG UGAUG GCAUGCACUAUGC GCG AGUAUUCAAC | 12895 | GTTGAATACT G CAAAT | 5832 |
| 3025 | UAAGU UGAUG GCAUGCACUAUGC GCG ACGUUUGCUC | 12896 | GAGCAAACGT G ACTTA | 5833 |
| 3049 | UGCUG UGAUG GCAUGCACUAUGC GCG AUCCUUGUUG | 12897 | CAACAAGGAT G CAGCA | 5834 |
| 3139 | GCUUU UGAUG GCAUGCACUAUGC GCG GCUGCUGGUG | 12898 | CACCAGCAGC G AAAGC | 5835 |
| 3148 | GCUCG UGAUG GCAUGCACUAUGC GCG AAAGCUUUCG | 12899 | CGAAAGCTTT G CGAGC | 5836 |

| | | | | |
|---|---|---|---|---|
| 3150 | GAGCU UGAUG GCAUGCACUAUGC GCG GCAAAGCUUU | 12900 | AAAGCTTTGC G AGCTC | 5837 |
| 3180 | UCACU UGAUG GCAUGCACUAUGC GCG AGACUUUUAU | 12901 | ATAAAAGTCT G AGTGA | 5838 |
| 3184 | AACAU UGAUG GCAUGCACUAUGC GCG ACUCAGACUU | 12902 | AAGTCTGAGT G ATGTT | 5839 |
| 3187 | CUCAA UGAUG GCAUGCACUAUGC GCG AUCACUCAGA | 12903 | TCTGAGTGAT G TTGAG | 5840 |
| 3190 | UUCCU UGAUG GCAUGCACUAUGC GCG AACAUCACUC | 12904 | GAGTGATGTT G AGGAA | 5841 |
| 3208 | ACCGU UGAUG GCAUGCACUAUGC GCG AGAAUCCUCC | 12905 | GGAGGATTCT G ACGGT | 5842 |
| 3246 | GAAAU UGAUG GCAUGCACUAUGC GCG AGAUCUUCCA | 12906 | TGGAAGATCT G ATTTC | 5843 |
| 3288 | GAAGA UGAUG GCAUGCACUAUGC GCG AGGAACUCCA | 12907 | TGGAGTTCCT G TCTTC | 5844 |
| 3302 | GAAUG UGAUG GCAUGCACUAUGC GCG ACUUUCUGGA | 12908 | TCCAGAAAGT G CATTC | 5845 |
| 3324 | UUUCU UGAUG GCAUGCACUAUGC GCG GCUGCCAGGU | 12909 | ACCTGGCAGC G AGAAA | 5846 |
| 3343 | GUUCU UGAUG GCAUGCACUAUGC GCG AGAUAAAAGA | 12910 | TCTTTTATCT G AGAAC | 5847 |
| 3357 | AUCUU UGAUG GCAUGCACUAUGC GCG ACCACGUUGU | 12911 | ACAACGTGGT G AAGAT | 5848 |
| 3365 | AAUCA UGAUG GCAUGCACUAUGC GCG AAAUCUUCAC | 12912 | GTGAAGATTT G TGATT | 5849 |
| 3367 | AAAAU UGAUG GCAUGCACUAUGC GCG ACAAAUCUUC | 12913 | GAAGATTTGT G ATTTT | 5850 |
| 3379 | CCGGG UGAUG GCAUGCACUAUGC GCG AAGGCCAAAA | 12914 | TTTTGGCCTT G CCCGG | 5851 |
| 3403 | AUAAU UGAUG GCAUGCACUAUGC GCG GGGGUUCUUA | 12915 | TAAGAACCCC G ATTAT | 5852 |
| 3409 | UCUCA UGAUG GCAUGCACUAUGC GCG AUAAUCGGGG | 12916 | CCCCGATTAT G TGAGA | 5853 |
| 3411 | UUUCU UGAUG GCAUGCACUAUGC GCG ACAUAAUCGG | 12917 | CCGATTATGT G AGAAA | 5854 |
| 3428 | GAAGU UGAUG GCAUGCACUAUGC GCG GAGUAUCUCC | 12918 | GGAGATACTC G ACTTC | 5855 |
| 3438 | CAUUU UGAUG GCAUGCACUAUGC GCG AGAGGAAGUC | 12919 | GACTTCCTCT G AAATG | 5856 |
| 3454 | AGAUU UGAUG GCAUGCACUAUGC GCG GGGAGCCAUC | 12920 | GATGGCTCCC G AATCT | 5857 |
| 3466 | UUUGU UGAUG GCAUGCACUAUGC GCG AAAGAUAGAU | 12921 | ATCTATCTTT G ACAAA | 5858 |
| 3490 | CACGU UGAUG GCAUGCACUAUGC GCG GCUCUUGGUG | 12922 | CACCAAGAGC G ACGTG | 5859 |
| 3495 | GACCA UGAUG GCAUGCACUAUGC GCG ACGUCGCUCU | 12923 | AGAGCGACGT G TGGTC | 5860 |
| 3513 | CACAG UGAUG GCAUGCACUAUGC GCG AAUACUCCGU | 12924 | ACGGAGTATT G CTGTG | 5861 |
| 3516 | UCCCA UGAUG GCAUGCACUAUGC GCG AGCAAUACUC | 12925 | GAGTATTGCT G TGGGA | 5862 |
| 3568 | GUCCU UGAUG GCAUGCACUAUGC GCG AUCCAUUUGU | 12926 | ACAAATGGAT G AGGAC | 5863 |
| 3578 | GACUG UGAUG GCAUGCACUAUGC GCG AAAAGUCCUC | 12927 | GAGGACTTTT G CAGTC | 5864 |
| 3584 | UCAGG UGAUG GCAUGCACUAUGC GCG GACUGCAAAA | 12928 | TTTTGCAGTC G CCTGA | 5865 |
| 3588 | UCCCU UGAUG GCAUGCACUAUGC GCG AGGCGACUGC | 12929 | GCAGTCGCCT G AGGGA | 5866 |
| 3600 | AUCCU UGAUG GCAUGCACUAUGC GCG AUGCCUUCCC | 12930 | GGGAAGGCAT G AGGAT | 5867 |
| 3606 | GCUCU UGAUG GCAUGCACUAUGC GCG AUCCUCAUGC | 12931 | GCATGAGGAT G AGAGC | 5868 |
| 3616 | GUACU UGAUG GCAUGCACUAUGC GCG AGGAGCUCUC | 12932 | GAGAGCTCCT G AGTAC | 5869 |

256

| | | | | |
|---|---|---|---|---|
| 3631 | GAUUU UGAUG GCAUGCACUAUGC GCG AGGAGUAGAG | 12933 | CTCTACTCCT G AAATC | 5870 |
| 3648 | UCCAG UGAUG GCAUGCACUAUGC GCG AUGAUCUGAU | 12934 | ATCAGATCAT G CTGGA | 5871 |
| 3656 | GCCAG UGAUG GCAUGCACUAUGC GCG AGUCCAGCAU | 12935 | ATGCTGGACT G CTGGC | 5872 |
| 3691 | UUCUG UGAUG GCAUGCACUAUGC GCG AAAUCUUGGC | 12936 | GCCAAGATTT G CAGAA | 5873 |
| 3700 | UUCCA UGAUG GCAUGCACUAUGC GCG AAGUUCUGCA | 12937 | TGCAGAACTT G TGGAA | 5874 |
| 3715 | CAAAU UGAUG GCAUGCACUAUGC GCG ACCUAGUUUU | 12938 | AAAACTAGGT G ATTTG | 5875 |
| 3720 | UGAAG UGAUG GCAUGCACUAUGC GCG AAAUCACCUA | 12939 | TAGGTGATTT G CTTCA | 5876 |
| 3733 | UUGUA UGAUG GCAUGCACUAUGC GCG AUUUGCUUGA | 12940 | TCAAGCAAAT G TACAA | 5877 |
| 3769 | UAUGG UGAUG GCAUGCACUAUGC GCG AUUGAUUGGG | 12941 | CCCAATCAAT G CCATA | 5878 |
| 3777 | CCUGU UGAUG GCAUGCACUAUGC GCG AGUAUGGCAU | 12942 | ATGCCATACT G ACAGG | 5879 |
| 3811 | GAAGG UGAUG GCAUGCACUAUGC GCG AGGAGUUGAG | 12943 | CTCAACTCCT G CCTTC | 5880 |
| 3820 | GUCCU UGAUG GCAUGCACUAUGC GCG AGAGAAGGCA | 12944 | TGCCTTCTCT G AGGAC | 5881 |
| 3852 | AACUU UGAUG GCAUGCACUAUGC GCG GGAGCUGAAA | 12945 | TTTCAGCTCC G AAGTT | 5882 |
| 3874 | AUCAU UGAUG GCAUGCACUAUGC GCG AGAGCUUCCU | 12946 | AGGAAGCTCT G ATGAT | 5883 |
| 3877 | GACAU UGAUG GCAUGCACUAUGC GCG AUCAGAGCUU | 12947 | AAGCTCTGAT G ATGTC | 5884 |
| 3880 | UCUGA UGAUG GCAUGCACUAUGC GCG AUCAUCAGAG | 12948 | CTCTGATGAT G TCAGA | 5885 |
| 3889 | AUUUA UGAUG GCAUGCACUAUGC GCG AUAUCUGACA | 12949 | TGTCAGATAT G TAAAT | 5886 |
| 3895 | GAAAG UGAUG GCAUGCACUAUGC GCG AUUUACAUAU | 12950 | ATATGTAAAT G CTTTC | 5887 |
| 3909 | AGGCU UGAUG GCAUGCACUAUGC GCG AUGAACUUGA | 12951 | TCAAGTTCAT G AGCCT | 5888 |
| 3934 | UUCUU UGAUG GCAUGCACUAUGC GCG AAAGGUUUUG | 12952 | CAAAACCTTT G AAGAA | 5889 |
| 3948 | GCAUU UGAUG GCAUGCACUAUGC GCG GGUAAAAGUU | 12953 | AACTTTTACC G AATGC | 5890 |
| 3952 | GGUGG UGAUG GCAUGCACUAUGC GCG AUUCGGUAAA | 12954 | TTTACCGAAT G CCACC | 5891 |
| 3963 | UCAAA UGAUG GCAUGCACUAUGC GCG AUGGAGGUGG | 12955 | CCACCTCCAT G TTTGA | 5892 |
| 3967 | GUCAU UGAUG GCAUGCACUAUGC GCG AAACAUGGAG | 12956 | CTCCATGTTT G ATGAC | 5893 |
| 3970 | GUAGU UGAUG GCAUGCACUAUGC GCG AUCAAACAUG | 12957 | CATGTTTGAT G ACTAC | 5894 |
| 3982 | GCUGU UGAUG GCAUGCACUAUGC GCG GCCCUGGUAG | 12958 | CTACCAGGGC G ACAGC | 5895 |
| 3996 | GCCAA UGAUG GCAUGCACUAUGC GCG AGAGUGCUGC | 12959 | GCAGCACTCT G TTGGC | 5896 |
| 4011 | UUCAG UGAUG GCAUGCACUAUGC GCG AUGGGAGAGG | 12960 | CCTCTCCCAT G CTGAA | 5897 |
| 4014 | CGCUU UGAUG GCAUGCACUAUGC GCG AGCAUGGGAG | 12961 | CTCCCATGCT G AAGCG | 5898 |
| 4019 | UGAAG UGAUG GCAUGCACUAUGC GCG GCUUCAGCAU | 12962 | ATGCTGAAGC G CTTCA | 5899 |
| 4033 | GCUGU UGAUG GCAUGCACUAUGC GCG AGUCCAGGUG | 12963 | CACCTGGACT G ACAGC | 5900 |
| 4053 | UUGAG UGAUG GCAUGCACUAUGC GCG GAGGCCUUGG | 12964 | CCAAGGCCTC G CTCAA | 5901 |
| 4063 | CAAGU UGAUG GCAUGCACUAUGC GCG AAUCUUGAGC | 12965 | GCTCAAGATT G ACTTG | 5902 |

257

| | | | | |
|---|---|---|---|---|
| 4068 | ACUCU UGAUG GCAUGCACUAUGC GCG AAGUCAAUCU | 12966 | AGATTGACTT G AGAGT | 5903 |
| 4101 | UCAGA UGAUG GCAUGCACUAUGC GCG AGCCCCGACU | 12967 | AGTCGGGGCT G TCTGA | 5904 |
| 4105 | GACAU UGAUG GCAUGCACUAUGC GCG AGACAGCCCC | 12968 | GGGGCTGTCT G ATGTC | 5905 |
| 4108 | GCUGA UGAUG GCAUGCACUAUGC GCG AUCAGACAGC | 12969 | GCTGTCTGAT G TCAGC | 5906 |
| 4127 | AAUGG UGAUG GCAUGCACUAUGC GCG AGAAACUGGG | 12970 | CCCAGTTTCT G CCATT | 5907 |
| 4139 | GCCCA UGAUG GCAUGCACUAUGC GCG AGCUGGAAUG | 12971 | CATTCCAGCT G TGGGC | 5908 |
| 4153 | GCCUU UGAUG GCAUGCACUAUGC GCG GCUGACGUGC | 12972 | GCACGTCAGC G AAGGC | 5909 |
| 4163 | ACCUG UGAUG GCAUGCACUAUGC GCG GCUUGCCUUC | 12973 | GAAGGCAAGC G CAGGT | 5910 |
| 4177 | GUGGU UGAUG GCAUGCACUAUGC GCG GUAGGUGAAC | 12974 | GTTCACCTAC G ACCAC | 5911 |
| 4183 | CUCAG UGAUG GCAUGCACUAUGC GCG GUGGUCGUAG | 12975 | CTACGACCAC G CTGAG | 5912 |
| 4186 | CAGCU UGAUG GCAUGCACUAUGC GCG AGCGUGGUCG | 12976 | CGACCACGCT G AGCTG | 5913 |
| 4204 | GCACG UGAUG GCAUGCACUAUGC GCG GAUUUUCCUU | 12977 | AAGGAAAATC G CGTGC | 5914 |
| 4208 | AGCAG UGAUG GCAUGCACUAUGC GCG ACGCGAUUUU | 12978 | AAAATCGCGT G CTGCT | 5915 |
| 4211 | GGGAG UGAUG GCAUGCACUAUGC GCG AGCACGCGAU | 12979 | ATCGCGTGCT G CTCCC | 5916 |
| 4218 | GGGGG UGAUG GCAUGCACUAUGC GCG GGGGAGCAGC | 12980 | GCTGCTCCCC G CCCCC | 5917 |
| 4245 | GAGUA UGAUG GCAUGCACUAUGC GCG AGGACCACCG | 12981 | CGGTGGTCCT G TACTC | 5918 |
| 4272 | CGUGU UGAUG GCAUGCACUAUGC GCG AAACUCUAGA | 12982 | TCTAGAGTTT G ACACG | 5919 |
| 4277 | GGCUU UGAUG GCAUGCACUAUGC GCG GUGUCAAACU | 12983 | AGTTTGACAC G AAGCC | 5920 |
| 4301 | AUACA UGAUG GCAUGCACUAUGC GCG AUGUGCUUCU | 12984 | AGAAGCACAT G TGTAT | 5921 |
| 4303 | AAAUA UGAUG GCAUGCACUAUGC GCG ACAUGUGCUU | 12985 | AAGCACATGT G TATTT | 5922 |
| 4332 | ACUGG UGAUG GCAUGCACUAUGC GCG AAAAGCUAGU | 12986 | ACTAGCTTTT G CCAGT | 5923 |
| 4343 | AUAUG UGAUG GCAUGCACUAUGC GCG AUAAUACUGG | 12987 | CCAGTATTAT G CATAT | 5924 |
| 4386 | AAAAG UGAUG GCAUGCACUAUGC GCG AGCUGGCUCC | 12988 | GGAGCCAGCT G CTTTT | 5925 |
| 4393 | AAUCA UGAUG GCAUGCACUAUGC GCG AAAAAGCAGC | 12989 | GCTGCTTTTT G TGATT | 5926 |
| 4395 | AAAAU UGAUG GCAUGCACUAUGC GCG ACAAAAAGCA | 12990 | TGCTTTTTGT G ATTTT | 5927 |
| 4410 | AAAAG UGAUG GCAUGCACUAUGC GCG ACUAUUAAAA | 12991 | TTTTAATAGT G CTTTT | 5928 |
| 4423 | UUAGU UGAUG GCAUGCACUAUGC GCG AAAAAAAAAA | 12992 | TTTTTTTTTT G ACTAA | 5929 |
| 4436 | AGUUA UGAUG GCAUGCACUAUGC GCG AUUCUUGUUA | 12993 | TAACAAGAAT G TAACT | 5930 |
| 4459 | CUUGU UGAUG GCAUGCACUAUGC GCG ACUAUUUCUC | 12994 | GAGAAATAGT G ACAAG | 5931 |
| 4466 | UUCUU UGAUG GCAUGCACUAUGC GCG ACUUGUCACU | 12995 | AGTGACAAGT G AAGAA | 5932 |
| 4479 | UUUAG UGAUG GCAUGCACUAUGC GCG AGUAGUGUUC | 12996 | GAACACTACT G CTAAA | 5933 |
| 4492 | AGUAA UGAUG GCAUGCACUAUGC GCG AUGAGGAUUU | 12997 | AAATCCTCAT G TTACT | 5934 |
| 4502 | UCUAA UGAUG GCAUGCACUAUGC GCG ACUGAGUAAC | 12998 | GTTACTCAGT G TTAGA | 5935 |

| | | | | |
|---|---|---|---|---|
| 4529 | GAAGU UGAUG GCAUGCACUAUGC GCG AUUGGGUUUA | 12999 | TAAACCCAAT G ACTTC | 5936 |
| 4538 | UGGAG UGAUG GCAUGCACUAUGC GCG AGGGAAGUCA | 13000 | TGACTTCCCT G CTCCA | 5937 |
| 4550 | GGUGG UGAUG GCAUGCACUAUGC GCG GGGGGUUGGA | 13001 | TCCAACCCCC G CCACC | 5938 |
| 4565 | UCCUG UGAUG GCAUGCACUAUGC GCG GUGCCCUGAG | 13002 | CTCAGGGCAC G CAGGA | 5939 |
| 4578 | UCAAU UGAUG GCAUGCACUAUGC GCG AAACUGGUCC | 13003 | GGACCAGTTT G ATTGA | 5940 |
| 4582 | CUCCU UGAUG GCAUGCACUAUGC GCG AAUCAAACUG | 13004 | CAGTTTGATT G AGGAG | 5941 |
| 4590 | CAGUG UGAUG GCAUGCACUAUGC GCG AGCUCCUCAA | 13005 | TTGAGGAGCT G CACTG | 5942 |
| 4595 | GUGAU UGAUG GCAUGCACUAUGC GCG AGUGCAGCUC | 13006 | GAGCTGCACT G ATCAC | 5943 |
| 4606 | UGAUG UGAUG GCAUGCACUAUGC GCG AUUGGGUGAU | 13007 | ATCACCCAAT G CATCA | 5944 |
| 4634 | GGCUG UGAUG GCAUGCACUAUGC GCG AGGGCUGGCC | 13008 | GGCCAGCCCT G CAGCC | 5945 |
| 4691 | UUGCU UGAUG GCAUGCACUAUGC GCG AGGCCAGCCA | 13009 | TGGCTGGCCT G AGCAA | 5946 |
| 4730 | CCUCA UGAUG GCAUGCACUAUGC GCG AUGUCUUAGG | 13010 | CCTAAGACAT G TGAGG | 5947 |
| 4732 | CUCCU UGAUG GCAUGCACUAUGC GCG ACAUGUCUUA | 13011 | TAAGACATGT G AGGAG | 5948 |
| 4792 | UUUCU UGAUG GCAUGCACUAUGC GCG AUGCCUUCUC | 13012 | GAGAAGGCAT G AGAAA | 5949 |
| 4804 | CGUCU UGAUG GCAUGCACUAUGC GCG AAAUUCUUUC | 13013 | GAAAGAATTT G AGACG | 5950 |
| 4809 | UGGUG UGAUG GCAUGCACUAUGC GCG GUCUCAAAUU | 13014 | AATTTGAGAC G CACCA | 5951 |
| 4816 | GCCCA UGAUG GCAUGCACUAUGC GCG AUGGUGCGUC | 13015 | GACGCACCAT G TGGGC | 5952 |
| 4847 | AAUGG UGAUG GCAUGCACUAUGC GCG AUUGCUGAGC | 13016 | GCTCAGCAAT G CCATT | 5953 |
| 4872 | AGGGU UGAUG GCAUGCACUAUGC GCG AGAGCUGGGA | 13017 | TCCCAGCTCT G ACCCT | 5954 |
| 4887 | GCCCU UGAUG GCAUGCACUAUGC GCG AAAUGUAGAA | 13018 | TTCTACATTT G AGGGC | 5955 |
| 4916 | CUCAU UGAUG GCAUGCACUAUGC GCG GCUGUCCAUC | 13019 | GATGGACAGC G ATGAG | 5956 |
| 4919 | CCCCU UGAUG GCAUGCACUAUGC GCG AUCGCUGUCC | 13020 | GGACAGCGAT G AGGGG | 5957 |
| 5018 | AUGGA UGAUG GCAUGCACUAUGC GCG AUAGAACCAC | 13021 | GTGGTTCTAT G TCCAT | 5958 |
| 5039 | CAAAA UGAUG GCAUGCACUAUGC GCG AUGCCACGAA | 13022 | TTCGTGGCAT G TTTTG | 5959 |
| 5044 | CAAAU UGAUG GCAUGCACUAUGC GCG AAAACAUGCC | 13023 | GGCATGTTTT G ATTTG | 5960 |
| 5049 | UGCUA UGAUG GCAUGCACUAUGC GCG AAAUCAAAAC | 13024 | GTTTTGATTT G TAGCA | 5961 |
| 5057 | ACCCU UGAUG GCAUGCACUAUGC GCG AGUGCUACAA | 13025 | TTGTAGCACT G AGGGT | 5962 |
| 5076 | GGGCU UGAUG GCAUGCACUAUGC GCG AGAGUUGAGU | 13026 | ACTCAACTCT G AGCCC | 5963 |
| 5107 | CAGUG UGAUG GCAUGCACUAUGC GCG AUCUUACUAG | 13027 | CTAGTAAGAT G CACTG | 5964 |
| 5112 | GUUUU UGAUG GCAUGCACUAUGC GCG AGUGCAUCUU | 13028 | AAGATGCACT G AAAAC | 5965 |
| 5135 | GGAGA UGAUG GCAUGCACUAUGC GCG AACCUAACUC | 13029 | GAGTTAGGTT G TCTCC | 5966 |
| 5148 | GCCAU UGAUG GCAUGCACUAUGC GCG AUGGCCUGGA | 13030 | TCCAGGCCAT G ATGGC | 5967 |
| 5162 | AUUUU UGAUG GCAUGCACUAUGC GCG AGUGUAAGGC | 13031 | GCCTTACACT G AAAAT | 5968 |

| | | | | |
|---|---|---|---|---|
| 5168 | UGUGA UGAUG GCAUGCACUAUGC GCG AUUUUCAGUG | 13032 | CACTGAAAAT G TCACA | 5969 |
| 5234 | CAAAA UGAUG GCAUGCACUAUGC GCG AGAAUAAUAC | 13033 | GTATTATTCT G TTTTG | 5970 |
| 5239 | CUGUG UGAUG GCAUGCACUAUGC GCG AAAACAGAAU | 13034 | ATTCTGTTTT G CACAG | 5971 |
| 5251 | UUUCA UGAUG GCAUGCACUAUGC GCG AACUAACUGU | 13035 | ACAGTTAGTT G TGAAA | 5972 |
| 5253 | UCUUU UGAUG GCAUGCACUAUGC GCG ACAACUAACU | 13036 | AGTTAGTTGT G AAAGA | 5973 |
| 5264 | CUUCU UGAUG GCAUGCACUAUGC GCG AGCUUUCUUU | 13037 | AAAGAAAGCT G AGAAG | 5974 |
| 5273 | AUUUU UGAUG GCAUGCACUAUGC GCG AUUCUUCUCA | 13038 | TGAGAAGAAT G AAAAT | 5975 |
| 5279 | GACUG UGAUG GCAUGCACUAUGC GCG AUUUUCAUUC | 13039 | GAATGAAAAT G CAGTC | 5976 |
| 5287 | CUCCU UGAUG GCAUGCACUAUGC GCG AGGACUGCAU | 13040 | ATGCAGTCCT G AGGAG | 5977 |
| 5313 | GCCCU UGAUG GCAUGCACUAUGC GCG GUUUUGAUAU | 13041 | ATATCAAAAC G AGGGC | 5978 |
| 5320 | UCCAU UGAUG GCAUGCACUAUGC GCG AGCCCUCGUU | 13042 | AACGAGGGCT G ATGGA | 5979 |
| 5469 | CCUUU UGAUG GCAUGCACUAUGC GCG AGAUUAGUGU | 13043 | ACACTAATCT G AAAGG | 5980 |
| 5477 | UUCCA UGAUG GCAUGCACUAUGC GCG AUCCUUUCAG | 13044 | CTGAAAGGAT G TGGAA | 5981 |
| 5497 | AUAUG UGAUG GCAUGCACUAUGC GCG GCCAGCUAAU | 13045 | ATTAGCTGGC G CATAT | 5982 |
| 5522 | UUACU UGAUG GCAUGCACUAUGC GCG AAGGAGCUUA | 13046 | TAAGCTCCTT G AGTAA | 5983 |
| 5539 | AAUUA UGAUG GCAUGCACUAUGC GCG AUACCACCUU | 13047 | AAGGTGGTAT G TAATT | 5984 |
| 5548 | CCUUG UGAUG GCAUGCACUAUGC GCG AUAAAUUACA | 13048 | TGTAATTTAT G CAAGG | 5985 |
| 5589 | UGGCU UGAUG GCAUGCACUAUGC GCG AUUAACUAAU | 13049 | ATTAGTTAAT G AGCCA | 5986 |
| 5623 | CAAAG UGAUG GCAUGCACUAUGC GCG AGUUGAAAAU | 13050 | ATTTTCAACT G CTTTG | 5987 |
| 5628 | AGUUU UGAUG GCAUGCACUAUGC GCG AAAGCAGUUG | 13051 | CAACTGCTTT G AAACT | 5988 |
| 5635 | CCAGG UGAUG GCAUGCACUAUGC GCG AAGUUUCAAA | 13052 | TTTGAAACTT G CCTGG | 5989 |
| 5646 | AUGCU UGAUG GCAUGCACUAUGC GCG AGACCCCAGG | 13053 | CCTGGGGTCT G AGCAT | 5990 |
| 5652 | CCCAU UGAUG GCAUGCACUAUGC GCG AUGCUCAGAC | 13054 | GTCTGAGCAT G ATGGG | 5991 |
| 5684 | GUAGG UGAUG GCAUGCACUAUGC GCG GCCCUUUCCU | 13055 | AGGAAAGGGC G CCTAC | 5992 |
| 5725 | CUUAG UGAUG GCAUGCACUAUGC GCG GAUCCAAGGC | 13056 | GCCTTGGATC G CTAAG | 5993 |
| 5739 | UCAAA UGAUG GCAUGCACUAUGC GCG AGAGCCAGCU | 13057 | AGCTGGCTCT G TTTGA | 5994 |
| 5743 | AGCAU UGAUG GCAUGCACUAUGC GCG AAACAGAGCC | 13058 | GGCTCTGTTT G ATGCT | 5995 |
| 5746 | AAUAG UGAUG GCAUGCACUAUGC GCG AUCAAACAGA | 13059 | TCTGTTTGAT G CTATT | 5996 |
| 5755 | ACUUG UGAUG GCAUGCACUAUGC GCG AUAAAUAGCA | 13060 | TGCTATTTAT G CAAGT | 5997 |
| 5771 | AAAUA UGAUG GCAUGCACUAUGC GCG AUAGACCCUA | 13061 | TAGGGTCTAT G TATTT | 5998 |
| 5782 | AGGCG UGAUG GCAUGCACUAUGC GCG AUCCUAAAUA | 13062 | TATTTAGGAT G CGCCT | 5999 |
| 5784 | GUAGG UGAUG GCAUGCACUAUGC GCG GCAUCCUAAA | 13063 | TTTAGGATGC G CCTAC | 6000 |
| 5825 | CUUAG UGAUG GCAUGCACUAUGC GCG GAUCCAAGGC | 13056 | GCCTTGGATC G CTAAG | 5993 |

260

| | | | | |
|---|---|---|---|---|
| 5839 | UCAAA UGAUG GCAUGCACUAUGC GCG AGAGCCAGCU | 13057 | AGCTGGCTCT G TTTGA | 5994 |
| 5843 | AGCAU UGAUG GCAUGCACUAUGC GCG AAACAGAGCC | 13058 | GGCTCTGTTT G ATGCT | 5995 |
| 5846 | AAUAG UGAUG GCAUGCACUAUGC GCG AUCAAACAGA | 13059 | TCTGTTTGAT G CTATT | 5996 |
| 5855 | ACUUG UGAUG GCAUGCACUAUGC GCG AUAAAUAGCA | 13060 | TGCTATTTAT G CAAGT | 5997 |
| 5871 | AAAUA UGAUG GCAUGCACUAUGC GCG AUAGACCCUA | 13061 | TAGGGTCTAT G TATTT | 5998 |
| 5882 | GCAGA UGAUG GCAUGCACUAUGC GCG AUCCUAAAUA | 13064 | TATTTAGGAT G TCTGC | 6001 |
| 5886 | AGGUG UGAUG GCAUGCACUAUGC GCG AGACAUCCUA | 13065 | TAGGATGTCT G CACCT | 6002 |
| 5895 | GGCUG UGAUG GCAUGCACUAUGC GCG AGAAGGUGCA | 13066 | TGCACCTTCT G CAGCC | 6003 |
| 5931 | AGCAG UGAUG GCAUGCACUAUGC GCG AAUCCACUGU | 13067 | ACAGTGGATT G CTGCT | 6004 |
| 5934 | AGAAG UGAUG GCAUGCACUAUGC GCG AGCAAUCCAC | 13068 | GTGGATTGCT G CTTCT | 6005 |
| 5955 | GGAAG UGAUG GCAUGCACUAUGC GCG AUACUCUUCU | 13069 | AGAAGAGTAT G CTTCC | 6006 |
| 5971 | AAUUA UGAUG GCAUGCACUAUGC GCG AUGGAUAAAA | 13070 | TTTTATCCAT G TAATT | 6007 |
| 5982 | UUCUA UGAUG GCAUGCACUAUGC GCG AGUUAAAUUA | 13071 | TAATTTAACT G TAGAA | 6008 |
| 5991 | GAGCU UGAUG GCAUGCACUAUGC GCG AGGUUCUACA | 13072 | TGTAGAACCT G AGCTC | 6009 |
| 6006 | UUCUU UGAUG GCAUGCACUAUGC GCG GGUUACUUAG | 13073 | CTAAGTAACC G AAGAA | 6010 |
| 6013 | GCAUA UGAUG GCAUGCACUAUGC GCG AUUCUUCGGU | 13074 | ACCGAAGAAT G TATGC | 6011 |
| 6017 | AGAGG UGAUG GCAUGCACUAUGC GCG AUACAUUCUU | 13075 | AAGAATGTAT G CCTCT | 6012 |
| 6023 | AAGAA UGAUG GCAUGCACUAUGC GCG AGAGGCAUAC | 13076 | GTATGCCTCT G TTCTT | 6013 |
| 6031 | UGGCA UGAUG GCAUGCACUAUGC GCG AUAAGAACAG | 13077 | CTGTTCTTAT G TGCCA | 6014 |
| 6033 | UGUGG UGAUG GCAUGCACUAUGC GCG ACAUAAGAAC | 13078 | GTTCTTATGT G CCACA | 6015 |
| 6044 | UUAAA UGAUG GCAUGCACUAUGC GCG AAGGAUGUGG | 13079 | CCACATCCTT G TTTAA | 6016 |
| 6059 | UCAUA UGAUG GCAUGCACUAUGC GCG AGAGAGCCUU | 13080 | AAGGCTCTCT G TATGA | 6017 |
| 6063 | CUCUU UGAUG GCAUGCACUAUGC GCG AUACAGAGAG | 13081 | CTCTCTGTAT G AAGAG | 6018 |
| 6098 | AGGCU UGAUG GCAUGCACUAUGC GCG ACUAGGGAAU | 13082 | ATTCCCTAGT G AGCCT | 6019 |
| 6127 | UUCCA UGAUG GCAUGCACUAUGC GCG AAAAGCCGCU | 13083 | AGCGGCTTTT G TGGAA | 6020 |
| 6230 | AACAA UGAUG GCAUGCACUAUGC GCG AAAGAUUUGU | 13084 | ACAAATCTTT G TTGTT | 6021 |
| 6233 | AGGAA UGAUG GCAUGCACUAUGC GCG AACAAAGAUU | 13085 | AATCTTTGTT G TTCCT | 6022 |
| 6254 | GUUUG UGAUG GCAUGCACUAUGC GCG GUAUGUGUAA | 13086 | TTACACATAC G CAAAC | 6023 |
| 6265 | UGUCA UGAUG GCAUGCACUAUGC GCG AGGUGGUUUG | 13087 | CAAACCACCT G TGACA | 6024 |
| 6267 | GCUGU UGAUG GCAUGCACUAUGC GCG ACAGGUGGUU | 13088 | AACCACCTGT G ACAGC | 6025 |
| 6391 | GUUAU UGAUG GCAUGCACUAUGC GCG ACUAUUUGCU | 13089 | AGCAAATAGT G ATAAC | 6026 |
| 6413 | AUGAA UGAUG GCAUGCACUAUGC GCG AGCUAAGGUU | 13090 | AACCTTAGCT G TTCAT | 6027 |
| 6419 | CAAGA UGAUG GCAUGCACUAUGC GCG AUGAACAGCU | 13091 | AGCTGTTCAT G TCTTG | 6028 |

| | | | | |
|---|---|---|---|---|
| 6424 | GAAAU UGAUG GCAUGCACUAUGC GCG AAGACAUGAA | 13092 | TTCATGTCTT G ATTTC | 6029 |
| 6504 | AGUAA UGAUG GCAUGCACUAUGC GCG AAUUCUAAUG | 13093 | CATTAGAATT G TTACT | 6030 |
| 6532 | UGCUA UGAUG GCAUGCACUAUGC GCG AAACCUGAGU | 13094 | ACTCAGGTTT G TAGCA | 6031 |
| 6543 | GGACU UGAUG GCAUGCACUAUGC GCG AUGUAUGCUA | 13095 | TAGCATACAT G AGTCC | 6032 |
| 6588 | UUCUA UGAUG GCAUGCACUAUGC GCG AUUAAGACUC | 13096 | GAGTCTTAAT G TAGAA | 6033 |
| 6610 | UAUUA UGAUG GCAUGCACUAUGC GCG AAGUCUCCAU | 13097 | ATGGAGACTT G TAATA | 6034 |
| 6618 | UAGCU UGAUG GCAUGCACUAUGC GCG AUUAUUACAA | 13098 | TTGTAATAAT G AGCTA | 6035 |
| 6634 | ACAAG UGAUG GCAUGCACUAUGC GCG ACUUUGUAAC | 13099 | GTTACAAAGT G CTTGT | 6036 |
| 6638 | AUGAA UGAUG GCAUGCACUAUGC GCG AAGCACUUUG | 13100 | CAAAGTGCTT G TTCAT | 6037 |
| 6656 | AUUUU UGAUG GCAUGCACUAUGC GCG AGUGCUAUUU | 13101 | AAATAGCACT G AAAAT | 6038 |
| 6663 | UGUUU UGAUG GCAUGCACUAUGC GCG AAUUUUCAGU | 13102 | ACTGAAAATT G AAACA | 6039 |
| 6670 | UAAUU UGAUG GCAUGCACUAUGC GCG AUGUUUCAAU | 13103 | ATTGAAACAT G AATTA | 6040 |
| 6679 | AUUAU UGAUG GCAUGCACUAUGC GCG AGUUAAUUCA | 13104 | TGAATTAACT G ATAAT | 6041 |
| 6698 | AAUGG UGAUG GCAUGCACUAUGC GCG AAAUGAUUGG | 13105 | CCAATCATTT G CCATT | 6042 |
| 6707 | UUUGU UGAUG GCAUGCACUAUGC GCG AUAAAUGGCA | 13106 | TGCCATTTAT G ACAAA | 6043 |
| 6736 | GUGCU UGAUG GCAUGCACUAUGC GCG GUUCUUUGUU | 13107 | AACAAAGAAC G AGCAC | 6044 |
| 6759 | UAUCU UGAUG GCAUGCACUAUGC GCG AGAAACUCUG | 13108 | CAGAGTTTCT G AGATA | 6045 |
| 6767 | ACGUA UGAUG GCAUGCACUAUGC GCG AUUAUCUCAG | 13109 | CTGAGATAAT G TACGT | 6046 |
| 6798 | GGUUU UGAUG GCAUGCACUAUGC GCG AGCCCCAUUC | 13110 | GAATGGGGCT G AAACC | 6047 |
| 6806 | UUGCA UGAUG GCAUGCACUAUGC GCG AUGGUUUCAG | 13111 | CTGAAACCAT G TGCAA | 6048 |
| 6808 | ACUUG UGAUG GCAUGCACUAUGC GCG ACAUGGUUUC | 13112 | GAAACCATGT G CAAGT | 6049 |
| 6816 | AGACA UGAUG GCAUGCACUAUGC GCG AGACUUGCAC | 13113 | GTGCAAGTCT G TGTCT | 6050 |
| 6818 | CAAGA UGAUG GCAUGCACUAUGC GCG ACAGACUUGC | 13114 | GCAAGTCTGT G TCTTG | 6051 |
| 6823 | ACUGA UGAUG GCAUGCACUAUGC GCG AAGACACAGA | 13115 | TCTGTGTCTT G TCAGT | 6052 |
| 6838 | GGUGU UGAUG GCAUGCACUAUGC GCG ACUUCUUGGA | 13116 | TCCAAGAAGT G ACACC | 6053 |
| 6844 | CAUCU UGAUG GCAUGCACUAUGC GCG GGUGUCACUU | 13117 | AAGTGACACC G AGATG | 6054 |
| 6849 | AUUAA UGAUG GCAUGCACUAUGC GCG AUCUCGGUGU | 13118 | ACACCGAGAT G TTAAT | 6055 |
| 6868 | CAAGG UGAUG GCAUGCACUAUGC GCG ACGGGUCCCU | 13119 | AGGGACCCGT G CCTTG | 6056 |
| 6873 | GGAAA UGAUG GCAUGCACUAUGC GCG AAGGCACGGG | 13120 | CCCGTGCCTT G TTTCC | 6057 |
| 6893 | GUUUG UGAUG GCAUGCACUAUGC GCG AUUCUUGUGG | 13121 | CCACAAGAAT G CAAAC | 6058 |
| 6914 | GCUAG UGAUG GCAUGCACUAUGC GCG GAGUAUCUGU | 13122 | ACAGATACTC G CTAGC | 6059 |
| 6932 | UUAAU UGAUG GCAUGCACUAUGC GCG AAUUUAAAUG | 13123 | CATTTAAATT G ATTAA | 6060 |
| 6947 | AGAUG UGAUG GCAUGCACUAUGC GCG ACUCCUCCUU | 13124 | AAGGAGGAGT G CATCT | 6061 |

262

| | | | | |
|---|---|---|---|---|
| 6959 | ACUGU UGAUG GCAUGCACUAUGC GCG GGCCAAAGAU | 13125 | ATCTTTGGCC G ACAGT | 6062 |
| 6968 | AGUUA UGAUG GCAUGCACUAUGC GCG ACCACUGUCG | 13126 | CGACAGTGGT G TAACT | 6063 |
| 6974 | ACACA UGAUG GCAUGCACUAUGC GCG AGUUACACCA | 13127 | TGGTGTAACT G TGTGT | 6064 |
| 6976 | ACACA UGAUG GCAUGCACUAUGC GCG ACAGUUACAC | 13128 | GTGTAACTGT G TGTGT | 6065 |
| 6978 | ACACA UGAUG GCAUGCACUAUGC GCG ACACAGUUAC | 13129 | GTAACTGTGT G TGTGT | 6066 |
| 6980 | ACACA UGAUG GCAUGCACUAUGC GCG ACACACAGUU | 13130 | AACTGTGTGT G TGTGT | 6067 |
| 6982 | ACACA UGAUG GCAUGCACUAUGC GCG ACACACACAG | 13131 | CTGTGTGTGT G TGTGT | 6068 |
| 6984 | ACACA UGAUG GCAUGCACUAUGC GCG ACACACACAC | 13132 | GTGTGTGTGT G TGTGT | 6069 |
| 6986 | ACACA UGAUG GCAUGCACUAUGC GCG ACACACACAC | 13132 | GTGTGTGTGT G TGTGT | 6069 |
| 6988 | ACACA UGAUG GCAUGCACUAUGC GCG ACACACACAC | 13132 | GTGTGTGTGT G TGTGT | 6069 |
| 6990 | ACACA UGAUG GCAUGCACUAUGC GCG ACACACACAC | 13132 | GTGTGTGTGT G TGTGT | 6069 |
| 6992 | ACACA UGAUG GCAUGCACUAUGC GCG ACACACACAC | 13132 | GTGTGTGTGT G TGTGT | 6069 |
| 6994 | ACACA UGAUG GCAUGCACUAUGC GCG ACACACACAC | 13132 | GTGTGTGTGT G TGTGT | 6069 |
| 6996 | ACACA UGAUG GCAUGCACUAUGC GCG ACACACACAC | 13132 | GTGTGTGTGT G TGTGT | 6069 |
| 6998 | ACACA UGAUG GCAUGCACUAUGC GCG ACACACACAC | 13132 | GTGTGTGTGT G TGTGT | 6069 |
| 7000 | ACACA UGAUG GCAUGCACUAUGC GCG ACACACACAC | 13132 | GTGTGTGTGT G TGTGT | 6069 |
| 7002 | ACACA UGAUG GCAUGCACUAUGC GCG ACACACACAC | 13132 | GTGTGTGTGT G TGTGT | 6069 |
| 7004 | ACACA UGAUG GCAUGCACUAUGC GCG ACACACACAC | 13132 | GTGTGTGTGT G TGTGT | 6069 |
| 7006 | ACACA UGAUG GCAUGCACUAUGC GCG ACACACACAC | 13132 | GTGTGTGTGT G TGTGT | 6069 |
| 7008 | ACACA UGAUG GCAUGCACUAUGC GCG ACACACACAC | 13132 | GTGTGTGTGT G TGTGT | 6069 |
| 7010 | CCACA UGAUG GCAUGCACUAUGC GCG ACACACACAC | 13133 | GTGTGTGTGT G TGTGG | 6070 |
| 7012 | ACCCA UGAUG GCAUGCACUAUGC GCG ACACACACAC | 13134 | GTGTGTGTGT G TGGGT | 6071 |
| 7018 | ACCCA UGAUG GCAUGCACUAUGC GCG ACCCACACAC | 13135 | GTGTGTGGGT G TGGGT | 6072 |
| 7024 | ACAUA UGAUG GCAUGCACUAUGC GCG ACCCACACCC | 13136 | GGGTGTGGGT G TATGT | 6073 |
| 7028 | ACACA UGAUG GCAUGCACUAUGC GCG AUACACCCAC | 13137 | GTGGGTGTAT G TGTGT | 6074 |
| 7030 | AAACA UGAUG GCAUGCACUAUGC GCG ACAUACACCC | 13138 | GGGTGTATGT G TGTTT | 6075 |
| 7032 | CAAAA UGAUG GCAUGCACUAUGC GCG ACACAUACAC | 13139 | GTGTATGTGT G TTTTG | 6076 |
| 7037 | AUGCA UGAUG GCAUGCACUAUGC GCG AAAACACACA | 13140 | TGTGTGTTTT G TGCAT | 6077 |
| 7039 | UUAUG UGAUG GCAUGCACUAUGC GCG ACAAAACACA | 13141 | TGTGTTTTGT G CATAA | 6078 |
| 7099 | UGUAG UGAUG GCAUGCACUAUGC GCG AUAUAUUCUU | 13142 | AAGAATATAT G CTACA | 6079 |
| 7146 | UUCAU UGAUG GCAUGCACUAUGC GCG AUGACUAGAA | 13143 | TTCTAGTCAT G ATGAA | 6080 |
| 7149 | ACAUU UGAUG GCAUGCACUAUGC GCG AUCAUGACUA | 13144 | TAGTCATGAT G AATGT | 6081 |
| 7153 | AAAUA UGAUG GCAUGCACUAUGC GCG AUUCAUCAUG | 13145 | CATGATGAAT G TATTT | 6082 |

263

| | | | | |
|---|---|---|---|---|
| 7160 | GUAUA UGAUG GCAUGCACUAUGC GCG AAAAUACAUU | 13146 | AATGTATTTT G TATAC | 6083 |
| 7210 | GAUUA UGAUG GCAUGCACUAUGC GCG AAAUCCCAAU | 13147 | ATTGGGATTT G TAATC | 6084 |
| 7230 | UUUAU UGAUG GCAUGCACUAUGC GCG AAUUAAGUUG | 13148 | CAACTTAATT G ATAAA | 6085 |
| 7246 | AAAAG UGAUG GCAUGCACUAUGC GCG AGUUGCCAAG | 13149 | CTTGGCAACT G CTTTT | 6086 |
| 7254 | CAGAA UGAUG GCAUGCACUAUGC GCG AUAAAAGCAG | 13150 | CTGCTTTTAT G TTCTG | 6087 |
| 7259 | GGAGA UGAUG GCAUGCACUAUGC GCG AGAACAUAAA | 13151 | TTTATGTTCT G TCTCC | 6088 |
| 7343 | CUAAA UGAUG GCAUGCACUAUGC GCG AAGGAUAAAU | 13152 | ATTTATCCTT G TTTAG | 6089 |
| 7375 | CAUUU UGAUG GCAUGCACUAUGC GCG AAAGUUUUUC | 13153 | GAAAAACTTT G AAATG | 6090 |
| 7394 | UUUAG UGAUG GCAUGCACUAUGC GCG AAUUUUUUGA | 13154 | TCAAAAAATT G CTAAA | 6091 |
| 7422 | ACUAA UGAUG GCAUGCACUAUGC GCG AUUUAGUUUU | 13155 | AAAACTAAAT G TTAGT | 6092 |
| 7434 | ACAAU UGAUG GCAUGCACUAUGC GCG AGCUAAACUA | 13156 | TAGTTTAGCT G ATTGT | 6093 |
| 7438 | CCAUA UGAUG GCAUGCACUAUGC GCG AAUCAGCUAA | 13157 | TTAGCTGATT G TATGG | 6094 |
| 7451 | AGGUU UGAUG GCAUGCACUAUGC GCG GAAAACCCCA | 13158 | TGGGGTTTTC G AACCT | 6095 |
| 7467 | ACAAA UGAUG GCAUGCACUAUGC GCG AAAAAGUGAA | 13159 | TTCACTTTTT G TTTGT | 6096 |
| 7471 | UAAAA UGAUG GCAUGCACUAUGC GCG AAACAAAAAG | 13160 | CTTTTTGTTT G TTTTA | 6097 |
| 7491 | UUACA UGAUG GCAUGCACUAUGC GCG AGUUGUGAAA | 13161 | TTTCACAACT G TGTAA | 6098 |
| 7493 | AUUUA UGAUG GCAUGCACUAUGC GCG ACAGUUGUGA | 13162 | TCACAACTGT G TAAAT | 6099 |
| 7500 | AUUGG UGAUG GCAUGCACUAUGC GCG AAUUUACACA | 13163 | TGTGTAAATT G CCAAT | 6100 |
| 7513 | AUGGA UGAUG GCAUGCACUAUGC GCG AGGAAUUAUU | 13164 | AATAATTCCT G TCCAT | 6101 |
| 7519 | AUUUU UGAUG GCAUGCACUAUGC GCG AUGGACAGGA | 13165 | TCCTGTCCAT G AAAAT | 6102 |
| 7525 | AUUUG UGAUG GCAUGCACUAUGC GCG AUUUUCAUGG | 13166 | CCATGAAAAT G CAAAT | 6103 |
| 7539 | AUCUA UGAUG GCAUGCACUAUGC GCG ACUGGAUAAU | 13167 | ATTATCCAGT G TAGAT | 6104 |
| 7551 | AUGGU UGAUG GCAUGCACUAUGC GCG AAAUAUAUCU | 13168 | AGATATATTT G ACCAT | 6105 |
| 7582 | AAAGG UGAUG GCAUGCACUAUGC GCG AAAACUAGCC | 13169 | GGCTAGTTTT G CCTTT | 6106 |
| 7611 | ACAUU UGAUG GCAUGCACUAUGC GCG AGGCUGAAAU | 13170 | ATTTCAGCCT G AATGT | 6107 |
| 7615 | GCAGA UGAUG GCAUGCACUAUGC GCG AUUCAGGCUG | 13171 | CAGCCTGAAT G TCTGC | 6108 |
| 7619 | AUAGG UGAUG GCAUGCACUAUGC GCG AGACAUUCAG | 13172 | CTGAATGTCT G CCTAT | 6109 |
| 7634 | AAGAG UGAUG GCAUGCACUAUGC GCG AGAGAAUAUA | 13173 | TATATTCTCT G CTCTT | 6110 |
| 7641 | GAAUA UGAUG GCAUGCACUAUGC GCG AAAGAGCAGA | 13174 | TCTGCTCTTT G TATTC | 6111 |
| 7653 | GGGUU UGAUG GCAUGCACUAUGC GCG AAAGGAGAAU | 13175 | ATTCTCCTTT G AACCC | 6112 |
| 7672 | UGCCA UGAUG GCAUGCACUAUGC GCG AGGAUGUUUU | 13176 | AAAACATCCT G TGGCA | 6113 |

Table XVI: Human KDR NCH Ribozyme and Target Sequences 237.198

Core Sequence = CUGAUGAG GCCGUUAGGC CGAA
Underlined region can be any X sequence or linker, as described herein.

| nt. Position | Ribozyme Sequence | Seq. ID Nos | Target | Seq. ID Nos. |
|---|---|---|---|---|
| 11 | CGGCCAGC CUGAUGAG GCCGUUAGGC CGAA ICACCUUG | 13177 | CAAGGTGC T GCTGGCCG | 6114 |
| 14 | CGACGGCC CUGAUGAG GCCGUUAGGC CGAA ICAGCACC | 13178 | GGTGCTGC T GGCCGTCG | 6115 |
| 18 | AGGGCGAC CUGAUGAG GCCGUUAGGC CGAA ICCAGCAG | 13179 | CTGCTGGC C GTCGCCCT | 6116 |
| 24 | AGCCACAG CUGAUGAG GCCGUUAGGC CGAA ICGACGGC | 13180 | GCCGTCGC C CTGTGGCT | 6117 |
| 25 | GAGCCACA CUGAUGAG GCCGUUAGGC CGAA IGCGACGG | 13181 | CCGTCGCC C TGTGGCTC | 6118 |
| 26 | AGAGCCAC CUGAUGAG GCCGUUAGGC CGAA IGGCGACG | 13182 | CGTCGCCC T GTGGCTCT | 6119 |
| 32 | CCACGCAG CUGAUGAG GCCGUUAGGC CGAA ICCACAGG | 13183 | CCTGTGGC T CTGCGTGG | 6120 |
| 34 | CUCCACGC CUGAUGAG GCCGUUAGGC CGAA IAGCCACA | 13184 | TGTGGCTC T GCGTGGAG | 6121 |
| 45 | GCGGCCCG CUGAUGAG GCCGUUAGGC CGAA IUCUCCAC | 13185 | GTGGAGAC C CGGGCCGC | 6122 |
| 46 | GGCGGCCC CUGAUGAG GCCGUUAGGC CGAA IGUCUCCA | 13186 | TGGAGACC C GGGCCGCC | 6123 |
| 51 | ACAGAGGC CUGAUGAG GCCGUUAGGC CGAA ICCCGGGU | 13187 | ACCCGGGC C GCCTCTGT | 6124 |
| 54 | CCCACAGA CUGAUGAG GCCGUUAGGC CGAA ICGGCCCG | 13188 | CGGGCCGC C TCTGTGGG | 6125 |
| 55 | ACCCACAG CUGAUGAG GCCGUUAGGC CGAA IGCGGCCC | 13189 | GGGCCGCC T CTGTGGGT | 6126 |
| 57 | AAACCCAC CUGAUGAG GCCGUUAGGC CGAA IAGGCGGC | 13190 | GCCGCCTC T GTGGGTTT | 6127 |
| 68 | AAACACUA CUGAUGAG GCCGUUAGGC CGAA ICAAACCC | 13191 | GGGTTTGC C TAGTGTTT | 6128 |
| 69 | GAAACACU CUGAUGAG GCCGUUAGGC CGAA IGCAAACC | 13192 | GGTTTGCC T AGTGTTTC | 6129 |
| 78 | AGAUCAAG CUGAUGAG GCCGUUAGGC CGAA IAAACACU | 13193 | AGTGTTTC T CTTGATCT | 6130 |
| 80 | GCAGAUCA CUGAUGAG GCCGUUAGGC CGAA IAGAAACA | 13194 | TGTTTCTC T TGATCTGC | 6131 |
| 86 | GCCUGGGC CUGAUGAG GCCGUUAGGC CGAA IAUCAAGA | 13195 | TCTTGATC T GCCCAGGC | 6132 |
| 89 | UGAGCCUG CUGAUGAG GCCGUUAGGC CGAA ICAGAUCA | 13196 | TGATCTGC C CAGGCTCA | 6133 |
| 90 | CUGAGCCU CUGAUGAG GCCGUUAGGC CGAA IGCAGAUC | 13197 | GATCTGCC C AGGCTCAG | 6134 |
| 91 | GCUGAGCC CUGAUGAG GCCGUUAGGC CGAA IGGCAGAU | 13198 | ATCTGCCC A GGCTCAGC | 6135 |
| 95 | GUAUGCUG CUGAUGAG GCCGUUAGGC CGAA ICCUGGGC | 13199 | GCCCAGGC T CAGCATAC | 6136 |
| 97 | UUGUAUGC CUGAUGAG GCCGUUAGGC CGAA IAGCCUGG | 13200 | CCAGGCTC A GCATACAA | 6137 |
| 100 | UUUUUGUA CUGAUGAG GCCGUUAGGC CGAA ICUGAGCC | 13201 | GGCTCAGC A TACAAAAA | 6138 |
| 104 | UGUCUUUU CUGAUGAG GCCGUUAGGC CGAA IUAUGCUG | 13202 | CAGCATAC A AAAAGACA | 6139 |
| 112 | UGUAAGUA CUGAUGAG GCCGUUAGGC CGAA IUCUUUUU | 13203 | AAAAAGAC A TACTTACA | 6140 |

265

| | | | | |
|---|---|---|---|---|
| 116 | UAAUUGUA CUGAUGAG GCCGUUAGGC CGAA IUAUGUCU | 13204 | AGACATAC T TACAATTA | 6141 |
| 120 | GCCUUAAU CUGAUGAG GCCGUUAGGC CGAA IUAAGUAU | 13205 | ATACTTAC A ATTAAGGC | 6142 |
| 129 | GUUGUAUU CUGAUGAG GCCGUUAGGC CGAA ICCUUAAU | 13206 | ATTAAGGC T AATACAAC | 6143 |
| 135 | UGAAGAGU CUGAUGAG GCCGUUAGGC CGAA IUAUUAGC | 13207 | GCTAATAC A ACTCTTCA | 6144 |
| 138 | AUUUGAAG CUGAUGAG GCCGUUAGGC CGAA IUUGUAUU | 13208 | AATACAAC T CTTCAAAT | 6145 |
| 140 | UAAUUUGA CUGAUGAG GCCGUUAGGC CGAA IAGUUGUA | 13209 | TACAACTC T TCAAATTA | 6146 |
| 143 | AAGUAAUU CUGAUGAG GCCGUUAGGC CGAA IAAGAGUU | 13210 | AACTCTTC A AATTACTT | 6147 |
| 150 | CCCCUGCA CUGAUGAG GCCGUUAGGC CGAA IUAAUUUG | 13211 | CAAATTAC T TGCAGGGG | 6148 |
| 154 | CUGUCCCC CUGAUGAG GCCGUUAGGC CGAA ICAAGUAA | 13212 | TTACTTGC A GGGGACAG | 6149 |
| 161 | AGUCCCUC CUGAUGAG GCCGUUAGGC CGAA IUCCCCUG | 13213 | CAGGGGAC A GAGGGACT | 6150 |
| 169 | CCAGUCCA CUGAUGAG GCCGUUAGGC CGAA IUCCCUCU | 13214 | AGAGGGAC T TGGACTGG | 6151 |
| 175 | CCAAAGCC CUGAUGAG GCCGUUAGGC CGAA IUCCAAGU | 13215 | ACTTGGAC T GGCTTTGG | 6152 |
| 179 | UGGGCCAA CUGAUGAG GCCGUUAGGC CGAA ICCAGUCC | 13216 | GGACTGGC T TTGGCCCA | 6153 |
| 185 | GAUUAUUG CUGAUGAG GCCGUUAGGC CGAA ICCAAAGC | 13217 | GCTTTGGC C CAATAATC | 6154 |
| 186 | UGAUUAUU CUGAUGAG GCCGUUAGGC CGAA IGCCAAAG | 13218 | CTTTGGCC C AATAATCA | 6155 |
| 187 | CUGAUUAU CUGAUGAG GCCGUUAGGC CGAA IGGCCAAA | 13219 | TTTGGCCC A ATAATCAG | 6156 |
| 194 | UGCCACUC CUGAUGAG GCCGUUAGGC CGAA IAUUAUUG | 13220 | CAATAATC A GAGTGGCA | 6157 |
| 202 | UUGCUCAC CUGAUGAG GCCGUUAGGC CGAA ICCACUCU | 13221 | AGAGTGGC A GTGAGCAA | 6158 |
| 209 | CCACCCUU CUGAUGAG GCCGUUAGGC CGAA ICUCACUG | 13222 | CAGTGAGC A AAGGGTGG | 6159 |
| 225 | CUGCACUC CUGAUGAG GCCGUUAGGC CGAA IUCACCUC | 13223 | GAGGTGAC T GAGTGCAG | 6160 |
| 232 | GCCAUCGC CUGAUGAG GCCGUUAGGC CGAA ICACUCAG | 13224 | CTGAGTGC A GCGATGGC | 6161 |
| 241 | ACAGAAGA CUGAUGAG GCCGUUAGGC CGAA ICCAUCGC | 13225 | GCGATGGC C TCTTCTGT | 6162 |
| 242 | UACAGAAG CUGAUGAG GCCGUUAGGC CGAA IGCCAUCG | 13226 | CGATGGCC T CTTCTGTA | 6163 |
| 244 | CUUACAGA CUGAUGAG GCCGUUAGGC CGAA IAGGCCAU | 13227 | ATGGCCTC T TCTGTAAG | 6164 |
| 247 | UGUCUUAC CUGAUGAG GCCGUUAGGC CGAA IAAGAGGC | 13228 | GCCTCTTC T GTAAGACA | 6165 |
| 255 | AUUGUGAG CUGAUGAG GCCGUUAGGC CGAA IUCUUACA | 13229 | TGTAAGAC A CTCACAAT | 6166 |
| 257 | GAAUUGUG CUGAUGAG GCCGUUAGGC CGAA IUGUCUUA | 13230 | TAAGACAC T CACAATTC | 6167 |
| 259 | UGGAAUUG CUGAUGAG GCCGUUAGGC CGAA IAGUGUCU | 13231 | AGACACTC A CAATTCCA | 6168 |
| 261 | UUUGGAAU CUGAUGAG GCCGUUAGGC CGAA IUGAGUGU | 13232 | ACACTCAC A ATTCCAAA | 6169 |
| 266 | UCACUUUU CUGAUGAG GCCGUUAGGC CGAA IAAUUGUG | 13233 | CACAATTC C AAAAGTGA | 6170 |
| 267 | AUCACUUU CUGAUGAG GCCGUUAGGC CGAA IGAAUUGU | 13234 | ACAATTCC A AAAGTGAT | 6171 |
| 286 | GGCUCCAG CUGAUGAG GCCGUUAGGC CGAA IUCAUUUC | 13235 | GAAATGAC A CTGGAGCC | 6172 |
| 288 | UAGGCUCC CUGAUGAG GCCGUUAGGC CGAA IUGUCAUU | 13236 | AATGACAC T GGAGCCTA | 6173 |

266

| | | | | |
|---|---|---|---|---|
| 294 | CACUUGUA CUGAUGAG GCCGUUAGGC CGAA ICUCCAGU | 13237 | ACTGGAGC C TACAAGTG | 6174 |
| 295 | GCACUUGU CUGAUGAG GCCGUUAGGC CGAA IGCUCCAG | 13238 | CTGGAGCC T ACAAGTGC | 6175 |
| 298 | GAAGCACU CUGAUGAG GCCGUUAGGC CGAA IUAGGCUC | 13239 | GAGCCTAC A AGTGCTTC | 6176 |
| 304 | CCGGUAGA CUGAUGAG GCCGUUAGGC CGAA ICACUUGU | 13240 | ACAAGTGC T TCTACCGG | 6177 |
| 307 | UUCCCGGU CUGAUGAG GCCGUUAGGC CGAA IAAGCACU | 13241 | AGTGCTTC T ACCGGGAA | 6178 |
| 310 | AGUUUCCC CUGAUGAG GCCGUUAGGC CGAA IUAGAAGC | 13242 | GCTTCTAC C GGGAAACT | 6179 |
| 318 | GCCAAGUC CUGAUGAG GCCGUUAGGC CGAA IUUUCCCG | 13243 | CGGGAAAC T GACTTGGC | 6180 |
| 322 | CGAGGCCA CUGAUGAG GCCGUUAGGC CGAA IUCAGUUU | 13244 | AAACTGAC T TGGCCTCG | 6181 |
| 327 | AUGACCGA CUGAUGAG GCCGUUAGGC CGAA ICCAAGUC | 13245 | GACTTGGC C TCGGTCAT | 6182 |
| 328 | AAUGACCG CUGAUGAG GCCGUUAGGC CGAA IGCCAAGU | 13246 | ACTTGGCC T CGGTCATT | 6183 |
| 334 | GACAUAAA CUGAUGAG GCCGUUAGGC CGAA IACCGAGG | 13247 | CCTCGGTC A TTTATGTC | 6184 |
| 343 | UUGAACAU CUGAUGAG GCCGUUAGGC CGAA IACAUAAA | 13248 | TTTATGTC T ATGTTCAA | 6185 |
| 350 | UGUAAUCU CUGAUGAG GCCGUUAGGC CGAA IAACAUAG | 13249 | CTATGTTC A AGATTACA | 6186 |
| 358 | UGGAGAUC CUGAUGAG GCCGUUAGGC CGAA IUAAUCUU | 13250 | AAGATTAC A GATCTCCA | 6187 |
| 363 | AUAAAUGG CUGAUGAG GCCGUUAGGC CGAA IAUCUGUA | 13251 | TACAGATC T CCATTTAT | 6188 |
| 365 | CAAUAAAU CUGAUGAG GCCGUUAGGC CGAA IAGAUCUG | 13252 | CAGATCTC C ATTTATTG | 6189 |
| 366 | GCAAUAAA CUGAUGAG GCCGUUAGGC CGAA IGAGAUCU | 13253 | AGATCTCC A TTTATTGC | 6190 |
| 375 | CUAACAGA CUGAUGAG GCCGUUAGGC CGAA ICAAUAAA | 13254 | TTTATTGC T TCTGTTAG | 6191 |
| 378 | UCACUAAC CUGAUGAG GCCGUUAGGC CGAA IAAGCAAU | 13255 | ATTGCTTC T GTTAGTGA | 6192 |
| 388 | UCCAUGUU CUGAUGAG GCCGUUAGGC CGAA IUCACUAA | 13256 | TTAGTGAC C AACATGGA | 6193 |
| 389 | CUCCAUGU CUGAUGAG GCCGUUAGGC CGAA IGUCACUA | 13257 | TAGTGACC A ACATGGAG | 6194 |
| 392 | CGACUCCA CUGAUGAG GCCGUUAGGC CGAA IUUGGUCA | 13258 | TGACCAAC A TGGAGTCG | 6195 |
| 406 | CUCAGUAA CUGAUGAG GCCGUUAGGC CGAA IUACACGA | 13259 | TCGTGTAC A TTACTGAG | 6196 |
| 411 | UUGUUCUC CUGAUGAG GCCGUUAGGC CGAA IUAAUGUA | 13260 | TACATTAC T GAGAACAA | 6197 |
| 418 | UUUGUUUU CUGAUGAG GCCGUUAGGC CGAA IUUCUCAG | 13261 | CTGAGAAC A AAAACAAA | 6198 |
| 424 | CACAGUUU CUGAUGAG GCCGUUAGGC CGAA IUUUUUGU | 13262 | ACAAAAAC A AAACTGTG | 6199 |
| 429 | AUCACCAC CUGAUGAG GCCGUUAGGC CGAA IUUUUGUU | 13263 | AACAAAAC T GTGGTGAT | 6200 |
| 440 | CGAGACAU CUGAUGAG GCCGUUAGGC CGAA IAAUCACC | 13264 | GGTGATTC C ATGTCTCG | 6201 |
| 441 | CCGAGACA CUGAUGAG GCCGUUAGGC CGAA IGAAUCAC | 13265 | GTGATTCC A TGTCTCGG | 6202 |
| 446 | UGGACCCG CUGAUGAG GCCGUUAGGC CGAA IACAUGGA | 13266 | TCCATGTC T CGGGTCCA | 6203 |
| 453 | UUUGAAAU CUGAUGAG GCCGUUAGGC CGAA IACCCGAG | 13267 | CTCGGGTC C ATTTCAAA | 6204 |
| 454 | AUUUGAAA CUGAUGAG GCCGUUAGGC CGAA IGACCCGA | 13268 | TCGGGTCC A TTTCAAAT | 6205 |
| 459 | UUGAGAUU CUGAUGAG GCCGUUAGGC CGAA IAAAUGGA | 13269 | TCCATTTC A AATCTCAA | 6206 |

| | | | | |
|---|---|---|---|---|
| 464 | ACACGUUG CUGAUGAG GCCGUUAGGC CGAA IAUUUGAA | 13270 | TTCAAATC T CAACGTGT | 6207 |
| 466 | UGACACGU CUGAUGAG GCCGUUAGGC CGAA IAGAUUUG | 13271 | CAAATCTC A ACGTGTCA | 6208 |
| 474 | GCACAAAG CUGAUGAG GCCGUUAGGC CGAA IACACGUU | 13272 | AACGTGTC A CTTTGTGC | 6209 |
| 476 | UUGCACAA CUGAUGAG GCCGUUAGGC CGAA IUGACACG | 13273 | CGTGTCAC T TTGTGCAA | 6210 |
| 483 | GGGUAUCU CUGAUGAG GCCGUUAGGC CGAA ICACAAAG | 13274 | CTTTGTGC A AGATACCC | 6211 |
| 490 | CUUUUCUG CUGAUGAG GCCGUUAGGC CGAA IUAUCUUG | 13275 | CAAGATAC C CAGAAAAG | 6212 |
| 491 | UCUUUUCU CUGAUGAG GCCGUUAGGC CGAA IGUAUCUU | 13276 | AAGATACC C AGAAAAGA | 6213 |
| 492 | CUCUUUUC CUGAUGAG GCCGUUAGGC CGAA IGGUAUCU | 13277 | AGATACCC A GAAAAGAG | 6214 |
| 509 | UACCAUCA CUGAUGAG GCCGUUAGGC CGAA IAACAAAU | 13278 | ATTTGTTC C TGATGGTA | 6215 |
| 510 | UUACCAUC CUGAUGAG GCCGUUAGGC CGAA IGAACAAA | 13279 | TTTGTTCC T GATGGTAA | 6216 |
| 520 | GGAAAUUC CUGAUGAG GCCGUUAGGC CGAA IUUACCAU | 13280 | ATGGTAAC A GAATTTCC | 6217 |
| 528 | CUGUCCCA CUGAUGAG GCCGUUAGGC CGAA IAAAUUCU | 13281 | AGAATTTC C TGGGACAG | 6218 |
| 529 | GCUGUCCC CUGAUGAG GCCGUUAGGC CGAA IGAAAUUC | 13282 | GAATTTCC T GGGACAGC | 6219 |
| 535 | CUUCUUGC CUGAUGAG GCCGUUAGGC CGAA IUCCCAGG | 13283 | CCTGGGAC A GCAAGAAG | 6220 |
| 538 | GCCCUUCU CUGAUGAG GCCGUUAGGC CGAA ICUGUCCC | 13284 | GGGACAGC A AGAAGGGC | 6221 |
| 547 | AAUAGUAA CUGAUGAG GCCGUUAGGC CGAA ICCCUUCU | 13285 | AGAAGGGC T TTACTATT | 6222 |
| 552 | CUGGGAAU CUGAUGAG GCCGUUAGGC CGAA IUAAAGCC | 13286 | GGCTTTAC T ATTCCCAG | 6223 |
| 557 | UGUAGCUG CUGAUGAG GCCGUUAGGC CGAA IAAUAGUA | 13287 | TACTATTC C CAGCTACA | 6224 |
| 558 | AUGUAGCU CUGAUGAG GCCGUUAGGC CGAA IGAAUAGU | 13288 | ACTATTCC C AGCTACAT | 6225 |
| 559 | CAUGUAGC CUGAUGAG GCCGUUAGGC CGAA IGGAAUAG | 13289 | CTATTCCC A GCTACATG | 6226 |
| 562 | GAUCAUGU CUGAUGAG GCCGUUAGGC CGAA ICUGGGAA | 13290 | TTCCCAGC T ACATGATC | 6227 |
| 565 | GCUGAUCA CUGAUGAG GCCGUUAGGC CGAA IUAGCUGG | 13291 | CCAGCTAC A TGATCAGC | 6228 |
| 571 | AGCAUAGC CUGAUGAG GCCGUUAGGC CGAA IAUCAUGU | 13292 | ACATGATC A GCTATGCT | 6229 |
| 574 | GCCAGCAU CUGAUGAG GCCGUUAGGC CGAA ICUGAUCA | 13293 | TGATCAGC T ATGCTGGC | 6230 |
| 579 | ACCAUGCC CUGAUGAG GCCGUUAGGC CGAA ICAUAGCU | 13294 | AGCTATGC T GGCATGGT | 6231 |
| 583 | GAAGACCA CUGAUGAG GCCGUUAGGC CGAA ICCAGCAU | 13295 | ATGCTGGC A TGGTCTTC | 6232 |
| 589 | UUCACAGA CUGAUGAG GCCGUUAGGC CGAA IACCAUGC | 13296 | GCATGGTC T TCTGTGAA | 6233 |
| 592 | UGCUUCAC CUGAUGAG GCCGUUAGGC CGAA IAAGACCA | 13297 | TGGTCTTC T GTGAAGCA | 6234 |
| 600 | UUAAUUUU CUGAUGAG GCCGUUAGGC CGAA ICUUCACA | 13298 | TGTGAAGC A AAAATTAA | 6235 |
| 622 | AAUAGACU CUGAUGAG GCCGUUAGGC CGAA IUAACUUU | 13299 | AAAGTTAC C AGTCTATT | 6236 |
| 623 | UAAUAGAC CUGAUGAG GCCGUUAGGC CGAA IGUAACUU | 13300 | AAGTTACC A GTCTATTA | 6237 |
| 627 | UACAUAAU CUGAUGAG GCCGUUAGGC CGAA IACUGGUA | 13301 | TACCAGTC T ATTATGTA | 6238 |
| 637 | GACAACUA CUGAUGAG GCCGUUAGGC CGAA IUACAUAA | 13302 | TTATGTAC A TAGTTGTC | 6239 |

| | | | | |
|---|---|---|---|---|
| 677 | ACGGACUC CUGAUGAG GCCGUUAGGC CGAA IAACCACA | 13303 | TGTGGTTC T GAGTCCGT | 6240 |
| 683 | CAUGAGAC CUGAUGAG GCCGUUAGGC CGAA IACUCAGA | 13304 | TCTGAGTC C GTCTCATG | 6241 |
| 687 | AUUCCAUG CUGAUGAG GCCGUUAGGC CGAA IACGGACU | 13305 | AGTCCGTC T CATGGAAT | 6242 |
| 689 | CAAUUCCA CUGAUGAG GCCGUUAGGC CGAA IAGACGGA | 13306 | TCCGTCTC A TGGAATTG | 6243 |
| 701 | CAACAGAU CUGAUGAG GCCGUUAGGC CGAA IUUCAAUU | 13307 | AATTGAAC T ATCTGTTG | 6244 |
| 705 | UCUCCAAC CUGAUGAG GCCGUUAGGC CGAA IAUAGUUC | 13308 | GAACTATC T GTTGGAGA | 6245 |
| 719 | UUAAGACA CUGAUGAG GCCGUUAGGC CGAA ICUUUUCU | 13309 | AGAAAAGC T TGTCTTAA | 6246 |
| 724 | ACAAUUUA CUGAUGAG GCCGUUAGGC CGAA IACAAGCU | 13310 | AGCTTGTC T TAAATTGT | 6247 |
| 735 | GUUCUUGC CUGAUGAG GCCGUUAGGC CGAA IUACAAUU | 13311 | AATTGTAC A GCAAGAAC | 6248 |
| 738 | UCAGUUCU CUGAUGAG GCCGUUAGGC CGAA ICUGUACA | 13312 | TGTACAGC A AGAACTGA | 6249 |
| 744 | UUUAGUUC CUGAUGAG GCCGUUAGGC CGAA IUUCUUGC | 13313 | GCAAGAAC T GAACTAAA | 6250 |
| 749 | CCACAUUU CUGAUGAG GCCGUUAGGC CGAA IUUCAGUU | 13314 | AACTGAAC T AAATGTGG | 6251 |
| 766 | CCAGUUGA CUGAUGAG GCCGUUAGGC CGAA IUCAAUCC | 13315 | GGATTGAC T TCAACTGG | 6252 |
| 769 | UUCCCAGU CUGAUGAG GCCGUUAGGC CGAA IAAGUCAA | 13316 | TTGACTTC A ACTGGGAA | 6253 |
| 772 | GUAUUCCC CUGAUGAG GCCGUUAGGC CGAA IUUGAAGU | 13317 | ACTTCAAC T GGGAATAC | 6254 |
| 781 | CGAAGAAG CUGAUGAG GCCGUUAGGC CGAA IUAUUCCC | 13318 | GGGAATAC C CTTCTTCG | 6255 |
| 782 | UCGAAGAA CUGAUGAG GCCGUUAGGC CGAA IGUAUUCC | 13319 | GGAATACC C TTCTTCGA | 6256 |
| 783 | UUCGAAGA CUGAUGAG GCCGUUAGGC CGAA IGGUAUUC | 13320 | GAATACCC T TCTTCGAA | 6257 |
| 786 | UGCUUCGA CUGAUGAG GCCGUUAGGC CGAA IAAGGGUA | 13321 | TACCCTTC T TCGAAGCA | 6258 |
| 794 | UAUGCUGA CUGAUGAG GCCGUUAGGC CGAA ICUUCGAA | 13322 | TTCGAAGC A TCAGCATA | 6259 |
| 797 | UCUUAUGC CUGAUGAG GCCGUUAGGC CGAA IAUGCUUC | 13323 | GAAGCATC A GCATAAGA | 6260 |
| 800 | GUUUCUUA CUGAUGAG GCCGUUAGGC CGAA ICUGAUGC | 13324 | GCATCAGC A TAAGAAAC | 6261 |
| 809 | GGUUUACA CUGAUGAG GCCGUUAGGC CGAA IUUUCUUA | 13325 | TAAGAAAC T TGTAAACC | 6262 |
| 817 | UAGGUCUC CUGAUGAG GCCGUUAGGC CGAA IUUUACAA | 13326 | TTGTAAAC C GAGACCTA | 6263 |
| 823 | GGUUUUUA CUGAUGAG GCCGUUAGGC CGAA IUCUCGGU | 13327 | ACCGAGAC C TAAAAACC | 6264 |
| 824 | GGGUUUUU CUGAUGAG GCCGUUAGGC CGAA IGUCUCGG | 13328 | CCGAGACC T AAAAACCC | 6265 |
| 831 | CCAGACUG CUGAUGAG GCCGUUAGGC CGAA IUUUUUAG | 13329 | CTAAAAAC C CAGTCTGG | 6266 |
| 832 | CCCAGACU CUGAUGAG GCCGUUAGGC CGAA IGUUUUUA | 13330 | TAAAAACC C AGTCTGGG | 6267 |
| 833 | UCCCAGAC CUGAUGAG GCCGUUAGGC CGAA IGGUUUUU | 13331 | AAAAACCC A GTCTGGGA | 6268 |
| 837 | UCACUCCC CUGAUGAG GCCGUUAGGC CGAA IACUGGGU | 13332 | ACCCAGTC T GGGAGTGA | 6269 |
| 865 | AGUUAAGG CUGAUGAG GCCGUUAGGC CGAA ICUCAAAA | 13333 | TTTTGAGC A CCTTAACT | 6270 |
| 867 | AUAGUUAA CUGAUGAG GCCGUUAGGC CGAA IUGCUCAA | 13334 | TTGAGCAC C TTAACTAT | 6271 |
| 868 | UAUAGUUA CUGAUGAG GCCGUUAGGC CGAA IGUGCUCA | 13335 | TGAGCACC T TAACTATA | 6272 |

| | | | | |
|---|---|---|---|---|
| 873 | CCAUCUAU CUGAUGAG GCCGUUAGGC CGAA IUUAAGGU | 13336 | ACCTTAAC T ATAGATGG | 6273 |
| 888 | UCACUCCG CUGAUGAG GCCGUUAGGC CGAA IUUACACC | 13337 | GGTGTAAC C CGGAGTGA | 6274 |
| 889 | GUCACUCC CUGAUGAG GCCGUUAGGC CGAA IGUUACAC | 13338 | GTGTAACC C GGAGTGAC | 6275 |
| 898 | CAAUCCUU CUGAUGAG GCCGUUAGGC CGAA IUCACUCC | 13339 | GGAGTGAC C AAGGATTG | 6276 |
| 899 | ACAAUCCU CUGAUGAG GCCGUUAGGC CGAA IGUCACUC | 13340 | GAGTGACC A AGGATTGT | 6277 |
| 910 | UGCACAGG CUGAUGAG GCCGUUAGGC CGAA IUACAAUC | 13341 | GATTGTAC A CCTGTGCA | 6278 |
| 912 | GCUGCACA CUGAUGAG GCCGUUAGGC CGAA IUGUACAA | 13342 | TTGTACAC C TGTGCAGC | 6279 |
| 913 | UGCUGCAC CUGAUGAG GCCGUUAGGC CGAA IGUGUACA | 13343 | TGTACACC T GTGCAGCA | 6280 |
| 918 | CUGGAUGC CUGAUGAG GCCGUUAGGC CGAA ICACAGGU | 13344 | ACCTGTGC A GCATCCAG | 6281 |
| 921 | CCACUGGA CUGAUGAG GCCGUUAGGC CGAA ICUGCACA | 13345 | TGTGCAGC A TCCAGTGG | 6282 |
| 924 | AGCCCACU CUGAUGAG GCCGUUAGGC CGAA IAUGCUGC | 13346 | GCAGCATC C AGTGGGCT | 6283 |
| 925 | CAGCCCAC CUGAUGAG GCCGUUAGGC CGAA IGAUGCUG | 13347 | CAGCATCC A GTGGGCTG | 6284 |
| 932 | UGGUCAUC CUGAUGAG GCCGUUAGGC CGAA ICCCACUG | 13348 | CAGTGGGC T GATGACCA | 6285 |
| 939 | UUCUUCUU CUGAUGAG GCCGUUAGGC CGAA IUCAUCAG | 13349 | CTGATGAC C AAGAAGAA | 6286 |
| 940 | GUUCUUCU CUGAUGAG GCCGUUAGGC CGAA IGUCAUCA | 13350 | TGATGACC A AGAAGAAC | 6287 |
| 949 | AAAUGUGC CUGAUGAG GCCGUUAGGC CGAA IUUCUUCU | 13351 | AGAAGAAC A GCACATTT | 6288 |
| 952 | GACAAAUG CUGAUGAG GCCGUUAGGC CGAA ICUGUUCU | 13352 | AGAACAGC A CATTTGTC | 6289 |
| 954 | CUGACAAA CUGAUGAG GCCGUUAGGC CGAA IUGCUGUU | 13353 | AACAGCAC A TTTGTCAG | 6290 |
| 961 | AUGGACCC CUGAUGAG GCCGUUAGGC CGAA IACAAAUG | 13354 | CATTTGTC A GGGTCCAT | 6291 |
| 967 | UUUUUCAU CUGAUGAG GCCGUUAGGC CGAA IACCCUGA | 13355 | TCAGGGTC C ATGAAAAA | 6292 |
| 968 | GUUUUUCA CUGAUGAG GCCGUUAGGC CGAA IGACCCUG | 13356 | CAGGGTCC A TGAAAAAC | 6293 |
| 977 | CAACAAAA CUGAUGAG GCCGUUAGGC CGAA IUUUUUCA | 13357 | TGAAAAAC C TTTTGTTG | 6294 |
| 978 | GCAACAAA CUGAUGAG GCCGUUAGGC CGAA IGUUUUUC | 13358 | GAAAAACC T TTTGTTGC | 6295 |
| 987 | CUUCCAAA CUGAUGAG GCCGUUAGGC CGAA ICAACAAA | 13359 | TTTGTTGC T TTTGGAAG | 6296 |
| 1000 | AGAUUCCA CUGAUGAG GCCGUUAGGC CGAA ICCACUUC | 13360 | GAAGTGGC A TGGAATCT | 6297 |
| 1008 | UCCACCAG CUGAUGAG GCCGUUAGGC CGAA IAUUCCAU | 13361 | ATGGAATC T CTGGTGGA | 6298 |
| 1010 | CUUCCACC CUGAUGAG GCCGUUAGGC CGAA IAGAUUCC | 13362 | GGAATCTC T GGTGGAAG | 6299 |
| 1020 | CCCACCGU CUGAUGAG GCCGUUAGGC CGAA ICUUCCAC | 13363 | GTGGAAGC C ACGGTGGG | 6300 |
| 1021 | CCCCACCG CUGAUGAG GCCGUUAGGC CGAA IGCUUCCA | 13364 | TGGAAGCC A CGGTGGGG | 6301 |
| 1039 | AGGGAUUC CUGAUGAG GCCGUUAGGC CGAA IACACGCU | 13365 | AGCGTGTC A GAATCCCT | 6302 |
| 1045 | CUUCGCAG CUGAUGAG GCCGUUAGGC CGAA IAUUCUGA | 13366 | TCAGAATC C CTGCGAAG | 6303 |
| 1046 | ACUUCGCA CUGAUGAG GCCGUUAGGC CGAA IGAUUCUG | 13367 | CAGAATCC C TGCGAAGT | 6304 |
| 1047 | UACUUCGC CUGAUGAG GCCGUUAGGC CGAA IGGAUUCU | 13368 | AGAATCCC T GCGAAGTA | 6305 |

270

| | | | | |
|---|---|---|---|---|
| 1057 | GUAACCAA CUGAUGAG GCCGUUAGGC CGAA IUACUUCG | 13369 | CGAAGTAC C TTGGTTAC | 6306 |
| 1058 | GGUAACCA CUGAUGAG GCCGUUAGGC CGAA IGUACUUC | 13370 | GAAGTACC T TGGTTACC | 6307 |
| 1066 | UGGGGGUG CUGAUGAG GCCGUUAGGC CGAA IUAACCAA | 13371 | TTGGTTAC C CACCCCCA | 6308 |
| 1067 | CUGGGGGU CUGAUGAG GCCGUUAGGC CGAA IGUAACCA | 13372 | TGGTTACC C ACCCCCAG | 6309 |
| 1068 | UCUGGGGG CUGAUGAG GCCGUUAGGC CGAA IGGUAACC | 13373 | GGTTACCC A CCCCCAGA | 6310 |
| 1070 | UUUCUGGG CUGAUGAG GCCGUUAGGC CGAA IUGGGUAA | 13374 | TTACCCAC C CCCAGAAA | 6311 |
| 1071 | AUUUCUGG CUGAUGAG GCCGUUAGGC CGAA IGUGGGUA | 13375 | TACCCACC C CCAGAAAT | 6312 |
| 1072 | UAUUUCUG CUGAUGAG GCCGUUAGGC CGAA IGGUGGGU | 13376 | ACCCACCC C CAGAAATA | 6313 |
| 1073 | UUAUUUCU CUGAUGAG GCCGUUAGGC CGAA IGGGUGGG | 13377 | CCCACCCC C AGAAATAA | 6314 |
| 1074 | UUUAUUUC CUGAUGAG GCCGUUAGGC CGAA IGGGGUGG | 13378 | CCACCCCC A GAAATAAA | 6315 |
| 1103 | ACUCAAGG CUGAUGAG GCCGUUAGGC CGAA IUAUUCCA | 13379 | TGGAATAC C CCTTGAGT | 6316 |
| 1104 | GACUCAAG CUGAUGAG GCCGUUAGGC CGAA IGUAUUCC | 13380 | GGAATACC C CTTGAGTC | 6317 |
| 1105 | GGACUCAA CUGAUGAG GCCGUUAGGC CGAA IGGUAUUC | 13381 | GAATACCC C TTGAGTCC | 6318 |
| 1106 | UGGACUCA CUGAUGAG GCCGUUAGGC CGAA IGGGUAUU | 13382 | AATACCCC T TGAGTCCA | 6319 |
| 1113 | GUGUGAUU CUGAUGAG GCCGUUAGGC CGAA IACUCAAG | 13383 | CTTGAGTC C AATCACAC | 6320 |
| 1114 | UGUGUGAU CUGAUGAG GCCGUUAGGC CGAA IGACUCAA | 13384 | TTGAGTCC A ATCACACA | 6321 |
| 1118 | UAAUUGUG CUGAUGAG GCCGUUAGGC CGAA IAUUGGAC | 13385 | GTCCAATC A CACAATTA | 6322 |
| 1120 | UUUAAUUG CUGAUGAG GCCGUUAGGC CGAA IUGAUUGG | 13386 | CCAATCAC A CAATTAAA | 6323 |
| 1122 | GCUUUAAU CUGAUGAG GCCGUUAGGC CGAA IUGUGAUU | 13387 | AATCACAC A ATTAAAGC | 6324 |
| 1136 | UCAGUACA CUGAUGAG GCCGUUAGGC CGAA ICCCCGCU | 13388 | AGCGGGGC A TGTACTGA | 6325 |
| 1142 | UAAUCGUC CUGAUGAG GCCGUUAGGC CGAA IUACAUGC | 13389 | GCATGTAC T GACGATTA | 6326 |
| 1171 | AUUUCCUG CUGAUGAG GCCGUUAGGC CGAA IUCUCUUU | 13390 | AAAGAGAC A CAGGAAAT | 6327 |
| 1173 | UAAUUUCC CUGAUGAG GCCGUUAGGC CGAA IUGUCUCU | 13391 | AGAGACAC A GGAAATTA | 6328 |
| 1183 | GAUGACAG CUGAUGAG GCCGUUAGGC CGAA IUAAUUUC | 13392 | GAAATTAC A CTGTCATC | 6329 |
| 1185 | AGGAUGAC CUGAUGAG GCCGUUAGGC CGAA IUGUAAUU | 13393 | AATTACAC T GTCATCCT | 6330 |
| 1189 | GGUAAGGA CUGAUGAG GCCGUUAGGC CGAA IACAGUGU | 13394 | ACACTGTC A TCCTTACC | 6331 |
| 1192 | AUUGGUAA CUGAUGAG GCCGUUAGGC CGAA IAUGACAG | 13395 | CTGTCATC C TTACCAAT | 6332 |
| 1193 | GAUUGGUA CUGAUGAG GCCGUUAGGC CGAA IGAUGACA | 13396 | TGTCATCC T TACCAATC | 6333 |
| 1197 | AUGGGAUU CUGAUGAG GCCGUUAGGC CGAA IUAAGGAU | 13397 | ATCCTTAC C AATCCCAT | 6334 |
| 1198 | AAUGGGAU CUGAUGAG GCCGUUAGGC CGAA IGUAAGGA | 13398 | TCCTTACC A ATCCCATT | 6335 |
| 1202 | UUGAAAUG CUGAUGAG GCCGUUAGGC CGAA IAUUGGUA | 13399 | TACCAATC C CATTTCAA | 6336 |
| 1203 | UUUGAAAU CUGAUGAG GCCGUUAGGC CGAA IGAUUGGU | 13400 | ACCAATCC C ATTTCAAA | 6337 |
| 1204 | CUUUGAAA CUGAUGAG GCCGUUAGGC CGAA IGGAUUGG | 13401 | CCAATCCC A TTTCAAAG | 6338 |

| | | | | |
|---|---|---|---|---|
| 1209 | UUCUCCUU CUGAUGAG GCCGUUAGGC CGAA IAAAUGGG | 13402 | CCCATTTC A AAGGAGAA | 6339 |
| 1220 | CAUGGCUC CUGAUGAG GCCGUUAGGC CGAA ICUUCUCC | 13403 | GGAGAAGC A GAGCCATG | 6340 |
| 1225 | GACCACAU CUGAUGAG GCCGUUAGGC CGAA ICUCUGCU | 13404 | AGCAGAGC C ATGTGGTC | 6341 |
| 1226 | AGACCACA CUGAUGAG GCCGUUAGGC CGAA IGCUCUGC | 13405 | GCAGAGCC A TGTGGTCT | 6342 |
| 1234 | AACCAGAG CUGAUGAG GCCGUUAGGC CGAA IACCACAU | 13406 | ATGTGGTC T CTCTGGTT | 6343 |
| 1236 | ACAACCAG CUGAUGAG GCCGUUAGGC CGAA IAGACCAC | 13407 | GTGGTCTC T CTGGTTGT | 6344 |
| 1238 | ACACAACC CUGAUGAG GCCGUUAGGC CGAA IAGAGACC | 13408 | GGTCTCTC T GGTTGTGT | 6345 |
| 1252 | CUGGGGUG CUGAUGAG GCCGUUAGGC CGAA IACAUACA | 13409 | TGTATGTC C CACCCCAG | 6346 |
| 1253 | UCUGGGGU CUGAUGAG GCCGUUAGGC CGAA IGACAUAC | 13410 | GTATGTCC C ACCCCAGA | 6347 |
| 1254 | AUCUGGGG CUGAUGAG GCCGUUAGGC CGAA IGGACAUA | 13411 | TATGTCCC A CCCCAGAT | 6348 |
| 1256 | CAAUCUGG CUGAUGAG GCCGUUAGGC CGAA IUGGGACA | 13412 | TGTCCCAC C CCAGATTG | 6349 |
| 1257 | CCAAUCUG CUGAUGAG GCCGUUAGGC CGAA IGUGGGAC | 13413 | GTCCCACC C CAGATTGG | 6350 |
| 1258 | ACCAAUCU CUGAUGAG GCCGUUAGGC CGAA IGGUGGGA | 13414 | TCCCACCC C AGATTGGT | 6351 |
| 1259 | CACCAAUC CUGAUGAG GCCGUUAGGC CGAA IGGGUGGG | 13415 | CCCACCCC A GATTGGTG | 6352 |
| 1275 | GAGAUUAG CUGAUGAG GCCGUUAGGC CGAA IAUUUCUC | 13416 | GAGAAATC T CTAATCTC | 6353 |
| 1277 | GAGAGAUU CUGAUGAG GCCGUUAGGC CGAA IAGAUUUC | 13417 | GAAATCTC T AATCTCTC | 6354 |
| 1282 | CACAGGAG CUGAUGAG GCCGUUAGGC CGAA IAUUAGAG | 13418 | CTCTAATC T CTCCTGTG | 6355 |
| 1284 | UCCACAGG CUGAUGAG GCCGUUAGGC CGAA IAGAUUAG | 13419 | CTAATCTC T CCTGTGGA | 6356 |
| 1286 | AAUCCACA CUGAUGAG GCCGUUAGGC CGAA IAGAGAUU | 13420 | AATCTCTC C TGTGGATT | 6357 |
| 1287 | GAAUCCAC CUGAUGAG GCCGUUAGGC CGAA IGAGAGAU | 13421 | ATCTCTCC T GTGGATTC | 6358 |
| 1296 | UACUGGUA CUGAUGAG GCCGUUAGGC CGAA IAAUCCAC | 13422 | GTGGATTC C TACCAGTA | 6359 |
| 1297 | GUACUGGU CUGAUGAG GCCGUUAGGC CGAA IGAAUCCA | 13423 | TGGATTCC T ACCAGTAC | 6360 |
| 1300 | GCCGUACU CUGAUGAG GCCGUUAGGC CGAA IUAGGAAU | 13424 | ATTCCTAC C AGTACGGC | 6361 |
| 1301 | UGCCGUAC CUGAUGAG GCCGUUAGGC CGAA IGUAGGAA | 13425 | TTCCTACC A GTACGGCA | 6362 |
| 1309 | UUGAGUGG CUGAUGAG GCCGUUAGGC CGAA ICCGUACU | 13426 | AGTACGGC A CCACTCAA | 6363 |
| 1311 | GUUUGAGU CUGAUGAG GCCGUUAGGC CGAA IUGCCGUA | 13427 | TACGGCAC C ACTCAAAC | 6364 |
| 1312 | CGUUUGAG CUGAUGAG GCCGUUAGGC CGAA IGUGCCGU | 13428 | ACGGCACC A CTCAAACG | 6365 |
| 1314 | AGCGUUUG CUGAUGAG GCCGUUAGGC CGAA IUGGUGCC | 13429 | GGCACCAC T CAAACGCT | 6366 |
| 1316 | UCAGCGUU CUGAUGAG GCCGUUAGGC CGAA IAGUGGUG | 13430 | CACCACTC A AACGCTGA | 6367 |
| 1322 | UACAUGUC CUGAUGAG GCCGUUAGGC CGAA ICGUUUGA | 13431 | TCAAACGC T GACATGTA | 6368 |
| 1326 | ACCGUACA CUGAUGAG GCCGUUAGGC CGAA IUCAGCGU | 13432 | ACGCTGAC A TGTACGGT | 6369 |
| 1336 | AAUGGCAU CUGAUGAG GCCGUUAGGC CGAA IACCGUAC | 13433 | GTACGGTC T ATGCCATT | 6370 |
| 1341 | GGAGGAAU CUGAUGAG GCCGUUAGGC CGAA ICAUAGAC | 13434 | GTCTATGC C ATTCCTCC | 6371 |

| | | | | |
|---|---|---|---|---|
| 1342 | GGGAGGAA CUGAUGAG GCCGUUAGGC CGAA IGCAUAGA | 13435 | TCTATGCC A TTCCTCCC | 6372 |
| 1346 | GCGGGGGA CUGAUGAG GCCGUUAGGC CGAA IAAUGGCA | 13436 | TGCCATTC C TCCCCCGC | 6373 |
| 1347 | UGCGGGGG CUGAUGAG GCCGUUAGGC CGAA IGAAUGGC | 13437 | GCCATTCC T CCCCCGCA | 6374 |
| 1349 | GAUGCGGG CUGAUGAG GCCGUUAGGC CGAA IAGGAAUG | 13438 | CATTCCTC C CCCGCATC | 6375 |
| 1350 | UGAUGCGG CUGAUGAG GCCGUUAGGC CGAA IGAGGAAU | 13439 | ATTCCTCC C CCGCATCA | 6376 |
| 1351 | GUGAUGCG CUGAUGAG GCCGUUAGGC CGAA IGGAGGAA | 13440 | TTCCTCCC C CGCATCAC | 6377 |
| 1352 | UGUGAUGC CUGAUGAG GCCGUUAGGC CGAA IGGGAGGA | 13441 | TCCTCCCC C GCATCACA | 6378 |
| 1355 | GGAUGUGA CUGAUGAG GCCGUUAGGC CGAA ICGGGGGA | 13442 | TCCCCCGC A TCACATCC | 6379 |
| 1358 | AGUGGAUG CUGAUGAG GCCGUUAGGC CGAA IAUGCGGG | 13443 | CCCGCATC A CATCCACT | 6380 |
| 1360 | CCAGUGGA CUGAUGAG GCCGUUAGGC CGAA IUGAUGCG | 13444 | CGCATCAC A TCCACTGG | 6381 |
| 1363 | AUACCAGU CUGAUGAG GCCGUUAGGC CGAA IAUGUGAU | 13445 | ATCACATC C ACTGGTAT | 6382 |
| 1364 | AAUACCAG CUGAUGAG GCCGUUAGGC CGAA IGAUGUGA | 13446 | TCACATCC A CTGGTATT | 6383 |
| 1366 | CCAAUACC CUGAUGAG GCCGUUAGGC CGAA IUGGAUGU | 13447 | ACATCCAC T GGTATTGG | 6384 |
| 1376 | CCUCCAAC CUGAUGAG GCCGUUAGGC CGAA ICCAAUAC | 13448 | GTATTGGC A GTTGGAGG | 6385 |
| 1395 | GGCUCGUU CUGAUGAG GCCGUUAGGC CGAA ICGCACUC | 13449 | GAGTGCGC C AACGAGCC | 6386 |
| 1396 | GGGCUCGU CUGAUGAG GCCGUUAGGC CGAA IGCGCACU | 13450 | AGTGCGCC A ACGAGCCC | 6387 |
| 1403 | CUUGGCUG CUGAUGAG GCCGUUAGGC CGAA ICUCGUUG | 13451 | CAACGAGC C CAGCCAAG | 6388 |
| 1404 | GCUUGGCU CUGAUGAG GCCGUUAGGC CGAA IGCUCGUU | 13452 | AACGAGCC C AGCCAAGC | 6389 |
| 1405 | AGCUUGGC CUGAUGAG GCCGUUAGGC CGAA IGGCUCGU | 13453 | ACGAGCCC A GCCAAGCT | 6390 |
| 1408 | GACAGCUU CUGAUGAG GCCGUUAGGC CGAA ICUGGGCU | 13454 | AGCCCAGC C AAGCTGTC | 6391 |
| 1409 | AGACAGCU CUGAUGAG GCCGUUAGGC CGAA IGCUGGGC | 13455 | GCCCAGCC A AGCTGTCT | 6392 |
| 1413 | ACUGAGAC CUGAUGAG GCCGUUAGGC CGAA ICUUGGCU | 13456 | AGCCAAGC T GTCTCAGT | 6393 |
| 1417 | UGUCACUG CUGAUGAG GCCGUUAGGC CGAA IACAGCUU | 13457 | AAGCTGTC T CAGTGACA | 6394 |
| 1419 | UUUGUCAC CUGAUGAG GCCGUUAGGC CGAA IAGACAGC | 13458 | GCTGTCTC A GTGACAAA | 6395 |
| 1425 | UAUGGGUU CUGAUGAG GCCGUUAGGC CGAA IUCACUGA | 13459 | TCAGTGAC A AACCCATA | 6396 |
| 1429 | AGGGUAUG CUGAUGAG GCCGUUAGGC CGAA IUUUGUCA | 13460 | TGACAAAC C CATACCCT | 6397 |
| 1430 | AAGGGUAU CUGAUGAG GCCGUUAGGC CGAA IGUUUGUC | 13461 | GACAAACC C ATACCCTT | 6398 |
| 1431 | CAAGGGUA CUGAUGAG GCCGUUAGGC CGAA IGGUUUGU | 13462 | ACAAACCC A TACCCTTG | 6399 |
| 1435 | UUCACAAG CUGAUGAG GCCGUUAGGC CGAA IUAUGGGU | 13463 | ACCCATAC C CTTGTGAA | 6400 |
| 1436 | CUUCACAA CUGAUGAG GCCGUUAGGC CGAA IGUAUGGG | 13464 | CCCATACC C TTGTGAAG | 6401 |
| 1437 | UCUUCACA CUGAUGAG GCCGUUAGGC CGAA IGGUAUGG | 13465 | CCATACCC T TGTGAAGA | 6402 |
| 1465 | UCCCUGGA CUGAUGAG GCCGUUAGGC CGAA IUCCUCCA | 13466 | TGGAGGAC T TCCAGGGA | 6403 |
| 1468 | UCCUCCCU CUGAUGAG GCCGUUAGGC CGAA IAAGUCCU | 13467 | AGGACTTC C AGGGAGGA | 6404 |

| | | | | |
|---|---|---|---|---|
| 1469 | UUCCUCCC CUGAUGAG GCCGUUAGGC CGAA IGAAGUCC | 13468 | GGACTTCC A GGGAGGAA | 6405 |
| 1502 | GAGCAAAU CUGAUGAG GCCGUUAGGC CGAA IAUUUUUA | 13469 | TAAAAATC A ATTTGCTC | 6406 |
| 1509 | UCAAUUAG CUGAUGAG GCCGUUAGGC CGAA ICAAAUUG | 13470 | CAATTTGC T CTAATTGA | 6407 |
| 1511 | CUUCAAUU CUGAUGAG GCCGUUAGGC CGAA IAGCAAAU | 13471 | ATTTGCTC T AATTGAAG | 6408 |
| 1528 | UACAGUUU CUGAUGAG GCCGUUAGGC CGAA IUUUUUUC | 13472 | GAAAAAAC A AAACTGTA | 6409 |
| 1533 | GUACUUAC CUGAUGAG GCCGUUAGGC CGAA IUUUUGUU | 13473 | AACAAAAC T GTAAGTAC | 6410 |
| 1542 | AUAACAAG CUGAUGAG GCCGUUAGGC CGAA IUACUUAC | 13474 | GTAAGTAC C CTTGTTAT | 6411 |
| 1543 | GAUAACAA CUGAUGAG GCCGUUAGGC CGAA IGUACUUA | 13475 | TAAGTACC C TTGTTATC | 6412 |
| 1544 | GGAUAACA CUGAUGAG GCCGUUAGGC CGAA IGGUACUU | 13476 | AAGTACCC T TGTTATCC | 6413 |
| 1552 | UGCCGCUU CUGAUGAG GCCGUUAGGC CGAA IAUAACAA | 13477 | TTGTTATC C AAGCGGCA | 6414 |
| 1553 | UUGCCGCU CUGAUGAG GCCGUUAGGC CGAA IGAUAACA | 13478 | TGTTATCC A AGCGGCAA | 6415 |
| 1560 | GACACAUU CUGAUGAG GCCGUUAGGC CGAA ICCGCUUG | 13479 | CAAGCGGC A AATGTGTC | 6416 |
| 1569 | UACAAAGC CUGAUGAG GCCGUUAGGC CGAA IACACAUU | 13480 | AATGTGTC A GCTTTGTA | 6417 |
| 1572 | UUGUACAA CUGAUGAG GCCGUUAGGC CGAA ICUGACAC | 13481 | GTGTCAGC T TTGTACAA | 6418 |
| 1579 | UUCACAUU CUGAUGAG GCCGUUAGGC CGAA IUACAAAG | 13482 | CTTTGTAC A AATGTGAA | 6419 |
| 1594 | GACUUUGU CUGAUGAG GCCGUUAGGC CGAA IACCGCUU | 13483 | AAGCGGTC A ACAAAGTC | 6420 |
| 1597 | CCCGACUU CUGAUGAG GCCGUUAGGC CGAA IUUGACCG | 13484 | CGGTCAAC A AAGTCGGG | 6421 |
| 1624 | GUGGAAGG CUGAUGAG GCCGUUAGGC CGAA IAUCACCC | 13485 | GGGTGATC T CCTTCCAC | 6422 |
| 1626 | ACGUGGAA CUGAUGAG GCCGUUAGGC CGAA IAGAUCAC | 13486 | GTGATCTC C TTCCACGT | 6423 |
| 1627 | CACGUGGA CUGAUGAG GCCGUUAGGC CGAA IGAGAUCA | 13487 | TGATCTCC T TCCACGTG | 6424 |
| 1630 | GGUCACGU CUGAUGAG GCCGUUAGGC CGAA IAAGGAGA | 13488 | TCTCCTTC C ACGTGACC | 6425 |
| 1631 | UGGUCACG CUGAUGAG GCCGUUAGGC CGAA IGAAGGAG | 13489 | CTCCTTCC A CGTGACCA | 6426 |
| 1638 | GGACCCCU CUGAUGAG GCCGUUAGGC CGAA IUCACGUG | 13490 | CACGTGAC C AGGGGTCC | 6427 |
| 1639 | AGGACCCC CUGAUGAG GCCGUUAGGC CGAA IGUCACGU | 13491 | ACGTGACC A GGGGTCCT | 6428 |
| 1646 | UAAUUUCA CUGAUGAG GCCGUUAGGC CGAA IACCCCUG | 13492 | CAGGGGTC C TGAAATTA | 6429 |
| 1647 | GUAAUUUC CUGAUGAG GCCGUUAGGC CGAA IGACCCCU | 13493 | AGGGGTCC T GAAATTAC | 6430 |
| 1656 | GGUUGCAA CUGAUGAG GCCGUUAGGC CGAA IUAAUUUC | 13494 | GAAATTAC T TTGCAACC | 6431 |
| 1661 | UGUCAGGU CUGAUGAG GCCGUUAGGC CGAA ICAAAGUA | 13495 | TACTTTGC A ACCTGACA | 6432 |
| 1664 | GCAUGUCA CUGAUGAG GCCGUUAGGC CGAA IUUGCAAA | 13496 | TTTGCAAC C TGACATGC | 6433 |
| 1665 | UGCAUGUC CUGAUGAG GCCGUUAGGC CGAA IGUUGCAA | 13497 | TTGCAACC T GACATGCA | 6434 |
| 1669 | GGGCUGCA CUGAUGAG GCCGUUAGGC CGAA IUCAGGUU | 13498 | AACCTGAC A TGCAGCCC | 6435 |
| 1673 | CAGUGGGC CUGAUGAG GCCGUUAGGC CGAA ICAUGUCA | 13499 | TGACATGC A GCCCACTG | 6436 |
| 1676 | GCUCAGUG CUGAUGAG GCCGUUAGGC CGAA ICUGCAUG | 13500 | CATGCAGC C CACTGAGC | 6437 |

| | | | | |
|---|---|---|---|---|
| 1677 | UGCUCAGU CUGAUGAG GCCGUUAGGC CGAA IGCUGCAU | 13501 | ATGCAGCC C ACTGAGCA | 6438 |
| 1678 | CUGCUCAG CUGAUGAG GCCGUUAGGC CGAA IGGCUGCA | 13502 | TGCAGCCC A CTGAGCAG | 6439 |
| 1680 | UCCUGCUC CUGAUGAG GCCGUUAGGC CGAA IUGGGCUG | 13503 | CAGCCCAC T GAGCAGGA | 6440 |
| 1685 | CGCUCUCC CUGAUGAG GCCGUUAGGC CGAA ICUCAGUG | 13504 | CACTGAGC A GGAGAGCG | 6441 |
| 1698 | CACCACAA CUGAUGAG GCCGUUAGGC CGAA IACACGCU | 13505 | AGCGTGTC T TTGTGGTG | 6442 |
| 1708 | GUCUGCAG CUGAUGAG GCCGUUAGGC CGAA ICACCACA | 13506 | TGTGGTGC A CTGCAGAC | 6443 |
| 1710 | CUGUCUGC CUGAUGAG GCCGUUAGGC CGAA IUGCACCA | 13507 | TGGTGCAC T GCAGACAG | 6444 |
| 1713 | GAUCUGUC CUGAUGAG GCCGUUAGGC CGAA ICAGUGCA | 13508 | TGCACTGC A GACAGATC | 6445 |
| 1717 | CGUAGAUC CUGAUGAG GCCGUUAGGC CGAA IUCUGCAG | 13509 | CTGCAGAC A GATCTACG | 6446 |
| 1722 | UCAAACGU CUGAUGAG GCCGUUAGGC CGAA IAUCUGUC | 13510 | GACAGATC T ACGTTTGA | 6447 |
| 1735 | CCAUGUGA CUGAUGAG GCCGUUAGGC CGAA IUUCUCAA | 13511 | TTGAGAAC C TCACATGG | 6448 |
| 1736 | ACCAUGUG CUGAUGAG GCCGUUAGGC CGAA IGUUCUCA | 13512 | TGAGAACC T CACATGGT | 6449 |
| 1738 | GUACCAUG CUGAUGAG GCCGUUAGGC CGAA IAGGUUCU | 13513 | AGAACCTC A CATGGTAC | 6450 |
| 1740 | UUGUACCA CUGAUGAG GCCGUUAGGC CGAA IUGAGGUU | 13514 | AACCTCAC A TGGTACAA | 6451 |
| 1747 | GCCAAGCU CUGAUGAG GCCGUUAGGC CGAA IUACCAUG | 13515 | CATGGTAC A AGCTTGGC | 6452 |
| 1751 | GUGGGCCA CUGAUGAG GCCGUUAGGC CGAA ICUUGUAC | 13516 | GTACAAGC T TGGCCCAC | 6453 |
| 1756 | AGGCUGUG CUGAUGAG GCCGUUAGGC CGAA ICCAAGCU | 13517 | AGCTTGGC C CACAGCCT | 6454 |
| 1757 | GAGGCUGU CUGAUGAG GCCGUUAGGC CGAA IGCCAAGC | 13518 | GCTTGGCC C ACAGCCTC | 6455 |
| 1758 | AGAGGCUG CUGAUGAG GCCGUUAGGC CGAA IGGCCAAG | 13519 | CTTGGCCC A CAGCCTCT | 6456 |
| 1760 | GCAGAGGC CUGAUGAG GCCGUUAGGC CGAA IUGGGCCA | 13520 | TGGCCCAC A GCCTCTGC | 6457 |
| 1763 | UUGGCAGA CUGAUGAG GCCGUUAGGC CGAA ICUGUGGG | 13521 | CCCACAGC C TCTGCCAA | 6458 |
| 1764 | AUUGGCAG CUGAUGAG GCCGUUAGGC CGAA IGCUGUGG | 13522 | CCACAGCC T CTGCCAAT | 6459 |
| 1766 | GGAUUGGC CUGAUGAG GCCGUUAGGC CGAA IAGGCUGU | 13523 | ACAGCCTC T GCCAATCC | 6460 |
| 1769 | CAUGGAUU CUGAUGAG GCCGUUAGGC CGAA ICAGAGGC | 13524 | GCCTCTGC C AATCCATG | 6461 |
| 1770 | ACAUGGAU CUGAUGAG GCCGUUAGGC CGAA IGCAGAGG | 13525 | CCTCTGCC A ATCCATGT | 6462 |
| 1774 | UCCCACAU CUGAUGAG GCCGUUAGGC CGAA IAUUGGCA | 13526 | TGCCAATC C ATGTGGGA | 6463 |
| 1775 | CUCCCACA CUGAUGAG GCCGUUAGGC CGAA IGAUUGGC | 13527 | GCCAATCC A TGTGGGAG | 6464 |
| 1790 | CAGGUGUG CUGAUGAG GCCGUUAGGC CGAA ICAACUCU | 13528 | AGAGTTGC C CACACCTG | 6465 |
| 1791 | ACAGGUGU CUGAUGAG GCCGUUAGGC CGAA IGCAACUC | 13529 | GAGTTGCC C ACACCTGT | 6466 |
| 1792 | AACAGGUG CUGAUGAG GCCGUUAGGC CGAA IGGCAACU | 13530 | AGTTGCCC A CACCTGTT | 6467 |
| 1794 | CAAACAGG CUGAUGAG GCCGUUAGGC CGAA IUGGGCAA | 13531 | TTGCCCAC A CCTGTTTG | 6468 |
| 1796 | UGCAAACA CUGAUGAG GCCGUUAGGC CGAA IUGUGGGC | 13532 | GCCCACAC C TGTTTGCA | 6469 |
| 1797 | UUGCAAAC CUGAUGAG GCCGUUAGGC CGAA IGUGUGGG | 13533 | CCCACACC T GTTTGCAA | 6470 |

| | | | | |
|---|---|---|---|---|
| 1804 | CAAGUUCU CUGAUGAG GCCGUUAGGC CGAA ICAAACAG | 13534 | CTGTTTGC A AGAACTTG | 6471 |
| 1810 | AGUAUCCA CUGAUGAG GCCGUUAGGC CGAA IUUCUUGC | 13535 | GCAAGAAC T TGGATACT | 6472 |
| 1818 | UUCCAAAG CUGAUGAG GCCGUUAGGC CGAA IUAUCCAA | 13536 | TTGGATAC T CTTTGGAA | 6473 |
| 1820 | AUUUCCAA CUGAUGAG GCCGUUAGGC CGAA IAGUAUCC | 13537 | GGATACTC T TTGGAAAT | 6474 |
| 1836 | AACAUGGU CUGAUGAG GCCGUUAGGC CGAA ICAUUCAA | 13538 | TTGAATGC C ACCATGTT | 6475 |
| 1837 | GAACAUGG CUGAUGAG GCCGUUAGGC CGAA IGCAUUCA | 13539 | TGAATGCC A CCATGTTC | 6476 |
| 1839 | GAGAACAU CUGAUGAG GCCGUUAGGC CGAA IUGGCAUU | 13540 | AATGCCAC C ATGTTCTC | 6477 |
| 1840 | AGAGAACA CUGAUGAG GCCGUUAGGC CGAA IGUGGCAU | 13541 | ATGCCACC A TGTTCTCT | 6478 |
| 1846 | GCUAUUAG CUGAUGAG GCCGUUAGGC CGAA IAACAUGG | 13542 | CCATGTTC T CTAATAGC | 6479 |
| 1848 | GUGCUAUU CUGAUGAG GCCGUUAGGC CGAA IAGAACAU | 13543 | ATGTTCTC T AATAGCAC | 6480 |
| 1855 | GUCAUUUG CUGAUGAG GCCGUUAGGC CGAA ICUAUUAG | 13544 | CTAATAGC A CAAATGAC | 6481 |
| 1857 | AUGUCAUU CUGAUGAG GCCGUUAGGC CGAA IUGCUAUU | 13545 | AATAGCAC A AATGACAT | 6482 |
| 1864 | GAUCAAAA CUGAUGAG GCCGUUAGGC CGAA IUCAUUUG | 13546 | CAAATGAC A TTTTGATC | 6483 |
| 1873 | AAGCUCCA CUGAUGAG GCCGUUAGGC CGAA IAUCAAAA | 13547 | TTTTGATC A TGGAGCTT | 6484 |
| 1880 | CAUUCUUA CUGAUGAG GCCGUUAGGC CGAA ICUCCAUG | 13548 | CATGGAGC T TAAGAATG | 6485 |
| 1890 | UGCAAGGA CUGAUGAG GCCGUUAGGC CGAA ICAUUCUU | 13549 | AAGAATGC A TCCTTGCA | 6486 |
| 1893 | UCCUGCAA CUGAUGAG GCCGUUAGGC CGAA IAUGCAUU | 13550 | AATGCATC C TTGCAGGA | 6487 |
| 1894 | GUCCUGCA CUGAUGAG GCCGUUAGGC CGAA IGAUGCAU | 13551 | ATGCATCC T TGCAGGAC | 6488 |
| 1898 | CUUGGUCC CUGAUGAG GCCGUUAGGC CGAA ICAAGGAU | 13552 | ATCCTTGC A GGACCAAG | 6489 |
| 1903 | GUCUCCUU CUGAUGAG GCCGUUAGGC CGAA IUCCUGCA | 13553 | TGCAGGAC C AAGGAGAC | 6490 |
| 1904 | AGUCUCCU CUGAUGAG GCCGUUAGGC CGAA IGUCCUGC | 13554 | GCAGGACC A AGGAGACT | 6491 |
| 1912 | GCAGACAU CUGAUGAG GCCGUUAGGC CGAA IUCUCCUU | 13555 | AAGGAGAC T ATGTCTGC | 6492 |
| 1918 | AGCAAGGC CUGAUGAG GCCGUUAGGC CGAA IACAUAGU | 13556 | ACTATGTC T GCCTTGCT | 6493 |
| 1921 | UUGAGCAA CUGAUGAG GCCGUUAGGC CGAA ICAGACAU | 13557 | ATGTCTGC C TTGCTCAA | 6494 |
| 1922 | CUUGAGCA CUGAUGAG GCCGUUAGGC CGAA IGCAGACA | 13558 | TGTCTGCC T TGCTCAAG | 6495 |
| 1926 | CUGUCUUG CUGAUGAG GCCGUUAGGC CGAA ICAAGGCA | 13559 | TGCCTTGC T CAAGACAG | 6496 |
| 1928 | UCCUGUCU CUGAUGAG GCCGUUAGGC CGAA IAGCAAGG | 13560 | CCTTGCTC A AGACAGGA | 6497 |
| 1933 | GGUCUUCC CUGAUGAG GCCGUUAGGC CGAA IUCUUGAG | 13561 | CTCAAGAC A GGAAGACC | 6498 |
| 1941 | CUUUUCUU CUGAUGAG GCCGUUAGGC CGAA IUCUUCCU | 13562 | AGGAAGAC C AAGAAAAG | 6499 |
| 1942 | UCUUUUCU CUGAUGAG GCCGUUAGGC CGAA IGUCUUCC | 13563 | GGAAGACC A AGAAAAGA | 6500 |
| 1952 | CCACGCAA CUGAUGAG GCCGUUAGGC CGAA IUCUUUUC | 13564 | GAAAAGAC A TTGCGTGG | 6501 |
| 1963 | GAGCUGCC CUGAUGAG GCCGUUAGGC CGAA IACCACGC | 13565 | GCGTGGTC A GGCAGCTC | 6502 |
| 1967 | CUGUGAGC CUGAUGAG GCCGUUAGGC CGAA ICCUGACC | 13566 | GGTCAGGC A GCTCACAG | 6503 |

276

| | | | | |
|---|---|---|---|---|
| 1970 | GGACUGUG CUGAUGAG GCCGUUAGGC CGAA ICUGCCUG | 13567 | CAGGCAGC T CACAGTCC | 6504 |
| 1972 | UAGGACUG CUGAUGAG GCCGUUAGGC CGAA IAGCUGCC | 13568 | GGCAGCTC A CAGTCCTA | 6505 |
| 1974 | UCUAGGAC CUGAUGAG GCCGUUAGGC CGAA IUGAGCUG | 13569 | CAGCTCAC A GTCCTAGA | 6506 |
| 1978 | ACGCUCUA CUGAUGAG GCCGUUAGGC CGAA IACUGUGA | 13570 | TCACAGTC C TAGAGCGT | 6507 |
| 1979 | CACGCUCU CUGAUGAG GCCGUUAGGC CGAA IGACUGUG | 13571 | CACAGTCC T AGAGCGTG | 6508 |
| 1992 | AUCGUGGG CUGAUGAG GCCGUUAGGC CGAA ICCACACG | 13572 | CGTGTGGC A CCCACGAT | 6509 |
| 1994 | UGAUCGUG CUGAUGAG GCCGUUAGGC CGAA IUGCCACA | 13573 | TGTGGCAC C CACGATCA | 6510 |
| 1995 | GUGAUCGU CUGAUGAG GCCGUUAGGC CGAA IGUGCCAC | 13574 | GTGGCACC C ACGATCAC | 6511 |
| 1996 | UGUGAUCG CUGAUGAG GCCGUUAGGC CGAA IGGUGCCA | 13575 | TGGCACCC A CGATCACA | 6512 |
| 2002 | GUUUCCUG CUGAUGAG GCCGUUAGGC CGAA IAUCGUGG | 13576 | CCACGATC A CAGGAAAC | 6513 |
| 2004 | AGGUUUCC CUGAUGAG GCCGUUAGGC CGAA IUGAUCGU | 13577 | ACGATCAC A GGAAACCT | 6514 |
| 2011 | AUUCUCCA CUGAUGAG GCCGUUAGGC CGAA IUUUCCUG | 13578 | CAGGAAAC C TGGAGAAT | 6515 |
| 2012 | GAUUCUCC CUGAUGAG GCCGUUAGGC CGAA IGUUUCCU | 13579 | AGGAAACC T GGAGAATC | 6516 |
| 2021 | UUGUCGUC CUGAUGAG GCCGUUAGGC CGAA IAUUCUCC | 13580 | GGAGAATC A GACGACAA | 6517 |
| 2028 | CCAAUACU CUGAUGAG GCCGUUAGGC CGAA IUCGUCUG | 13581 | CAGACGAC A AGTATTGG | 6518 |
| 2044 | GACUUCGA CUGAUGAG GCCGUUAGGC CGAA ICUUUCCC | 13582 | GGGAAAGC A TCGAAGTC | 6519 |
| 2053 | CGUGCAUG CUGAUGAG GCCGUUAGGC CGAA IACUUCGA | 13583 | TCGAAGTC T CATGCACG | 6520 |
| 2055 | GCCGUGCA CUGAUGAG GCCGUUAGGC CGAA IAGACUUC | 13584 | GAAGTCTC A TGCACGGC | 6521 |
| 2059 | AGAUGCCG CUGAUGAG GCCGUUAGGC CGAA ICAUGAGA | 13585 | TCTCATGC A CGGCATCT | 6522 |
| 2064 | UUCCCAGA CUGAUGAG GCCGUUAGGC CGAA ICCGUGCA | 13586 | TGCACGGC A TCTGGGAA | 6523 |
| 2067 | GGAUUCCC CUGAUGAG GCCGUUAGGC CGAA IAUGCCGU | 13587 | ACGGCATC T GGGAATCC | 6524 |
| 2075 | GUGGAGGG CUGAUGAG GCCGUUAGGC CGAA IAUUCCCA | 13588 | TGGGAATC C CCCTCCAC | 6525 |
| 2076 | UGUGGAGG CUGAUGAG GCCGUUAGGC CGAA IGAUUCCC | 13589 | GGGAATCC C CCTCCACA | 6526 |
| 2077 | CUGUGGAG CUGAUGAG GCCGUUAGGC CGAA IGGAUUCC | 13590 | GGAATCCC C CTCCACAG | 6527 |
| 2078 | UCUGUGGA CUGAUGAG GCCGUUAGGC CGAA IGGGAUUC | 13591 | GAATCCCC C TCCACAGA | 6528 |
| 2079 | AUCUGUGG CUGAUGAG GCCGUUAGGC CGAA IGGGGAUU | 13592 | AATCCCCC T CCACAGAT | 6529 |
| 2081 | UGAUCUGU CUGAUGAG GCCGUUAGGC CGAA IAGGGGGA | 13593 | TCCCCCTC C ACAGATCA | 6530 |
| 2082 | AUGAUCUG CUGAUGAG GCCGUUAGGC CGAA IGAGGGGG | 13594 | CCCCCTCC A CAGATCAT | 6531 |
| 2084 | ACAUGAUC CUGAUGAG GCCGUUAGGC CGAA IUGGAGGG | 13595 | CCCTCCAC A GATCATGT | 6532 |
| 2089 | AAACCACA CUGAUGAG GCCGUUAGGC CGAA IAUCUGUG | 13596 | CACAGATC A TGTGGTTT | 6533 |
| 2112 | UCUACAAG CUGAUGAG GCCGUUAGGC CGAA IUCUCAUU | 13597 | AATGAGAC C CTTGTAGA | 6534 |
| 2113 | UUCUACAA CUGAUGAG GCCGUUAGGC CGAA IGUCUCAU | 13598 | ATGAGACC C TTGTAGAA | 6535 |
| 2114 | CUUCUACA CUGAUGAG GCCGUUAGGC CGAA IGGUCUCA | 13599 | TGAGACCC T TGTAGAAG | 6536 |

| | | | | |
|---|---|---|---|---|
| 2125 | AAUGCCUG CUGAUGAG GCCGUUAGGC CGAA IUCUUCUA | 13600 | TAGAAGAC T CAGGCATT | 6537 |
| 2127 | ACAAUGCC CUGAUGAG GCCGUUAGGC CGAA IAGUCUUC | 13601 | GAAGACTC A GGCATTGT | 6538 |
| 2131 | CAAUACAA CUGAUGAG GCCGUUAGGC CGAA ICCUGAGU | 13602 | ACTCAGGC A TTGTATTG | 6539 |
| 2152 | GAGGUUCC CUGAUGAG GCCGUUAGGC CGAA IUUCCCAU | 13603 | ATGGGAAC C GGAACCTC | 6540 |
| 2158 | GAUAGUGA CUGAUGAG GCCGUUAGGC CGAA IUUCCGGU | 13604 | ACCGGAAC C TCACTATC | 6541 |
| 2159 | GGAUAGUG CUGAUGAG GCCGUUAGGC CGAA IGUUCCGG | 13605 | CCGGAACC T CACTATCC | 6542 |
| 2161 | GCGGAUAG CUGAUGAG GCCGUUAGGC CGAA IAGGUUCC | 13606 | GGAACCTC A CTATCCGC | 6543 |
| 2163 | CUGCGGAU CUGAUGAG GCCGUUAGGC CGAA IUGAGGUU | 13607 | AACCTCAC T ATCCGCAG | 6544 |
| 2167 | CACUCUGC CUGAUGAG GCCGUUAGGC CGAA IAUAGUGA | 13608 | TCACTATC C GCAGAGTG | 6545 |
| 2170 | CCUCACUC CUGAUGAG GCCGUUAGGC CGAA ICGGAUAG | 13609 | CTATCCGC A GAGTGAGG | 6546 |
| 2194 | GGUGUAGA CUGAUGAG GCCGUUAGGC CGAA ICCUUCGU | 13610 | ACGAAGGC C TCTACACC | 6547 |
| 2195 | AGGUGUAG CUGAUGAG GCCGUUAGGC CGAA IGCCUUCG | 13611 | CGAAGGCC T CTACACCT | 6548 |
| 2197 | GCAGGUGU CUGAUGAG GCCGUUAGGC CGAA IAGGCCUU | 13612 | AAGGCCTC T ACACCTGC | 6549 |
| 2200 | CUGGCAGG CUGAUGAG GCCGUUAGGC CGAA IUAGAGGC | 13613 | GCCTCTAC A CCTGCCAG | 6550 |
| 2202 | GCCUGGCA CUGAUGAG GCCGUUAGGC CGAA IUGUAGAG | 13614 | CTCTACAC C TGCCAGGC | 6551 |
| 2203 | UGCCUGGC CUGAUGAG GCCGUUAGGC CGAA IGUGUAGA | 13615 | TCTACACC T GCCAGGCA | 6552 |
| 2206 | GCAUGCCU CUGAUGAG GCCGUUAGGC CGAA ICAGGUGU | 13616 | ACACCTGC C AGGCATGC | 6553 |
| 2207 | UGCAUGCC CUGAUGAG GCCGUUAGGC CGAA IGCAGGUG | 13617 | CACCTGCC A GGCATGCA | 6554 |
| 2211 | ACACUGCA CUGAUGAG GCCGUUAGGC CGAA ICCUGGCA | 13618 | TGCCAGGC A TGCAGTGT | 6555 |
| 2215 | AAGAACAC CUGAUGAG GCCGUUAGGC CGAA ICAUGCCU | 13619 | AGGCATGC A GTGTTCTT | 6556 |
| 2222 | CACAGCCA CUGAUGAG GCCGUUAGGC CGAA IAACACUG | 13620 | CAGTGTTC T TGGCTGTG | 6557 |
| 2227 | UUUUGCAC CUGAUGAG GCCGUUAGGC CGAA ICCAAGAA | 13621 | TTCTTGGC T GTGCAAAA | 6558 |
| 2232 | UCCACUUU CUGAUGAG GCCGUUAGGC CGAA ICACAGCC | 13622 | GGCTGTGC A AAAGTGGA | 6559 |
| 2244 | AUGAAAAA CUGAUGAG GCCGUUAGGC CGAA ICCUCCAC | 13623 | GTGGAGGC A TTTTTCAT | 6560 |
| 2251 | UUCUAUUA CUGAUGAG GCCGUUAGGC CGAA IAAAAAUG | 13624 | CATTTTTC A TAATAGAA | 6561 |
| 2265 | UUUUCCUG CUGAUGAG GCCGUUAGGC CGAA ICACCUUC | 13625 | GAAGGTGC C CAGGAAAA | 6562 |
| 2266 | CUUUUCCU CUGAUGAG GCCGUUAGGC CGAA IGCACCUU | 13626 | AAGGTGCC C AGGAAAAG | 6563 |
| 2267 | UCUUUUCC CUGAUGAG GCCGUUAGGC CGAA IGGCACCU | 13627 | AGGTGCCC A GGAAAAGA | 6564 |
| 2281 | GAUUUCCA CUGAUGAG GCCGUUAGGC CGAA IUUCGUCU | 13628 | AGACGAAC T TGGAAATC | 6565 |
| 2290 | UAGAAUAA CUGAUGAG GCCGUUAGGC CGAA IAUUUCCA | 13629 | TGGAAATC A TTATTCTA | 6566 |
| 2297 | UGCCUACU CUGAUGAG GCCGUUAGGC CGAA IAAUAAUG | 13630 | CATTATTC T AGTAGGCA | 6567 |
| 2305 | CACCGUCG CUGAUGAG GCCGUUAGGC CGAA ICCUACUA | 13631 | TAGTAGGC A CGACGGTG | 6568 |
| 2319 | AAGAACAU CUGAUGAG GCCGUUAGGC CGAA ICAAUCAC | 13632 | GTGATTGC C ATGTTCTT | 6569 |

| | | | | |
|---|---|---|---|---|
| 2320 | GAAGAACA CUGAUGAG GCCGUUAGGC CGAA IGCAAUCA | 13633 | TGATTGCC A TGTTCTTC | 6570 |
| 2326 | UAGCCAGA CUGAUGAG GCCGUUAGGC CGAA IAACAUGG | 13634 | CCATGTTC T TCTGGCTA | 6571 |
| 2329 | AAGUAGCC CUGAUGAG GCCGUUAGGC CGAA IAAGAACA | 13635 | TGTTCTTC T GGCTACTT | 6572 |
| 2333 | CAAGAAGU CUGAUGAG GCCGUUAGGC CGAA ICCAGAAG | 13636 | CTTCTGGC T ACTTCTTG | 6573 |
| 2336 | UGACAAGA CUGAUGAG GCCGUUAGGC CGAA IUAGCCAG | 13637 | CTGGCTAC T TCTTGTCA | 6574 |
| 2339 | UGAUGACA CUGAUGAG GCCGUUAGGC CGAA IAAGUAGC | 13638 | GCTACTTC T TGTCATCA | 6575 |
| 2344 | UAGGAUGA CUGAUGAG GCCGUUAGGC CGAA IACAAGAA | 13639 | TTCTTGTC A TCATCCTA | 6576 |
| 2347 | CCCUAGGA CUGAUGAG GCCGUUAGGC CGAA IAUGACAA | 13640 | TTGTCATC A TCCTAGGG | 6577 |
| 2350 | GGUCCCUA CUGAUGAG GCCGUUAGGC CGAA IAUGAUGA | 13641 | TCATCATC C TAGGGACC | 6578 |
| 2351 | CGGUCCCU CUGAUGAG GCCGUUAGGC CGAA IGAUGAUG | 13642 | CATCATCC T AGGGACCG | 6579 |
| 2358 | CGCUUAAC CUGAUGAG GCCGUUAGGC CGAA IUCCCUAG | 13643 | CTAGGGAC C GTTAAGCG | 6580 |
| 2370 | CCUCCAUU CUGAUGAG GCCGUUAGGC CGAA ICCCGCUU | 13644 | AAGCGGGC C AATGGAGG | 6581 |
| 2371 | CCCUCCAU CUGAUGAG GCCGUUAGGC CGAA IGCCCGCU | 13645 | AGCGGGCC A ATGGAGGG | 6582 |
| 2384 | CUGUCUUC CUGAUGAG GCCGUUAGGC CGAA IUUCCCCU | 13646 | AGGGGAAC T GAAGACAG | 6583 |
| 2391 | AAGUAGCC CUGAUGAG GCCGUUAGGC CGAA IUCUUCAG | 13647 | CTGAAGAC A GGCTACTT | 6584 |
| 2395 | GGACAAGU CUGAUGAG GCCGUUAGGC CGAA ICCUGUCU | 13648 | AGACAGGC T ACTTGTCC | 6585 |
| 2398 | GAUGGACA CUGAUGAG GCCGUUAGGC CGAA IUAGCCUG | 13649 | CAGGCTAC T TGTCCATC | 6586 |
| 2403 | AUGACGAU CUGAUGAG GCCGUUAGGC CGAA IACAAGUA | 13650 | TACTTGTC C ATCGTCAT | 6587 |
| 2404 | CAUGACGA CUGAUGAG GCCGUUAGGC CGAA IGACAAGU | 13651 | ACTTGTCC A TCGTCATG | 6588 |
| 2410 | UGGAUCCA CUGAUGAG GCCGUUAGGC CGAA IACGAUGG | 13652 | CCATCGTC A TGGATCCA | 6589 |
| 2417 | GUUCAUCU CUGAUGAG GCCGUUAGGC CGAA IAUCCAUG | 13653 | CATGGATC C AGATGAAC | 6590 |
| 2418 | AGUUCAUC CUGAUGAG GCCGUUAGGC CGAA IGAUCCAU | 13654 | ATGGATCC A GATGAACT | 6591 |
| 2426 | CCAAUGGG CUGAUGAG GCCGUUAGGC CGAA IUUCAUCU | 13655 | AGATGAAC T CCCATTGG | 6592 |
| 2428 | AUCCAAUG CUGAUGAG GCCGUUAGGC CGAA IAGUUCAU | 13656 | ATGAACTC C CATTGGAT | 6593 |
| 2429 | CAUCCAAU CUGAUGAG GCCGUUAGGC CGAA IGAGUUCA | 13657 | TGAACTCC C ATTGGATG | 6594 |
| 2430 | UCAUCCAA CUGAUGAG GCCGUUAGGC CGAA IGGAGUUC | 13658 | GAACTCCC A TTGGATGA | 6595 |
| 2441 | GUUCACAA CUGAUGAG GCCGUUAGGC CGAA IUUCAUCC | 13659 | GGATGAAC A TTGTGAAC | 6596 |
| 2453 | CAUAAGGC CUGAUGAG GCCGUUAGGC CGAA IUCGUUCA | 13660 | TGAACGAC T GCCTTATG | 6597 |
| 2456 | CAUCAUAA CUGAUGAG GCCGUUAGGC CGAA ICAGUCGU | 13661 | ACGACTGC C TTATGATG | 6598 |
| 2457 | GCAUCAUA CUGAUGAG GCCGUUAGGC CGAA IGCAGUCG | 13662 | CGACTGCC T TATGATGC | 6599 |
| 2466 | CAUUUGCU CUGAUGAG GCCGUUAGGC CGAA ICAUCAUA | 13663 | TATGATGC C AGCAAATG | 6600 |
| 2467 | CCAUUUGC CUGAUGAG GCCGUUAGGC CGAA IGCAUCAU | 13664 | ATGATGCC A GCAAATGG | 6601 |
| 2470 | UUCCCAUU CUGAUGAG GCCGUUAGGC CGAA ICUGGCAU | 13665 | ATGCCAGC A AATGGGAA | 6602 |

279

| | | | | |
|---|---|---|---|---|
| 2482 | GUCUCUGG CUGAUGAG GCCGUUAGGC CGAA IAAUUCCC | 13666 | GGGAATTC C CCAGAGAC | 6603 |
| 2483 | GGUCUCUG CUGAUGAG GCCGUUAGGC CGAA IGAAUUCC | 13667 | GGAATTCC C CAGAGACC | 6604 |
| 2484 | CGGUCUCU CUGAUGAG GCCGUUAGGC CGAA IGGAAUUC | 13668 | GAATTCCC C AGAGACCG | 6605 |
| 2485 | CCGGUCUC CUGAUGAG GCCGUUAGGC CGAA IGGGAAUU | 13669 | AATTCCCC A GAGACCGG | 6606 |
| 2491 | GUUCAGCC CUGAUGAG GCCGUUAGGC CGAA IUCUCUGG | 13670 | CCAGAGAC C GGCTGAAC | 6607 |
| 2495 | CUAGGUUC CUGAUGAG GCCGUUAGGC CGAA ICCGGUCU | 13671 | AGACCGGC T GAACCTAG | 6608 |
| 2500 | CUUACCUA CUGAUGAG GCCGUUAGGC CGAA IUUCAGCC | 13672 | GGCTGAAC C TAGGTAAG | 6609 |
| 2501 | GCUUACCU CUGAUGAG GCCGUUAGGC CGAA IGUUCAGC | 13673 | GCTGAACC T AGGTAAGC | 6610 |
| 2510 | GGCCAAGA CUGAUGAG GCCGUUAGGC CGAA ICUUACCU | 13674 | AGGTAAGC C TCTTGGCC | 6611 |
| 2511 | CGGCCAAG CUGAUGAG GCCGUUAGGC CGAA IGCUUACC | 13675 | GGTAAGCC T CTTGGCCG | 6612 |
| 2513 | CACGGCCA CUGAUGAG GCCGUUAGGC CGAA IAGGCUUA | 13676 | TAAGCCTC T TGGCCGTG | 6613 |
| 2518 | GGCACCAC CUGAUGAG GCCGUUAGGC CGAA ICCAAGAG | 13677 | CTCTTGGC C GTGGTGCC | 6614 |
| 2526 | UGGCCAAA CUGAUGAG GCCGUUAGGC CGAA ICACCACG | 13678 | CGTGGTGC C TTTGGCCA | 6615 |
| 2527 | UUGGCCAA CUGAUGAG GCCGUUAGGC CGAA IGCACCAC | 13679 | GTGGTGCC T TTGGCCAA | 6616 |
| 2533 | AAUCUCUU CUGAUGAG GCCGUUAGGC CGAA ICCAAAGG | 13680 | CCTTTGGC C AAGAGATT | 6617 |
| 2534 | CAAUCUCU CUGAUGAG GCCGUUAGGC CGAA IGCCAAAG | 13681 | CTTTGGCC A AGAGATTG | 6618 |
| 2547 | AAGGCAUC CUGAUGAG GCCGUUAGGC CGAA ICUUCAAU | 13682 | ATTGAAGC A GATGCCTT | 6619 |
| 2553 | AUUCCAAA CUGAUGAG GCCGUUAGGC CGAA ICAUCUGC | 13683 | GCAGATGC C TTTGGAAT | 6620 |
| 2554 | AAUUCCAA CUGAUGAG GCCGUUAGGC CGAA IGCAUCUG | 13684 | CAGATGCC T TTGGAATT | 6621 |
| 2566 | UGCUGUCU CUGAUGAG GCCGUUAGGC CGAA IUCAAUUC | 13685 | GAATTGAC A AGACAGCA | 6622 |
| 2571 | CAAGUUGC CUGAUGAG GCCGUUAGGC CGAA IUCUUGUC | 13686 | GACAAGAC A GCAACTTG | 6623 |
| 2574 | CUGCAAGU CUGAUGAG GCCGUUAGGC CGAA ICUGUCUU | 13687 | AAGACAGC A ACTTGCAG | 6624 |
| 2577 | GUCCUGCA CUGAUGAG GCCGUUAGGC CGAA IUUGCUGU | 13688 | ACAGCAAC T TGCAGGAC | 6625 |
| 2581 | UACUGUCC CUGAUGAG GCCGUUAGGC CGAA ICAAGUUG | 13689 | CAACTTGC A GGACAGTA | 6626 |
| 2586 | ACUGCUAC CUGAUGAG GCCGUUAGGC CGAA IUCCUGCA | 13690 | TGCAGGAC A GTAGCAGT | 6627 |
| 2592 | AUUUUGAC CUGAUGAG GCCGUUAGGC CGAA ICUACUGU | 13691 | ACAGTAGC A GTCAAAAT | 6628 |
| 2596 | CAACAUUU CUGAUGAG GCCGUUAGGC CGAA IACUGCUA | 13692 | TAGCAGTC A AAATGTTG | 6629 |
| 2616 | CUGUGUGU CUGAUGAG GCCGUUAGGC CGAA ICUCCUUC | 13693 | GAAGGAGC A ACACACAG | 6630 |
| 2619 | UCACUGUG CUGAUGAG GCCGUUAGGC CGAA IUUGCUCC | 13694 | GGAGCAAC A CACAGTGA | 6631 |
| 2621 | GCUCACUG CUGAUGAG GCCGUUAGGC CGAA IUGUUGCU | 13695 | AGCAACAC A CAGTGAGC | 6632 |
| 2623 | AUGCUCAC CUGAUGAG GCCGUUAGGC CGAA IUGUGUUG | 13696 | CAACACAC A GTGAGCAT | 6633 |
| 2630 | GAGCUCGA CUGAUGAG GCCGUUAGGC CGAA ICUCACUG | 13697 | CAGTGAGC A TCGAGCTC | 6634 |
| 2637 | GACAUGAG CUGAUGAG GCCGUUAGGC CGAA ICUCGAUG | 13698 | CATCGAGC T CTCATGTC | 6635 |

280

| | | | | |
|---|---|---|---|---|
| 2639 | CAGACAUG CUGAUGAG GCCGUUAGGC CGAA IAGCUCGA | 13699 | TCGAGCTC T CATGTCTG | 6636 |
| 2641 | UUCAGACA CUGAUGAG GCCGUUAGGC CGAA IAGAGCUC | 13700 | GAGCTCTC A TGTCTGAA | 6637 |
| 2646 | UUGAGUUC CUGAUGAG GCCGUUAGGC CGAA IACAUGAG | 13701 | CTCATGTC T GAACTCAA | 6638 |
| 2651 | GGAUCUUG CUGAUGAG GCCGUUAGGC CGAA IUUCAGAC | 13702 | GTCTGAAC T CAAGATCC | 6639 |
| 2653 | GAGGAUCU CUGAUGAG GCCGUUAGGC CGAA IAGUUCAG | 13703 | CTGAACTC A AGATCCTC | 6640 |
| 2659 | AUGAAUGA CUGAUGAG GCCGUUAGGC CGAA IAUCUUGA | 13704 | TCAAGATC C TCATTCAT | 6641 |
| 2660 | UAUGAAUG CUGAUGAG GCCGUUAGGC CGAA IGAUCUUG | 13705 | CAAGATCC T CATTCATA | 6642 |
| 2662 | AAUAUGAA CUGAUGAG GCCGUUAGGC CGAA IAGGAUCU | 13706 | AGATCCTC A TTCATATT | 6643 |
| 2666 | GACCAAUA CUGAUGAG GCCGUUAGGC CGAA IAAUGAGG | 13707 | CCTCATTC A TATTGGTC | 6644 |
| 2675 | UGAGAUGG CUGAUGAG GCCGUUAGGC CGAA IACCAAUA | 13708 | TATTGGTC A CCATCTCA | 6645 |
| 2677 | AUUGAGAU CUGAUGAG GCCGUUAGGC CGAA IUGACCAA | 13709 | TTGGTCAC C ATCTCAAT | 6646 |
| 2678 | CAUUGAGA CUGAUGAG GCCGUUAGGC CGAA IGUGACCA | 13710 | TGGTCACC A TCTCAATG | 6647 |
| 2681 | CCACAUUG CUGAUGAG GCCGUUAGGC CGAA IAUGGUGA | 13711 | TCACCATC T CAATGTGG | 6648 |
| 2683 | GACCACAU CUGAUGAG GCCGUUAGGC CGAA IAGAUGGU | 13712 | ACCATCTC A ATGTGGTC | 6649 |
| 2692 | UAGAAGGU CUGAUGAG GCCGUUAGGC CGAA IACCACAU | 13713 | ATGTGGTC A ACCTTCTA | 6650 |
| 2695 | ACCUAGAA CUGAUGAG GCCGUUAGGC CGAA IUUGACCA | 13714 | TGGTCAAC C TTCTAGGT | 6651 |
| 2696 | CACCUAGA CUGAUGAG GCCGUUAGGC CGAA IGUUGACC | 13715 | GGTCAACC T TCTAGGTG | 6652 |
| 2699 | AGGCACCU CUGAUGAG GCCGUUAGGC CGAA IAAGGUUG | 13716 | CAACCTTC T AGGTGCCT | 6653 |
| 2706 | UUGGUACA CUGAUGAG GCCGUUAGGC CGAA ICACCUAG | 13717 | CTAGGTGC C TGTACCAA | 6654 |
| 2707 | CUUGGUAC CUGAUGAG GCCGUUAGGC CGAA IGCACCUA | 13718 | TAGGTGCC T GTACCAAG | 6655 |
| 2712 | CCUGGCUU CUGAUGAG GCCGUUAGGC CGAA IUACAGGC | 13719 | GCCTGTAC C AAGCCAGG | 6656 |
| 2713 | UCCUGGCU CUGAUGAG GCCGUUAGGC CGAA IGUACAGG | 13720 | CCTGTACC A AGCCAGGA | 6657 |
| 2717 | GCCCUCCU CUGAUGAG GCCGUUAGGC CGAA ICUUGGUA | 13721 | TACCAAGC C AGGAGGGC | 6658 |
| 2718 | GGCCCUCC CUGAUGAG GCCGUUAGGC CGAA IGCUUGGU | 13722 | ACCAAGCC A GGAGGGCC | 6659 |
| 2726 | CCAUGAGU CUGAUGAG GCCGUUAGGC CGAA ICCCUCCU | 13723 | AGGAGGGC C ACTCATGG | 6660 |
| 2727 | ACCAUGAG CUGAUGAG GCCGUUAGGC CGAA IGCCCUCC | 13724 | GGAGGGCC A CTCATGGT | 6661 |
| 2729 | UCACCAUG CUGAUGAG GCCGUUAGGC CGAA IUGGCCCU | 13725 | AGGGCCAC T CATGGTGA | 6662 |
| 2731 | AAUCACCA CUGAUGAG GCCGUUAGGC CGAA IAGUGGCC | 13726 | GGCCACTC A TGGTGATT | 6663 |
| 2749 | AAAUUUGC CUGAUGAG GCCGUUAGGC CGAA IAAUUCCA | 13727 | TGGAATTC T GCAAATTT | 6664 |
| 2752 | UCCAAAUU CUGAUGAG GCCGUUAGGC CGAA ICAGAAUU | 13728 | AATTCTGC A AATTTGGA | 6665 |
| 2764 | AGUGGACA CUGAUGAG GCCGUUAGGC CGAA IUUUCCAA | 13729 | TTGGAAAC C TGTCCACT | 6666 |
| 2765 | AAGUGGAC CUGAUGAG GCCGUUAGGC CGAA IGUUUCCA | 13730 | TGGAAACC T GTCCACTT | 6667 |
| 2769 | AGGUAAGU CUGAUGAG GCCGUUAGGC CGAA IACAGGUU | 13731 | AACCTGTC C ACTTACCT | 6668 |

| | | | | | |
|---|---|---|---|---|---|
| 2770 | CAGGUAAG CUGAUGAG GCCGUUAGGC CGAA IGACAGGU | 13732 | ACCTGTCC A CTTACCTG | 6669 |
| 2772 | CUCAGGUA CUGAUGAG GCCGUUAGGC CGAA IUGGACAG | 13733 | CTGTCCAC T TACCTGAG | 6670 |
| 2776 | GCUCCUCA CUGAUGAG GCCGUUAGGC CGAA IUAAGUGG | 13734 | CCACTTAC C TGAGGAGC | 6671 |
| 2777 | UGCUCCUC CUGAUGAG GCCGUUAGGC CGAA IGUAAGUG | 13735 | CACTTACC T GAGGAGCA | 6672 |
| 2785 | AUUUCUCU CUGAUGAG GCCGUUAGGC CGAA ICUCCUCA | 13736 | TGAGGAGC A AGAGAAAT | 6673 |
| 2803 | CUUGUAGG CUGAUGAG GCCGUUAGGC CGAA IACAAAUU | 13737 | AATTTGTC C CCTACAAG | 6674 |
| 2804 | UCUUGUAG CUGAUGAG GCCGUUAGGC CGAA IGACAAAU | 13738 | ATTTGTCC C CTACAAGA | 6675 |
| 2805 | GUCUUGUA CUGAUGAG GCCGUUAGGC CGAA IGGACAAA | 13739 | TTTGTCCC C TACAAGAC | 6676 |
| 2806 | GGUCUUGU CUGAUGAG GCCGUUAGGC CGAA IGGGACAA | 13740 | TTGTCCCC T ACAAGACC | 6677 |
| 2809 | UUUGGUCU CUGAUGAG GCCGUUAGGC CGAA IUAGGGGA | 13741 | TCCCCTAC A AGACCAAA | 6678 |
| 2814 | GCCCCUUU CUGAUGAG GCCGUUAGGC CGAA IUCUUGUA | 13742 | TACAAGAC C AAAGGGGC | 6679 |
| 2815 | UGCCCCUU CUGAUGAG GCCGUUAGGC CGAA IGUCUUGU | 13743 | ACAAGACC A AAGGGGCA | 6680 |
| 2823 | CGGAAUCG CUGAUGAG GCCGUUAGGC CGAA ICCCCUUU | 13744 | AAAGGGGC A CGATTCCG | 6681 |
| 2830 | CCCUUGAC CUGAUGAG GCCGUUAGGC CGAA IAAUCGUG | 13745 | CACGATTC C GTCAAGGG | 6682 |
| 2834 | CUUUCCCU CUGAUGAG GCCGUUAGGC CGAA IACGGAAU | 13746 | ATTCCGTC A AGGGAAAG | 6683 |
| 2845 | UCCAACGU CUGAUGAG GCCGUUAGGC CGAA IUCUUUCC | 13747 | GGAAAGAC T ACGTTGGA | 6684 |
| 2856 | ACAGGGAU CUGAUGAG GCCGUUAGGC CGAA ICUCCAAC | 13748 | GTTGGAGC A ATCCCTGT | 6685 |
| 2860 | AUCCACAG CUGAUGAG GCCGUUAGGC CGAA IAUUGCUC | 13749 | GAGCAATC C CTGTGGAT | 6686 |
| 2861 | GAUCCACA CUGAUGAG GCCGUUAGGC CGAA IGAUUGCU | 13750 | AGCAATCC C TGTGGATC | 6687 |
| 2862 | AGAUCCAC CUGAUGAG GCCGUUAGGC CGAA IGGAUUGC | 13751 | GCAATCCC T GTGGATCT | 6688 |
| 2870 | GCCGUUUC CUGAUGAG GCCGUUAGGC CGAA IAUCCACA | 13752 | TGTGGATC T GAAACGGC | 6689 |
| 2881 | GCUGUCCA CUGAUGAG GCCGUUAGGC CGAA ICGCCGUU | 13753 | AACGGCGC T TGGACAGC | 6690 |
| 2887 | GGUGAUGC CUGAUGAG GCCGUUAGGC CGAA IUCCAAGC | 13754 | GCTTGGAC A GCATCACC | 6691 |
| 2890 | ACUGGUGA CUGAUGAG GCCGUUAGGC CGAA ICUGUCCA | 13755 | TGGACAGC A TCACCAGT | 6692 |
| 2893 | GCUACUGG CUGAUGAG GCCGUUAGGC CGAA IAUGCUGU | 13756 | ACAGCATC A CCAGTAGC | 6693 |
| 2895 | UGGCUACU CUGAUGAG GCCGUUAGGC CGAA IUGAUGCU | 13757 | AGCATCAC C AGTAGCCA | 6694 |
| 2896 | CUGGCUAC CUGAUGAG GCCGUUAGGC CGAA IGUGAUGC | 13758 | GCATCACC A GTAGCCAG | 6695 |
| 2902 | UGAGCUCU CUGAUGAG GCCGUUAGGC CGAA ICUACUGG | 13759 | CCAGTAGC C AGAGCTCA | 6696 |
| 2903 | CUGAGCUC CUGAUGAG GCCGUUAGGC CGAA IGCUACUG | 13760 | CAGTAGCC A GAGCTCAG | 6697 |
| 2908 | GCUGGCUG CUGAUGAG GCCGUUAGGC CGAA ICUCUGGC | 13761 | GCCAGAGC T CAGCCAGC | 6698 |
| 2910 | GAGCUGGC CUGAUGAG GCCGUUAGGC CGAA IAGCUCUG | 13762 | CAGAGCTC A GCCAGCTC | 6699 |
| 2913 | CCAGAGCU CUGAUGAG GCCGUUAGGC CGAA ICUGAGCU | 13763 | AGCTCAGC C AGCTCTGG | 6700 |
| 2914 | UCCAGAGC CUGAUGAG GCCGUUAGGC CGAA IGCUGAGC | 13764 | GCTCAGCC A GCTCTGGA | 6701 |

282

| | | | | |
|---|---|---|---|---|
| 2917 | AAAUCCAG CUGAUGAG GCCGUUAGGC CGAA ICUGGCUG | 13765 | CAGCCAGC T CTGGATTT | 6702 |
| 2919 | ACAAAUCC CUGAUGAG GCCGUUAGGC CGAA IAGCUGGC | 13766 | GCCAGCTC T GGATTTGT | 6703 |
| 2940 | UCACUGAG CUGAUGAG GCCGUUAGGC CGAA IACUUCUC | 13767 | GAGAAGTC C CTCAGTGA | 6704 |
| 2941 | AUCACUGA CUGAUGAG GCCGUUAGGC CGAA IGACUUCU | 13768 | AGAAGTCC C TCAGTGAT | 6705 |
| 2942 | CAUCACUG CUGAUGAG GCCGUUAGGC CGAA IGGACUUC | 13769 | GAAGTCCC T CAGTGATG | 6706 |
| 2944 | UACAUCAC CUGAUGAG GCCGUUAGGC CGAA IAGGGACU | 13770 | AGTCCCTC A GTGATGTA | 6707 |
| 2967 | UCUUCAGG CUGAUGAG GCCGUUAGGC CGAA ICUUCCUC | 13771 | GAGGAAGC T CCTGAAGA | 6708 |
| 2969 | GAUCUUCA CUGAUGAG GCCGUUAGGC CGAA IAGCUUCC | 13772 | GGAAGCTC C TGAAGATC | 6709 |
| 2970 | AGAUCUUC CUGAUGAG GCCGUUAGGC CGAA IGAGCUUC | 13773 | GAAGCTCC T GAAGATCT | 6710 |
| 2978 | CCUUAUAC CUGAUGAG GCCGUUAGGC CGAA IAUCUUCA | 13774 | TGAAGATC T GTATAAGG | 6711 |
| 2989 | GGUCAGGA CUGAUGAG GCCGUUAGGC CGAA IUCCUUAU | 13775 | ATAAGGAC T TCCTGACC | 6712 |
| 2992 | CAAGGUCA CUGAUGAG GCCGUUAGGC CGAA IAAGUCCU | 13776 | AGGACTTC C TGACCTTG | 6713 |
| 2993 | CCAAGGUC CUGAUGAG GCCGUUAGGC CGAA IGAAGUCC | 13777 | GGACTTCC T GACCTTGG | 6714 |
| 2997 | UGCUCCAA CUGAUGAG GCCGUUAGGC CGAA IUCAGGAA | 13778 | TTCCTGAC C TTGGAGCA | 6715 |
| 2998 | AUGCUCCA CUGAUGAG GCCGUUAGGC CGAA IGUCAGGA | 13779 | TCCTGACC T TGGAGCAT | 6716 |
| 3005 | AGAUGAGA CUGAUGAG GCCGUUAGGC CGAA ICUCCAAG | 13780 | CTTGGAGC A TCTCATCT | 6717 |
| 3008 | AACAGAUG CUGAUGAG GCCGUUAGGC CGAA IAUGCUCC | 13781 | GGAGCATC T CATCTGTT | 6718 |
| 3010 | GUAACAGA CUGAUGAG GCCGUUAGGC CGAA IAGAUGCU | 13782 | AGCATCTC A TCTGTTAC | 6719 |
| 3013 | GCUGUAAC CUGAUGAG GCCGUUAGGC CGAA IAUGAGAU | 13783 | ATCTCATC T GTTACAGC | 6720 |
| 3019 | UUGGAAGC CUGAUGAG GCCGUUAGGC CGAA IUAACAGA | 13784 | TCTGTTAC A GCTTCCAA | 6721 |
| 3022 | CACUUGGA CUGAUGAG GCCGUUAGGC CGAA ICUGUAAC | 13785 | GTTACAGC T TCCAAGTG | 6722 |
| 3025 | AGCCACUU CUGAUGAG GCCGUUAGGC CGAA IAAGCUGU | 13786 | ACAGCTTC C AAGTGGCT | 6723 |
| 3026 | UAGCCACU CUGAUGAG GCCGUUAGGC CGAA IGAAGCUG | 13787 | CAGCTTCC A AGTGGCTA | 6724 |
| 3033 | AUGCCCUU CUGAUGAG GCCGUUAGGC CGAA ICCACUUG | 13788 | CAAGTGGC T AAGGGCAT | 6725 |
| 3040 | GAACUCCA CUGAUGAG GCCGUUAGGC CGAA ICCCUUAG | 13789 | CTAAGGGC A TGGAGTTC | 6726 |
| 3049 | CGAUGCCA CUGAUGAG GCCGUUAGGC CGAA IAACUCCA | 13790 | TGGAGTTC T TGGCATCG | 6727 |
| 3054 | UUUCGCGA CUGAUGAG GCCGUUAGGC CGAA ICCAAGAA | 13791 | TTCTTGGC A TCGCGAAA | 6728 |
| 3070 | GUCCCUGU CUGAUGAG GCCGUUAGGC CGAA IAUACACU | 13792 | AGTGTATC C ACAGGGAC | 6729 |
| 3071 | GGUCCCUG CUGAUGAG GCCGUUAGGC CGAA IGAUACAC | 13793 | GTGTATCC A CAGGGACC | 6730 |
| 3073 | CAGGUCCC CUGAUGAG GCCGUUAGGC CGAA IUGGAUAC | 13794 | GTATCCAC A GGGACCTG | 6731 |
| 3079 | UGCCGCCA CUGAUGAG GCCGUUAGGC CGAA IUCCCUGU | 13795 | ACAGGGAC C TGGCGGCA | 6732 |
| 3080 | GUGCCGCC CUGAUGAG GCCGUUAGGC CGAA IGUCCCUG | 13796 | CAGGGACC T GGCGGCAC | 6733 |
| 3087 | AUAUUUCG CUGAUGAG GCCGUUAGGC CGAA ICCGCCAG | 13797 | CTGGCGGC A CGAAATAT | 6734 |

283

| | | | | |
|---|---|---|---|---|
| 3097 | CGAUAAGA CUGAUGAG GCCGUUAGGC CGAA IAUAUUUC | 13798 | GAAATATC C TCTTATCG | 6735 |
| 3098 | CCGAUAAG CUGAUGAG GCCGUUAGGC CGAA IGAUAUUU | 13799 | AAATATCC T CTTATCGG | 6736 |
| 3100 | CUCCGAUA CUGAUGAG GCCGUUAGGC CGAA IAGGAUAU | 13800 | ATATCCTC T TATCGGAG | 6737 |
| 3127 | AAAGUCAC CUGAUGAG GCCGUUAGGC CGAA IAUUUUAA | 13801 | TTAAAATC T GTGACTTT | 6738 |
| 3133 | CAAGCCAA CUGAUGAG GCCGUUAGGC CGAA IUCACAGA | 13802 | TCTGTGAC T TTGGCTTG | 6739 |
| 3139 | CCGGGCCA CUGAUGAG GCCGUUAGGC CGAA ICCAAAGU | 13803 | ACTTTGGC T TGGCCCGG | 6740 |
| 3144 | AUAUCCCG CUGAUGAG GCCGUUAGGC CGAA ICCAAGCC | 13804 | GGCTTGGC C CGGGATAT | 6741 |
| 3145 | AAUAUCCC CUGAUGAG GCCGUUAGGC CGAA IGCCAAGC | 13805 | GCTTGGCC C GGGATATT | 6742 |
| 3164 | CAUAAUCU CUGAUGAG GCCGUUAGGC CGAA IAUCUUUA | 13806 | TAAAGATC C AGATTATG | 6743 |
| 3165 | ACAUAAUC CUGAUGAG GCCGUUAGGC CGAA IGAUCUUU | 13807 | AAAGATCC A GATTATGT | 6744 |
| 3175 | UCCUUUUC CUGAUGAG GCCGUUAGGC CGAA IACAUAAU | 13808 | ATTATGTC A GAAAAGGA | 6745 |
| 3189 | GGGAGGCG CUGAUGAG GCCGUUAGGC CGAA ICAUCUCC | 13809 | GGAGATGC T CGCCTCCC | 6746 |
| 3193 | CAAAGGGA CUGAUGAG GCCGUUAGGC CGAA ICGAGCAU | 13810 | ATGCTCGC C TCCCTTTG | 6747 |
| 3194 | UCAAAGGG CUGAUGAG GCCGUUAGGC CGAA IGCGAGCA | 13811 | TGCTCGCC T CCCTTTGA | 6748 |
| 3196 | UUUCAAAG CUGAUGAG GCCGUUAGGC CGAA IAGGCGAG | 13812 | CTCGCCTC C CTTTGAAA | 6749 |
| 3197 | AUUUCAAA CUGAUGAG GCCGUUAGGC CGAA IGAGGCGA | 13813 | TCGCCTCC C TTTGAAAT | 6750 |
| 3198 | CAUUUCAA CUGAUGAG GCCGUUAGGC CGAA IGGAGGCG | 13814 | CGCCTCCC T TTGAAATG | 6751 |
| 3213 | GUUUCUGG CUGAUGAG GCCGUUAGGC CGAA ICCAUCCA | 13815 | TGGATGGC C CCAGAAAC | 6752 |
| 3214 | UGUUUCUG CUGAUGAG GCCGUUAGGC CGAA IGCCAUCC | 13816 | GGATGGCC C CAGAAACA | 6753 |
| 3215 | UUGUUUCU CUGAUGAG GCCGUUAGGC CGAA IGGCCAUC | 13817 | GATGGCCC C AGAAACAA | 6754 |
| 3216 | AUUGUUUC CUGAUGAG GCCGUUAGGC CGAA IGGGCCAU | 13818 | ATGGCCCC A GAAACAAT | 6755 |
| 3222 | UCAAAAAU CUGAUGAG GCCGUUAGGC CGAA IUUUCUGG | 13819 | CCAGAAAC A ATTTTTGA | 6756 |
| 3232 | GUACACUC CUGAUGAG GCCGUUAGGC CGAA IUCAAAAA | 13820 | TTTTTGAC A GAGTGTAC | 6757 |
| 3241 | CUGGAUUG CUGAUGAG GCCGUUAGGC CGAA IUACACUC | 13821 | GAGTGTAC A CAATCCAG | 6758 |
| 3243 | CUCUGGAU CUGAUGAG GCCGUUAGGC CGAA IUGUACAC | 13822 | GTGTACAC A ATCCAGAG | 6759 |
| 3247 | GUCACUCU CUGAUGAG GCCGUUAGGC CGAA IAUUGUGU | 13823 | ACACAATC C AGAGTGAC | 6760 |
| 3248 | CGUCACUC CUGAUGAG GCCGUUAGGC CGAA IGAUUGUG | 13824 | CACAATCC A GAGTGACG | 6761 |
| 3259 | AAAAGACC CUGAUGAG GCCGUUAGGC CGAA IACGUCAC | 13825 | GTGACGTC T GGTCTTTT | 6762 |
| 3264 | ACACCAAA CUGAUGAG GCCGUUAGGC CGAA IACCAGAC | 13826 | GTCTGGTC T TTTGGTGT | 6763 |
| 3278 | UUUCCCAC CUGAUGAG GCCGUUAGGC CGAA ICAAAACA | 13827 | TGTTTTGC T GTGGGAAA | 6764 |
| 3294 | GCACCUAA CUGAUGAG GCCGUUAGGC CGAA IAAAAUAU | 13828 | ATATTTTC C TTAGGTGC | 6765 |
| 3295 | AGCACCUA CUGAUGAG GCCGUUAGGC CGAA IGAAAAUA | 13829 | TATTTTCC T TAGGTGCT | 6766 |
| 3303 | UAUGGAGA CUGAUGAG GCCGUUAGGC CGAA ICACCUAA | 13830 | TTAGGTGC T TCTCCATA | 6767 |

| | | | | |
|---|---|---|---|---|
| 3306 | GGAUAUGG CUGAUGAG GCCGUUAGGC CGAA IAAGCACC | 13831 | GGTGCTTC T CCATATCC | 6768 |
| 3308 | CAGGAUAU CUGAUGAG GCCGUUAGGC CGAA IAGAAGCA | 13832 | TGCTTCTC C ATATCCTG | 6769 |
| 3309 | CCAGGAUA CUGAUGAG GCCGUUAGGC CGAA IGAGAAGC | 13833 | GCTTCTCC A TATCCTGG | 6770 |
| 3314 | UUACCCCA CUGAUGAG GCCGUUAGGC CGAA IAUAUGGA | 13834 | TCCATATC C TGGGGTAA | 6771 |
| 3315 | UUUACCCC CUGAUGAG GCCGUUAGGC CGAA IGAUAUGG | 13835 | CCATATCC T GGGGTAAA | 6772 |
| 3363 | CUCAUUCU CUGAUGAG GCCGUUAGGC CGAA IUUCCUUC | 13836 | GAAGGAAC T AGAATGAG | 6773 |
| 3375 | UAAUCAGG CUGAUGAG GCCGUUAGGC CGAA ICCCUCAU | 13837 | ATGAGGGC C CCTGATTA | 6774 |
| 3376 | AUAAUCAG CUGAUGAG GCCGUUAGGC CGAA IGCCCUCA | 13838 | TGAGGGCC C CTGATTAT | 6775 |
| 3377 | UAUAAUCA CUGAUGAG GCCGUUAGGC CGAA IGGCCCUC | 13839 | GAGGGCCC C TGATTATA | 6776 |
| 3378 | GUAUAAUC CUGAUGAG GCCGUUAGGC CGAA IGGGCCCU | 13840 | AGGGCCCC T GATTATAC | 6777 |
| 3387 | UCUGGUGU CUGAUGAG GCCGUUAGGC CGAA IUAUAAUC | 13841 | GATTATAC T ACACCAGA | 6778 |
| 3390 | AUUUCUGG CUGAUGAG GCCGUUAGGC CGAA IUAGUAUA | 13842 | TATACTAC A CCAGAAAT | 6779 |
| 3392 | ACAUUUCU CUGAUGAG GCCGUUAGGC CGAA IUGUAGUA | 13843 | TACTACAC C AGAAATGT | 6780 |
| 3393 | UACAUUUC CUGAUGAG GCCGUUAGGC CGAA IGUGUAGU | 13844 | ACTACACC A GAAATGTA | 6781 |
| 3403 | CAUGGUCU CUGAUGAG GCCGUUAGGC CGAA IUACAUUU | 13845 | AAATGTAC C AGACCATG | 6782 |
| 3404 | GCAUGGUC CUGAUGAG GCCGUUAGGC CGAA IGUACAUU | 13846 | AATGTACC A GACCATGC | 6783 |
| 3408 | UCCAGCAU CUGAUGAG GCCGUUAGGC CGAA IUCUGGUA | 13847 | TACCAGAC C ATGCTGGA | 6784 |
| 3409 | GUCCAGCA CUGAUGAG GCCGUUAGGC CGAA IGUCUGGU | 13848 | ACCAGACC A TGCTGGAC | 6785 |
| 3413 | AGCAGUCC CUGAUGAG GCCGUUAGGC CGAA ICAUGGUC | 13849 | GACCATGC T GGACTGCT | 6786 |
| 3418 | GUGCCAGC CUGAUGAG GCCGUUAGGC CGAA IUCCAGCA | 11949 | TGCTGGAC T GCTGGCAC | 4886 |
| 3421 | CCCGUGCC CUGAUGAG GCCGUUAGGC CGAA ICAGUCCA | 13850 | TGGACTGC T GGCACGGG | 6787 |
| 3425 | GCUCCCCG CUGAUGAG GCCGUUAGGC CGAA ICCAGCAG | 13851 | CTGCTGGC A CGGGGAGC | 6788 |
| 3434 | UCUGACUG CUGAUGAG GCCGUUAGGC CGAA ICUCCCCG | 13852 | CGGGGAGC C CAGTCAGA | 6789 |
| 3435 | CUCUGACU CUGAUGAG GCCGUUAGGC CGAA IGCUCCCC | 13853 | GGGGAGCC C AGTCAGAG | 6790 |
| 3436 | UCUCUGAC CUGAUGAG GCCGUUAGGC CGAA IGGCUCCC | 13854 | GGGAGCCC A GTCAGAGA | 6791 |
| 3440 | UGGGUCUC CUGAUGAG GCCGUUAGGC CGAA IACUGGGC | 13855 | GCCCAGTC A GAGACCCA | 6792 |
| 3446 | AAAACGUG CUGAUGAG GCCGUUAGGC CGAA IUCUCUGA | 13856 | TCAGAGAC C CACGTTTT | 6793 |
| 3447 | GAAAACGU CUGAUGAG GCCGUUAGGC CGAA IGUCUCUG | 13857 | CAGAGACC C ACGTTTTC | 6794 |
| 3448 | UGAAAACG CUGAUGAG GCCGUUAGGC CGAA IGGUCUCU | 13858 | AGAGACCC A CGTTTTCA | 6795 |
| 3456 | ACCAACUC CUGAUGAG GCCGUUAGGC CGAA IAAAACGU | 13859 | ACGTTTTC A GAGTTGGT | 6796 |
| 3470 | UUCCCAAA CUGAUGAG GCCGUUAGGC CGAA IUUCCACC | 13860 | GGTGGAAC A TTTGGGAA | 6797 |
| 3482 | CUUGCAAG CUGAUGAG GCCGUUAGGC CGAA IAUUUCCC | 13861 | GGGAAATC T CTTGCAAG | 6798 |
| 3484 | AGCUUGCA CUGAUGAG GCCGUUAGGC CGAA IAGAUUUC | 13862 | GAAATCTC T TGCAAGCT | 6799 |

285

| | | | | |
|---|---|---|---|---|
| 3488 | CAUUAGCU CUGAUGAG GCCGUUAGGC CGAA ICAAGAGA | 13863 | TCTCTTGC A AGCTAATG | 6800 |
| 3492 | UGAGCAUU CUGAUGAG GCCGUUAGGC CGAA ICUUGCAA | 13864 | TTGCAAGC T AATGCTCA | 6801 |
| 3498 | UCCUGCUG CUGAUGAG GCCGUUAGGC CGAA ICAUUAGC | 13865 | GCTAATGC T CAGCAGGA | 6802 |
| 3500 | CAUCCUGC CUGAUGAG GCCGUUAGGC CGAA IAGCAUUA | 13866 | TAATGCTC A GCAGGATG | 6803 |
| 3503 | UGCCAUCC CUGAUGAG GCCGUUAGGC CGAA ICUGAGCA | 13867 | TGCTCAGC A GGATGGCA | 6804 |
| 3511 | GUAGUCUU CUGAUGAG GCCGUUAGGC CGAA ICCAUCCU | 13868 | AGGATGGC A AAGACTAC | 6805 |
| 3517 | AACAAUGU CUGAUGAG GCCGUUAGGC CGAA IUCUUUGC | 13869 | GCAAAGAC T ACATTGTT | 6806 |
| 3520 | AAGAACAA CUGAUGAG GCCGUUAGGC CGAA IUAGUCUU | 13870 | AAGACTAC A TTGTTCTT | 6807 |
| 3527 | AUAUCGGA CUGAUGAG GCCGUUAGGC CGAA IAACAAUG | 13871 | CATTGTTC T TCCGATAT | 6808 |
| 3530 | CUGAUAUC CUGAUGAG GCCGUUAGGC CGAA IAAGAACA | 13872 | TGTTCTTC C GATATCAG | 6809 |
| 3537 | AAAGUCUC CUGAUGAG GCCGUUAGGC CGAA IAUAUCGG | 13873 | CCGATATC A GAGACTTT | 6810 |
| 3543 | AUGCUCAA CUGAUGAG GCCGUUAGGC CGAA IUCUCUGA | 13874 | TCAGAGAC T TTGAGCAT | 6811 |
| 3550 | CUCUUCCA CUGAUGAG GCCGUUAGGC CGAA ICUCAAAG | 13875 | CTTTGAGC A TGGAAGAG | 6812 |
| 3564 | GAGAGUCC CUGAUGAG GCCGUUAGGC CGAA IAAUCCUC | 13876 | GAGGATTC T GGACTCTC | 6813 |
| 3569 | GCAGAGAG CUGAUGAG GCCGUUAGGC CGAA IUCCAGAA | 13877 | TTCTGGAC T CTCTCTGC | 6814 |
| 3571 | AGGCAGAG CUGAUGAG GCCGUUAGGC CGAA IAGUCCAG | 13878 | CTGGACTC T CTCTGCCT | 6815 |
| 3573 | GUAGGCAG CUGAUGAG GCCGUUAGGC CGAA IAGAGUCC | 13879 | GGACTCTC T CTGCCTAC | 6816 |
| 3575 | AGGUAGGC CUGAUGAG GCCGUUAGGC CGAA IAGAGAGU | 13880 | ACTCTCTC T GCCTACCT | 6817 |
| 3578 | GUGAGGUA CUGAUGAG GCCGUUAGGC CGAA ICAGAGAG | 13881 | CTCTCTGC C TACCTCAC | 6818 |
| 3579 | GGUGAGGU CUGAUGAG GCCGUUAGGC CGAA IGCAGAGA | 13882 | TCTCTGCC T ACCTCACC | 6819 |
| 3582 | ACAGGUGA CUGAUGAG GCCGUUAGGC CGAA IUAGGCAG | 13883 | CTGCCTAC C TCACCTGT | 6820 |
| 3583 | AACAGGUG CUGAUGAG GCCGUUAGGC CGAA IGUAGGCA | 13884 | TGCCTACC T CACCTGTT | 6821 |
| 3585 | GAAACAGG CUGAUGAG GCCGUUAGGC CGAA IAGGUAGG | 13885 | CCTACCTC A CCTGTTTC | 6822 |
| 3587 | AGGAAACA CUGAUGAG GCCGUUAGGC CGAA IUGAGGUA | 13886 | TACCTCAC C TGTTTCCT | 6823 |
| 3588 | CAGGAAAC CUGAUGAG GCCGUUAGGC CGAA IGUGAGGU | 13887 | ACCTCACC T GTTTCCTG | 6824 |
| 3594 | UCCAUACA CUGAUGAG GCCGUUAGGC CGAA IAAACAGG | 13888 | CCTGTTTC C TGTATGGA | 6825 |
| 3595 | CUCCAUAC CUGAUGAG GCCGUUAGGC CGAA IGAAACAG | 13889 | CTGTTTCC T GTATGGAG | 6826 |
| 3622 | GAAUUUGG CUGAUGAG GCCGUUAGGC CGAA IUCACAUA | 13890 | TATGTGAC C CCAAATTC | 6827 |
| 3623 | GGAAUUUG CUGAUGAG GCCGUUAGGC CGAA IGUCACAU | 13891 | ATGTGACC C CAAATTCC | 6828 |
| 3624 | UGGAAUUU CUGAUGAG GCCGUUAGGC CGAA IGGUCACA | 13892 | TGTGACCC C AAATTCCA | 6829 |
| 3625 | AUGGAAUU CUGAUGAG GCCGUUAGGC CGAA IGGGUCAC | 13893 | GTGACCCC A AATTCCAT | 6830 |
| 3631 | GUCAUAAU CUGAUGAG GCCGUUAGGC CGAA IAAUUUGG | 13894 | CCAAATTC C ATTATGAC | 6831 |
| 3632 | UGUCAUAA CUGAUGAG GCCGUUAGGC CGAA IGAAUUUG | 13895 | CAAATTCC A TTATGACA | 6832 |

| | | | | |
|---|---|---|---|---|
| 3640 | UGCUGUGU CUGAUGAG GCCGUUAGGC CGAA IUCAUAAU | 13896 | ATTATGAC A ACACAGCA | 6833 |
| 3643 | UCCUGCUG CUGAUGAG GCCGUUAGGC CGAA IUUGUCAU | 13897 | ATGACAAC A CAGCAGGA | 6834 |
| 3645 | AUUCCUGC CUGAUGAG GCCGUUAGGC CGAA IUGUUGUC | 13898 | GACAACAC A GCAGGAAT | 6835 |
| 3648 | CUGAUUCC CUGAUGAG GCCGUUAGGC CGAA ICUGUGUU | 13899 | AACACAGC A GGAATCAG | 6836 |
| 3655 | AUACUGAC CUGAUGAG GCCGUUAGGC CGAA IAUUCCUG | 13900 | CAGGAATC A GTCAGTAT | 6837 |
| 3659 | GCAGAUAC CUGAUGAG GCCGUUAGGC CGAA IACUGAUU | 13901 | AATCAGTC A GTATCTGC | 6838 |
| 3665 | UGUUCUGC CUGAUGAG GCCGUUAGGC CGAA IAUACUGA | 13902 | TCAGTATC T GCAGAACA | 6839 |
| 3668 | UACUGUUC CUGAUGAG GCCGUUAGGC CGAA ICAGAUAC | 13903 | GTATCTGC A GAACAGTA | 6840 |
| 3673 | UCGCUUAC CUGAUGAG GCCGUUAGGC CGAA IUUCUGCA | 13904 | TGCAGAAC A GTAAGCGA | 6841 |
| 3688 | CACAGGCC CUGAUGAG GCCGUUAGGC CGAA ICUCUUUC | 13905 | GAAAGAGC C GGCCTGTG | 6842 |
| 3692 | CACUCACA CUGAUGAG GCCGUUAGGC CGAA ICCGGCUC | 13906 | GAGCCGGC C TGTGAGTG | 6843 |
| 3693 | ACACUCAC CUGAUGAG GCCGUUAGGC CGAA IGCCGGCU | 13907 | AGCCGGCC T GTGAGTGT | 6844 |
| 3708 | UCUUCAAA CUGAUGAG GCCGUUAGGC CGAA IUUUUUAC | 13908 | GTAAAAAC A TTTGAAGA | 6845 |
| 3721 | UUCUAACG CUGAUGAG GCCGUUAGGC CGAA IAUAUCUU | 13909 | AAGATATC C CGTTAGAA | 6846 |
| 3722 | CUUCUAAC CUGAUGAG GCCGUUAGGC CGAA IGAUAUCU | 13910 | AGATATCC C GTTAGAAG | 6847 |
| 3734 | UUACUUCU CUGAUGAG GCCGUUAGGC CGAA IUUCUUCU | 13911 | AGAAGAAC C AGAAGTAA | 6848 |
| 3735 | UUUACUUC CUGAUGAG GCCGUUAGGC CGAA IGUUCUUC | 13912 | GAAGAACC A GAAGTAAA | 6849 |
| 3751 | GUCAUCUG CUGAUGAG GCCGUUAGGC CGAA IAUUACUU | 13913 | AAGTAATC C CAGATGAC | 6850 |
| 3752 | UGUCAUCU CUGAUGAG GCCGUUAGGC CGAA IGAUUACU | 13914 | AGTAATCC C AGATGACA | 6851 |
| 3753 | UUGUCAUC CUGAUGAG GCCGUUAGGC CGAA IGGAUUAC | 13915 | GTAATCCC A GATGACAA | 6852 |
| 3760 | CGUCUGGU CUGAUGAG GCCGUUAGGC CGAA IUCAUCUG | 13916 | CAGATGAC A ACCAGACG | 6853 |
| 3763 | GUCCGUCU CUGAUGAG GCCGUUAGGC CGAA IUUGUCAU | 13917 | ATGACAAC C AGACGGAC | 6854 |
| 3764 | UGUCCGUC CUGAUGAG GCCGUUAGGC CGAA IGUUGUCA | 13918 | TGACAACC A GACGGACA | 6855 |
| 3772 | CAUACCAC CUGAUGAG GCCGUUAGGC CGAA IUCCGUCU | 13919 | AGACGGAC A GTGGTATG | 6856 |
| 3785 | CUGAGGCA CUGAUGAG GCCGUUAGGC CGAA IAACCAUA | 13920 | TATGGTTC T TGCCTCAG | 6857 |
| 3789 | UCUUCUGA CUGAUGAG GCCGUUAGGC CGAA ICAAGAAC | 13921 | GTTCTTGC C TCAGAAGA | 6858 |
| 3790 | CUCUUCUG CUGAUGAG GCCGUUAGGC CGAA IGCAAGAA | 13922 | TTCTTGCC T CAGAAGAG | 6859 |
| 3792 | AGCUCUUC CUGAUGAG GCCGUUAGGC CGAA IAGGCAAG | 13923 | CTTGCCTC A GAAGAGCT | 6860 |
| 3800 | AAGUUUUC CUGAUGAG GCCGUUAGGC CGAA ICUCUUCU | 13924 | AGAAGAGC T GAAAACTT | 6861 |
| 3807 | UCUUCCAA CUGAUGAG GCCGUUAGGC CGAA IUUUUCAG | 13925 | CTGAAAAC T TTGGAAGA | 6862 |
| 3817 | UUUGGUUC CUGAUGAG GCCGUUAGGC CGAA IUCUUCCA | 13926 | TGGAAGAC A GAACCAAA | 6863 |
| 3822 | GAUAAUUU CUGAUGAG GCCGUUAGGC CGAA IUUCUGUC | 13927 | GACAGAAC C AAATTATC | 6864 |
| 3823 | AGAUAAUU CUGAUGAG GCCGUUAGGC CGAA IGUUCUGU | 13928 | ACAGAACC A AATTATCT | 6865 |

287

| | | | | |
|---|---|---|---|---|
| 3831 | AAAGAUGG CUGAUGAG GCCGUUAGGC CGAA IAUAAUUU | 13929 | AAATTATC T CCATCTTT | 6866 |
| 3833 | CAAAAGAU CUGAUGAG GCCGUUAGGC CGAA IAGAUAAU | 13930 | ATTATCTC C ATCTTTTG | 6867 |
| 3834 | CCAAAAGA CUGAUGAG GCCGUUAGGC CGAA IGAGAUAA | 13931 | TTATCTCC A TCTTTTGG | 6868 |
| 3837 | CCACCAAA CUGAUGAG GCCGUUAGGC CGAA IAUGGAGA | 13932 | TCTCCATC T TTTGGTGG | 6869 |
| 3854 | UUUUGCUG CUGAUGAG GCCGUUAGGC CGAA ICACCAUU | 13933 | AATGGTGC C CAGCAAAA | 6870 |
| 3855 | CUUUUGCU CUGAUGAG GCCGUUAGGC CGAA IGCACCAU | 13934 | ATGGTGCC C AGCAAAAG | 6871 |
| 3856 | GCUUUUGC CUGAUGAG GCCGUUAGGC CGAA IGGCACCA | 13935 | TGGTGCCC A GCAAAAGC | 6872 |
| 3859 | CCUGCUUU CUGAUGAG GCCGUUAGGC CGAA ICUGGGCA | 13936 | TGCCCAGC A AAAGCAGG | 6873 |
| 3865 | AGACUCCC CUGAUGAG GCCGUUAGGC CGAA ICUUUUGC | 13937 | GCAAAAGC A GGGAGTCT | 6874 |
| 3873 | GAUGCCAC CUGAUGAG GCCGUUAGGC CGAA IACUCCCU | 13938 | AGGGAGTC T GTGGCATC | 6875 |
| 3879 | CCUUCAGA CUGAUGAG GCCGUUAGGC CGAA ICCACAGA | 13939 | TCTGTGGC A TCTGAAGG | 6876 |
| 3882 | GAGCCUUC CUGAUGAG GCCGUUAGGC CGAA IAUGCCAC | 13940 | GTGGCATC T GAAGGCTC | 6877 |
| 3889 | CUGGUUUG CUGAUGAG GCCGUUAGGC CGAA ICCUUCAG | 13941 | CTGAAGGC T CAAACCAG | 6878 |
| 3891 | GUCUGGUU CUGAUGAG GCCGUUAGGC CGAA IAGCCUUC | 13942 | GAAGGCTC A AACCAGAC | 6879 |
| 3895 | GCUUGUCU CUGAUGAG GCCGUUAGGC CGAA IUUUGAGC | 13943 | GCTCAAAC C AGACAAGC | 6880 |
| 3896 | CGCUUGUC CUGAUGAG GCCGUUAGGC CGAA IGUUUGAG | 13944 | CTCAAACC A GACAAGCG | 6881 |
| 3900 | UAGCCGCU CUGAUGAG GCCGUUAGGC CGAA IUCUGGUU | 13945 | AACCAGAC A AGCGGCTA | 6882 |
| 3907 | GGACUGGU CUGAUGAG GCCGUUAGGC CGAA ICCGCUUG | 13946 | CAAGCGGC T ACCAGTCC | 6883 |
| 3910 | UCCGGACU CUGAUGAG GCCGUUAGGC CGAA IUAGCCGC | 13947 | GCGGCTAC C AGTCCGGA | 6884 |
| 3911 | AUCCGGAC CUGAUGAG GCCGUUAGGC CGAA IGUAGCCG | 13948 | CGGCTACC A GTCCGGAT | 6885 |
| 3915 | UGAUAUCC CUGAUGAG GCCGUUAGGC CGAA IACUGGUA | 13949 | TACCAGTC C GGATATCA | 6886 |
| 3923 | CAUCGGAG CUGAUGAG GCCGUUAGGC CGAA IAUAUCCG | 13950 | CGGATATC A CTCCGATG | 6887 |
| 3925 | GUCAUCGG CUGAUGAG GCCGUUAGGC CGAA IUGAUAUC | 13951 | GATATCAC T CCGATGAC | 6888 |
| 3927 | GUGUCAUC CUGAUGAG GCCGUUAGGC CGAA IAGUGAUA | 13952 | TATCACTC C GATGACAC | 6889 |
| 3934 | GGUGUCUG CUGAUGAG GCCGUUAGGC CGAA IUCAUCGG | 13953 | CCGATGAC A CAGACACC | 6890 |
| 3936 | GUGGUGUC CUGAUGAG GCCGUUAGGC CGAA IUGUCAUC | 13954 | GATGACAC A GACACCAC | 6891 |
| 3940 | CACGGUGG CUGAUGAG GCCGUUAGGC CGAA IUCUGUGU | 13955 | ACACAGAC A CCACCGTG | 6892 |
| 3942 | UACACGGU CUGAUGAG GCCGUUAGGC CGAA IUGUCUGU | 13956 | ACAGACAC C ACCGTGTA | 6893 |
| 3943 | GUACACGG CUGAUGAG GCCGUUAGGC CGAA IGUGUCUG | 13957 | CAGACACC A CCGTGTAC | 6894 |
| 3945 | GAGUACAC CUGAUGAG GCCGUUAGGC CGAA IUGGUGUC | 13958 | GACACCAC C GTGTACTC | 6895 |
| 3952 | CUCACUGG CUGAUGAG GCCGUUAGGC CGAA IUACACGG | 13959 | CCGTGTAC T CCAGTGAG | 6896 |
| 3954 | UCCUCACU CUGAUGAG GCCGUUAGGC CGAA IAGUACAC | 13960 | GTGTACTC C AGTGAGGA | 6897 |
| 3955 | UUCCUCAC CUGAUGAG GCCGUUAGGC CGAA IGAGUACA | 13961 | TGTACTCC A GTGAGGAA | 6898 |

| | | | | | |
|---|---|---|---|---|---|
| 3966 | AAAAGUUC CUGAUGAG GCCGUUAGGC CGAA ICUUCCUC | 13962 | GAGGAAGC A GAACTTTT | 6899 |
| 3971 | GCUUUAAA CUGAUGAG GCCGUUAGGC CGAA IUUCUGCU | 13963 | AGCAGAAC T TTTAAAGC | 6900 |
| 3980 | UCUCUAUC CUGAUGAG GCCGUUAGGC CGAA ICUUUAAA | 13964 | TTTAAAGC T GATAGAGA | 6901 |
| 3998 | UACCGGUU CUGAUGAG GCCGUUAGGC CGAA ICACUCCA | 13965 | TGGAGTGC A AACCGGTA | 6902 |
| 4002 | GUGCUACC CUGAUGAG GCCGUUAGGC CGAA IUUUGCAC | 13966 | GTGCAAAC C GGTAGCAC | 6903 |
| 4009 | CUGGGCUG CUGAUGAG GCCGUUAGGC CGAA ICUACCGG | 13967 | CCGGTAGC A CAGCCCAG | 6904 |
| 4011 | AUCUGGGC CUGAUGAG GCCGUUAGGC CGAA IUGCUACC | 13968 | GGTAGCAC A GCCCAGAT | 6905 |
| 4014 | AGAAUCUG CUGAUGAG GCCGUUAGGC CGAA ICUGUGCU | 13969 | AGCACAGC C CAGATTCT | 6906 |
| 4015 | GAGAAUCU CUGAUGAG GCCGUUAGGC CGAA IGCUGUGC | 13970 | GCACAGCC C AGATTCTC | 6907 |
| 4016 | GGAGAAUC CUGAUGAG GCCGUUAGGC CGAA IGGCUGUG | 13971 | CACAGCCC A GATTCTCC | 6908 |
| 4022 | CAGGCUGG CUGAUGAG GCCGUUAGGC CGAA IAAUCUGG | 13972 | CCAGATTC T CCAGCCTG | 6909 |
| 4024 | GUCAGGCU CUGAUGAG GCCGUUAGGC CGAA IAGAAUCU | 13973 | AGATTCTC C AGCCTGAC | 6910 |
| 4025 | UGUCAGGC CUGAUGAG GCCGUUAGGC CGAA IGAGAAUC | 13974 | GATTCTCC A GCCTGACA | 6911 |
| 4028 | CCGUGUCA CUGAUGAG GCCGUUAGGC CGAA ICUGGAGA | 13975 | TCTCCAGC C TGACACGG | 6912 |
| 4029 | CCCGUGUC CUGAUGAG GCCGUUAGGC CGAA IGCUGGAG | 13976 | CTCCAGCC T GACACGGG | 6913 |
| 4033 | GGUCCCCG CUGAUGAG GCCGUUAGGC CGAA IUCAGGCU | 13977 | AGCCTGAC A CGGGGACC | 6914 |
| 4041 | CUCAGUGU CUGAUGAG GCCGUUAGGC CGAA IUCCCCGU | 13978 | ACGGGGAC C ACACTGAG | 6915 |
| 4042 | GCUCAGUG CUGAUGAG GCCGUUAGGC CGAA IGUCCCCG | 13979 | CGGGGACC A CACTGAGC | 6916 |
| 4044 | GAGCUCAG CUGAUGAG GCCGUUAGGC CGAA IUGGUCCC | 13980 | GGGACCAC A CTGAGCTC | 6917 |
| 4046 | GAGAGCUC CUGAUGAG GCCGUUAGGC CGAA IUGUGGUC | 13981 | GACCACAC T GAGCTCTC | 6918 |
| 4051 | AGGAGGAG CUGAUGAG GCCGUUAGGC CGAA ICUCAGUG | 13982 | CACTGAGC T CTCCTCCT | 6919 |
| 4053 | ACAGGAGG CUGAUGAG GCCGUUAGGC CGAA IAGCUCAG | 13983 | CTGAGCTC T CCTCCTGT | 6920 |
| 4055 | AAACAGGA CUGAUGAG GCCGUUAGGC CGAA IAGAGCUC | 13984 | GAGCTCTC C TCCTGTTT | 6921 |
| 4056 | UAAACAGG CUGAUGAG GCCGUUAGGC CGAA IGAGAGCU | 13985 | AGCTCTCC T CCTGTTTA | 6922 |
| 4058 | UUUAAACA CUGAUGAG GCCGUUAGGC CGAA IAGGAGAG | 13986 | CTCTCCTC C TGTTTAAA | 6923 |
| 4059 | UUUUAAAC CUGAUGAG GCCGUUAGGC CGAA IGAGGAGA | 13987 | TCTCCTCC T GTTTAAAA | 6924 |
| 4074 | GGUGUGGA CUGAUGAG GCCGUUAGGC CGAA ICUUCCUU | 13988 | AAGGAAGC A TCCACACC | 6925 |
| 4077 | UGGGGUGU CUGAUGAG GCCGUUAGGC CGAA IAUGCUUC | 13989 | GAAGCATC C ACACCCCA | 6926 |
| 4078 | UUGGGGUG CUGAUGAG GCCGUUAGGC CGAA IGAUGCUU | 13990 | AAGCATCC A CACCCCAA | 6927 |
| 4080 | AGUUGGGG CUGAUGAG GCCGUUAGGC CGAA IUGGAUGC | 13991 | GCATCCAC A CCCCAACT | 6928 |
| 4082 | GGAGUUGG CUGAUGAG GCCGUUAGGC CGAA IUGUGGAU | 13992 | ATCCACAC C CCAACTCC | 6929 |
| 4083 | GGGAGUUG CUGAUGAG GCCGUUAGGC CGAA IGUGUGGA | 13993 | TCCACACC C CAACTCCC | 6930 |
| 4084 | CGGGAGUU CUGAUGAG GCCGUUAGGC CGAA IGGUGUGG | 13994 | CCACACCC C AACTCCCG | 6931 |

289

| | | | | |
|---|---|---|---|---|
| 4085 | CCGGGAGU CUGAUGAG GCCGUUAGGC CGAA IGGGUGUG | 13995 | CACACCCC A ACTCCCGG | 6932 |
| 4088 | UGUCCGGG CUGAUGAG GCCGUUAGGC CGAA IUUGGGGU | 13996 | ACCCCAAC T CCCGGACA | 6933 |
| 4090 | GAUGUCCG CUGAUGAG GCCGUUAGGC CGAA IAGUUGGG | 13997 | CCCAACTC C CGGACATC | 6934 |
| 4091 | UGAUGUCC CUGAUGAG GCCGUUAGGC CGAA IGAGUUGG | 13998 | CCAACTCC C GGACATCA | 6935 |
| 4096 | UCAUGUGA CUGAUGAG GCCGUUAGGC CGAA IUCCGGGA | 13999 | TCCCGGAC A TCACATGA | 6936 |
| 4099 | CUCUCAUG CUGAUGAG GCCGUUAGGC CGAA IAUGUCCG | 14000 | CGGACATC A CATGAGAG | 6937 |
| 4101 | ACCUCUCA CUGAUGAG GCCGUUAGGC CGAA IUGAUGUC | 14001 | GACATCAC A TGAGAGGT | 6938 |
| 4111 | AUCUGAGC CUGAUGAG GCCGUUAGGC CGAA IACCUCUC | 14002 | GAGAGGTC T GCTCAGAT | 6939 |
| 4114 | AAAAUCUG CUGAUGAG GCCGUUAGGC CGAA ICAGACCU | 14003 | AGGTCTGC T CAGATTTT | 6940 |
| 4116 | UCAAAAUC CUGAUGAG GCCGUUAGGC CGAA IAGCAGAC | 14004 | GTCTGCTC A GATTTTGA | 6941 |
| 4135 | UGGUGGAA CUGAUGAG GCCGUUAGGC CGAA IAACAACA | 14005 | TGTTGTTC T TTCCACCA | 6942 |
| 4139 | CUGCUGGU CUGAUGAG GCCGUUAGGC CGAA IAAAGAAC | 14006 | GTTCTTTC C ACCAGCAG | 6943 |
| 4140 | CCUGCUGG CUGAUGAG GCCGUUAGGC CGAA IGAAAGAA | 14007 | TTCTTTCC A CCAGCAGG | 6944 |
| 4142 | UUCCUGCU CUGAUGAG GCCGUUAGGC CGAA IUGGAAAG | 14008 | CTTTCCAC C AGCAGGAA | 6945 |
| 4143 | CUUCCUGC CUGAUGAG GCCGUUAGGC CGAA IGUGGAAA | 14009 | TTTCCACC A GCAGGAAG | 6946 |
| 4146 | CUACUUCC CUGAUGAG GCCGUUAGGC CGAA ICUGGUGG | 14010 | CCACCAGC A GGAAGTAG | 6947 |
| 4156 | UCAAAUGC CUGAUGAG GCCGUUAGGC CGAA ICUACUUC | 14011 | GAAGTAGC C GCATTTGA | 6948 |
| 4159 | AAAUCAAA CUGAUGAG GCCGUUAGGC CGAA ICGGCUAC | 14012 | GTAGCCGC A TTTGATTT | 6949 |
| 4170 | UGUCGAAA CUGAUGAG GCCGUUAGGC CGAA IAAAAUCA | 14013 | TGATTTTC A TTTCGACA | 6950 |
| 4178 | UUUUCUGU CUGAUGAG GCCGUUAGGC CGAA IUCGAAAU | 14014 | ATTTCGAC A ACAGAAAA | 6951 |
| 4181 | CCUUUUUC CUGAUGAG GCCGUUAGGC CGAA IUUGUCGA | 14015 | TCGACAAC A GAAAAAGG | 6952 |
| 4192 | CAGUCCGA CUGAUGAG GCCGUUAGGC CGAA IUCCUUUU | 14016 | AAAAGGAC C TCGGACTG | 6953 |
| 4193 | GCAGUCCG CUGAUGAG GCCGUUAGGC CGAA IGUCCUUU | 14017 | AAAGGACC T CGGACTGC | 6954 |
| 4199 | CUCCCUGC CUGAUGAG GCCGUUAGGC CGAA IUCCGAGG | 14018 | CCTCGGAC T GCAGGGAG | 6955 |
| 4202 | UGGCUCCC CUGAUGAG GCCGUUAGGC CGAA ICAGUCCG | 14019 | CGGACTGC A GGGAGCCA | 6956 |
| 4209 | GAAGAGCU CUGAUGAG GCCGUUAGGC CGAA ICUCCCUG | 14020 | CAGGGAGC C AGCTCTTC | 6957 |
| 4210 | AGAAGAGC CUGAUGAG GCCGUUAGGC CGAA IGCUCCCU | 14021 | AGGGAGCC A GCTCTTCT | 6958 |
| 4213 | CCUAGAAG CUGAUGAG GCCGUUAGGC CGAA ICUGGCUC | 14022 | GAGCCAGC T CTTCTAGG | 6959 |
| 4215 | AGCCUAGA CUGAUGAG GCCGUUAGGC CGAA IAGCUGGC | 14023 | GCCAGCTC T TCTAGGCT | 6960 |
| 4218 | ACAAGCCU CUGAUGAG GCCGUUAGGC CGAA IAAGAGCU | 14024 | AGCTCTTC T AGGCTTGT | 6961 |

290

Table XVII: KDR G-Cleaver Ribozyme and Target Sequences 237.198

| nt. Position | Ribozyme Sequence | Seq. ID. Nos | Target | Seq. ID Nos |
|---|---|---|---|---|
| 12 | GCCAG UGAUG GCAUGCACUAUGC GCG AGCACCUUGC | 14025 | GCAAGGTGCT G CTGGC | 6962 |
| 22 | CAGGG UGAUG GCAUGCACUAUGC GCG GACGGCCAGC | 14026 | GCTGGCCGTC G CCCTG | 6963 |
| 35 | CCACG UGAUG GCAUGCACUAUGC GCG AGAGCCACAG | 14027 | CTGTGGCTCT G CGTGG | 6964 |
| 52 | AGAGG UGAUG GCAUGCACUAUGC GCG GGCCCGGGUC | 14028 | GACCCGGGCC G CCTCT | 6965 |
| 66 | CUAGG UGAUG GCAUGCACUAUGC GCG AAACCCACAG | 14029 | CTGTGGGTTT G CCTAG | 6966 |
| 82 | CAGAU UGAUG GCAUGCACUAUGC GCG AAGAGAAACA | 14030 | TGTTTCTCTT G ATCTG | 6967 |
| 87 | CUGGG UGAUG GCAUGCACUAUGC GCG AGAUCAAGAG | 14031 | CTCTTGATCT G CCCAG | 6968 |
| 152 | CCCUG UGAUG GCAUGCACUAUGC GCG AAGUAAUUUG | 14032 | CAAATTACTT G CAGGG | 6969 |
| 205 | UUGCU UGAUG GCAUGCACUAUGC GCG ACUGCCACUC | 14033 | GAGTGGCAGT G AGCAA | 6970 |
| 222 | UCAGU UGAUG GCAUGCACUAUGC GCG ACCUCCACCC | 14034 | GGGTGGAGGT G ACTGA | 6971 |
| 226 | GCACU UGAUG GCAUGCACUAUGC GCG AGUCACCUCC | 14035 | GGAGGTGACT G AGTGC | 6972 |
| 230 | CGCUG UGAUG GCAUGCACUAUGC GCG ACUCAGUCAC | 14036 | GTGACTGAGT G CAGCG | 6973 |
| 235 | GCCAU UGAUG GCAUGCACUAUGC GCG GCUGCACUCA | 14037 | TGAGTGCAGC G ATGGC | 6974 |
| 273 | CCGAU UGAUG GCAUGCACUAUGC GCG ACUUUUGGAA | 14038 | TTCCAAAAGT G ATCGG | 6975 |
| 283 | AGUGU UGAUG GCAUGCACUAUGC GCG AUUUCCGAUC | 14039 | GATCGGAAAT G ACACT | 6976 |
| 302 | AGAAG UGAUG GCAUGCACUAUGC GCG ACUUGUAGGC | 14040 | GCCTACAAGT G CTTCT | 6977 |
| 319 | CAAGU UGAUG GCAUGCACUAUGC GCG AGUUUCCCGG | 14041 | CCGGGAAACT G ACTTG | 6978 |
| 373 | AGAAG UGAUG GCAUGCACUAUGC GCG AAUAAAUGGA | 14042 | TCCATTTATT G CTTCT | 6979 |
| 385 | UUGGU UGAUG GCAUGCACUAUGC GCG ACUAACAGAA | 14043 | TTCTGTTAGT G ACCAA | 6980 |
| 412 | GUUCU UGAUG GCAUGCACUAUGC GCG AGUAAUGUAC | 14044 | GTACATTACT G AGAAC | 6981 |
| 435 | GGAAU UGAUG GCAUGCACUAUGC GCG ACCACAGUUU | 14045 | AAACTGTGGT G ATTCC | 6982 |
| 481 | UCUUG UGAUG GCAUGCACUAUGC GCG ACAAAGUGAC | 14046 | GTCACTTTGT G CAAGA | 6983 |
| 511 | ACCAU UGAUG GCAUGCACUAUGC GCG AGGAACAAAU | 14047 | ATTTGTTCCT G ATGGT | 6984 |
| 567 | CUGAU UGAUG GCAUGCACUAUGC GCG AUGUAGCUGG | 14048 | CCAGCTACAT G ATCAG | 6985 |
| 577 | GCCAG UGAUG GCAUGCACUAUGC GCG AUAGCUGAUC | 14049 | GATCAGCTAT G CTGGC | 6986 |
| 595 | UGCUU UGAUG GCAUGCACUAUGC GCG ACAGAAGACC | 14050 | GGTCTTCTGT G AAGCA | 6987 |
| 610 | UUCAU UGAUG GCAUGCACUAUGC GCG AUUAAUUUUU | 14051 | AAAAATTAAT G ATGAA | 6988 |
| 613 | ACUUU UGAUG GCAUGCACUAUGC GCG AUCAUUAAUU | 14052 | AATTAATGAT G AAAGT | 6989 |
| 667 | CACAU UGAUG GCAUGCACUAUGC GCG AUAAAUCCUA | 14053 | TAGGATTTAT G ATGTG | 6990 |

291

| | | | | |
|---|---|---|---|---|
| 678 | GGACU UGAUG GCAUGCACUAUGC GCG AGAACCACAU | 14054 | ATGTGGTTCT G AGTCC | 6991 |
| 697 | UAGUU UGAUG GCAUGCACUAUGC GCG AAUUCCAUGA | 14055 | TCATGGAATT G AACTA | 6992 |
| 745 | UAGUU UGAUG GCAUGCACUAUGC GCG AGUUCUUGCU | 14056 | AGCAAGAACT G AACTA | 6993 |
| 763 | GAAGU UGAUG GCAUGCACUAUGC GCG AAUCCCCACA | 14057 | TGTGGGGATT G ACTTC | 6994 |
| 789 | UGCUU UGAUG GCAUGCACUAUGC GCG GAAGAAGGGU | 14058 | ACCCTTCTTC G AAGCA | 6995 |
| 818 | GGUCU UGAUG GCAUGCACUAUGC GCG GGUUUACAAG | 14059 | CTTGTAAACC G AGACC | 6996 |
| 844 | CAUCU UGAUG GCAUGCACUAUGC GCG ACUCCCAGAC | 14060 | GTCTGGGAGT G AGATG | 6997 |
| 849 | UUCUU UGAUG GCAUGCACUAUGC GCG AUCUCACUCC | 14061 | GGAGTGAGAT G AAGAA | 6998 |
| 861 | GUGCU UGAUG GCAUGCACUAUGC GCG AAAAAUUUCU | 14062 | AGAAATTTTT G AGCAC | 6999 |
| 895 | UUGGU UGAUG GCAUGCACUAUGC GCG ACUCCGGGUU | 14063 | AACCCGGAGT G ACCAA | 7000 |
| 916 | UGCUG UGAUG GCAUGCACUAUGC GCG ACAGGUGUAC | 14064 | GTACACCTGT G CAGCA | 7001 |
| 933 | GUCAU UGAUG GCAUGCACUAUGC GCG AGCCCACUGG | 14065 | CCAGTGGGCT G ATGAC | 7002 |
| 936 | UUGGU UGAUG GCAUGCACUAUGC GCG AUCAGCCCAC | 14066 | GTGGGCTGAT G ACCAA | 7003 |
| 970 | UUUUU UGAUG GCAUGCACUAUGC GCG AUGGACCCUG | 14067 | CAGGGTCCAT G AAAAA | 7004 |
| 985 | AAAAG UGAUG GCAUGCACUAUGC GCG AACAAAAGGU | 14068 | ACCTTTTGTT G CTTTT | 7005 |
| 1048 | CUUCG UGAUG GCAUGCACUAUGC GCG AGGGAUUCUG | 14069 | CAGAATCCCT G CGAAG | 7006 |
| 1050 | UACUU UGAUG GCAUGCACUAUGC GCG GCAGGGAUUC | 14070 | GAATCCCTGC G AAGTA | 7007 |
| 1108 | GGACU UGAUG GCAUGCACUAUGC GCG AAGGGGUAUU | 14071 | AATACCCCTT G AGTCC | 7008 |
| 1143 | AUCGU UGAUG GCAUGCACUAUGC GCG AGUACAUGCC | 14072 | GGCATGTACT G ACGAT | 7009 |
| 1146 | AUAAU UGAUG GCAUGCACUAUGC GCG GUCAGUACAU | 14073 | ATGTACTGAC G ATTAT | 7010 |
| 1158 | UCACU UGAUG GCAUGCACUAUGC GCG ACUUCCAUAA | 14074 | TTATGGAAGT G AGTGA | 7011 |
| 1162 | UCUUU UGAUG GCAUGCACUAUGC GCG ACUCACUUCC | 14075 | GGAAGTGAGT G AAAGA | 7012 |
| 1267 | UUUCU UGAUG GCAUGCACUAUGC GCG ACCAAUCUGG | 14076 | CCAGATTGGT G AGAAA | 7013 |
| 1320 | GUCAG UGAUG GCAUGCACUAUGC GCG GUUUGAGUGG | 14077 | CCACTCAAAC G CTGAC | 7014 |
| 1323 | CAUGU UGAUG GCAUGCACUAUGC GCG AGCGUUUGAG | 14078 | CTCAAACGCT G ACATG | 7015 |
| 1339 | AAUGG UGAUG GCAUGCACUAUGC GCG AUAGACCGUA | 14079 | TACGGTCTAT G CCATT | 7016 |
| 1353 | UGAUG UGAUG GCAUGCACUAUGC GCG GGGGGAGGAA | 14080 | TTCCTCCCCC G CATCA | 7017 |
| 1391 | UGGCG UGAUG GCAUGCACUAUGC GCG ACUCUUCCUC | 14081 | GAGGAAGAGT G CGCCA | 7018 |
| 1393 | GUUGG UGAUG GCAUGCACUAUGC GCG GCACUCUUCC | 14082 | GGAAGAGTGC G CCAAC | 7019 |
| 1399 | GGGCU UGAUG GCAUGCACUAUGC GCG GUUGGCGCAC | 14083 | GTGCGCCAAC G AGCCC | 7020 |
| 1422 | UUUGU UGAUG GCAUGCACUAUGC GCG ACUGAGACAG | 14084 | CTGTCTCAGT G ACAAA | 7021 |
| 1441 | UUCUU UGAUG GCAUGCACUAUGC GCG ACAAGGGUAU | 14085 | ATACCCTTGT G AAGAA | 7022 |
| 1486 | AACUU UGAUG GCAUGCACUAUGC GCG AAUUUUAUUU | 14086 | AAATAAAATT G AAGTT | 7023 |

292

| | | | | |
|---|---|---|---|---|
| 1507 | UAGAG UGAUG GCAUGCACUAUGC GCG AAAUUGAUUU | 14087 | AAATCAATTT G CTCTA | 7024 |
| 1516 | UCCUU UGAUG GCAUGCACUAUGC GCG AAUUAGAGCA | 14088 | TGCTCTAATT G AAGGA | 7025 |
| 1585 | CGCUU UGAUG GCAUGCACUAUGC GCG ACAUUUGUAC | 14089 | GTACAAATGT G AAGCG | 7026 |
| 1620 | GAGAU UGAUG GCAUGCACUAUGC GCG ACCCUCUCUC | 14090 | GAGAGAGGGT G ATCTC | 7027 |
| 1635 | CUGGU UGAUG GCAUGCACUAUGC GCG ACGUGGAAGG | 14091 | CCTTCCACGT G ACCAG | 7028 |
| 1648 | AAUUU UGAUG GCAUGCACUAUGC GCG AGGACCCCUG | 14092 | CAGGGGTCCT G AAATT | 7029 |
| 1659 | GGUUG UGAUG GCAUGCACUAUGC GCG AAAGUAAUUU | 14093 | AAATTACTTT G CAACC | 7030 |
| 1666 | CAUGU UGAUG GCAUGCACUAUGC GCG AGGUUGCAAA | 14094 | TTTGCAACCT G ACATG | 7031 |
| 1671 | GGCUG UGAUG GCAUGCACUAUGC GCG AUGUCAGGUU | 14095 | AACCTGACAT G CAGCC | 7032 |
| 1681 | CUGCU UGAUG GCAUGCACUAUGC GCG AGUGGGCUGC | 14096 | GCAGCCCACT G AGCAG | 7033 |
| 1706 | CAGUG UGAUG GCAUGCACUAUGC GCG ACCACAAAGA | 14097 | TCTTTGTGGT G CACTG | 7034 |
| 1711 | GUCUG UGAUG GCAUGCACUAUGC GCG AGUGCACCAC | 14098 | GTGGTGCACT G CAGAC | 7035 |
| 1729 | GUUCU UGAUG GCAUGCACUAUGC GCG AAACGUAGAU | 14099 | ATCTACGTTT G AGAAC | 7036 |
| 1767 | AUUGG UGAUG GCAUGCACUAUGC GCG AGAGGCUGUG | 14100 | CACAGCCTCT G CCAAT | 7037 |
| 1788 | GUGGG UGAUG GCAUGCACUAUGC GCG AACUCUCCCA | 14101 | TGGGAGAGTT G CCCAC | 7038 |
| 1802 | UCUUG UGAUG GCAUGCACUAUGC GCG AAACAGGUGU | 14102 | ACACCTGTTT G CAAGA | 7039 |
| 1830 | GCAUU UGAUG GCAUGCACUAUGC GCG AAUUUCCAAA | 14103 | TTTGGAAATT G AATGC | 7040 |
| 1834 | GGUGG UGAUG GCAUGCACUAUGC GCG AUUCAAUUUC | 14104 | GAAATTGAAT G CCACC | 7041 |
| 1861 | AAUGU UGAUG GCAUGCACUAUGC GCG AUUUGUGCUA | 14105 | TAGCACAAAT G ACATT | 7042 |
| 1869 | AUGAU UGAUG GCAUGCACUAUGC GCG AAAAUGUCAU | 14106 | ATGACATTTT G ATCAT | 7043 |
| 1888 | GGAUG UGAUG GCAUGCACUAUGC GCG AUUCUUAAGC | 14107 | GCTTAAGAAT G CATCC | 7044 |
| 1896 | UCCUG UGAUG GCAUGCACUAUGC GCG AAGGAUGCAU | 14108 | ATGCATCCTT G CAGGA | 7045 |
| 1919 | CAAGG UGAUG GCAUGCACUAUGC GCG AGACAUAGUC | 14109 | GACTATGTCT G CCTTG | 7046 |
| 1924 | UUGAG UGAUG GCAUGCACUAUGC GCG AAGGCAGACA | 14110 | TGTCTGCCTT G CTCAA | 7047 |
| 1955 | CCACG UGAUG GCAUGCACUAUGC GCG AAUGUCUUUU | 14111 | AAAAGACATT G CGTGG | 7048 |
| 1998 | GUGAU UGAUG GCAUGCACUAUGC GCG GUGGGUGCCA | 14112 | TGGCACCCAC G ATCAC | 7049 |
| 2025 | CUUGU UGAUG GCAUGCACUAUGC GCG GUCUGAUUCU | 14113 | AGAATCAGAC G ACAAG | 7050 |
| 2047 | GACUU UGAUG GCAUGCACUAUGC GCG GAUGCUUUCC | 14114 | GGAAAGCATC G AAGTC | 7051 |
| 2057 | CCGUG UGAUG GCAUGCACUAUGC GCG AUGAGACUUC | 14115 | GAAGTCTCAT G CACGG | 7052 |
| 2107 | GGUCU UGAUG GCAUGCACUAUGC GCG AUUAUCUUUA | 14116 | TAAAGATAAT G AGACC | 7053 |
| 2139 | UCCUU UGAUG GCAUGCACUAUGC GCG AAUACAAUGC | 14117 | GCATTGTATT G AAGGA | 7054 |
| 2168 | CUCUG UGAUG GCAUGCACUAUGC GCG GGAUAGUGAG | 14118 | CTCACTATCC G CAGAG | 7055 |
| 2175 | UUCCU UGAUG GCAUGCACUAUGC GCG ACUCUGCGGA | 14119 | TCCGCAGAGT G AGGAA | 7056 |

| | | | | |
|---|---|---|---|---|
| 2188 | GCCUU UGAUG GCAUGCACUAUGC GCG GUCCUCCUUC | 14120 | GAAGGAGGAC G AAGGC | 7057 |
| 2204 | CCUGG UGAUG GCAUGCACUAUGC GCG AGGUGUAGAG | 14121 | CTCTACACCT G CCAGG | 7058 |
| 2213 | CACUG UGAUG GCAUGCACUAUGC GCG AUGCCUGGCA | 14122 | TGCCAGGCAT G CAGTG | 7059 |
| 2230 | UUUUG UGAUG GCAUGCACUAUGC GCG ACAGCCAAGA | 14123 | TCTTGGCTGT G CAAAA | 7060 |
| 2263 | CUGGG UGAUG GCAUGCACUAUGC GCG ACCUUCUAUU | 14124 | AATAGAAGGT G CCCAG | 7061 |
| 2277 | AAGUU UGAUG GCAUGCACUAUGC GCG GUCUUUUCCU | 14125 | AGGAAAAGAC G AACTT | 7062 |
| 2307 | ACCGU UGAUG GCAUGCACUAUGC GCG GUGCCUACUA | 14126 | TAGTAGGCAC G ACGGT | 7063 |
| 2313 | GCAAU UGAUG GCAUGCACUAUGC GCG ACCGUCGUGC | 14127 | GCACGACGGT G ATTGC | 7064 |
| 2317 | CAUGG UGAUG GCAUGCACUAUGC GCG AAUCACCGUC | 14128 | GACGGTGATT G CCATG | 7065 |
| 2385 | GUCUU UGAUG GCAUGCACUAUGC GCG AGUUCCCCUC | 14129 | GAGGGGAACT G AAGAC | 7066 |
| 2422 | GAGUU UGAUG GCAUGCACUAUGC GCG AUCUGGAUCC | 14130 | GGATCCAGAT G AACTC | 7067 |
| 2437 | AUGUU UGAUG GCAUGCACUAUGC GCG AUCCAAUGGG | 14131 | CCCATTGGAT G AACAT | 7068 |
| 2446 | UCGUU UGAUG GCAUGCACUAUGC GCG ACAAUGUUCA | 14132 | TGAACATTGT G AACGA | 7069 |
| 2450 | GCAGU UGAUG GCAUGCACUAUGC GCG GUUCACAAUG | 14133 | CATTGTGAAC G ACTGC | 7070 |
| 2454 | UAAGG UGAUG GCAUGCACUAUGC GCG AGUCGUUCAC | 14134 | GTGAACGACT G CCTTA | 7071 |
| 2461 | GGCAU UGAUG GCAUGCACUAUGC GCG AUAAGGCAGU | 14135 | ACTGCCTTAT G ATGCC | 7072 |
| 2464 | GCUGG UGAUG GCAUGCACUAUGC GCG AUCAUAAGGC | 14136 | GCCTTATGAT G CCAGC | 7073 |
| 2496 | AGGUU UGAUG GCAUGCACUAUGC GCG AGCCGGUCUC | 14137 | GAGACCGGCT G AACCT | 7074 |
| 2524 | AAAGG UGAUG GCAUGCACUAUGC GCG ACCACGGCCA | 14138 | TGGCCGTGGT G CCTTT | 7075 |
| 2542 | UGCUU UGAUG GCAUGCACUAUGC GCG AAUCUCUUGG | 14139 | CCAAGAGATT G AAGCA | 7076 |
| 2551 | AAAGG UGAUG GCAUGCACUAUGC GCG AUCUGCUUCA | 14140 | TGAAGCAGAT G CCTTT | 7077 |
| 2563 | CUUGU UGAUG GCAUGCACUAUGC GCG AAUUCCAAAG | 14141 | CTTTGGAATT G ACAAG | 7078 |
| 2579 | UCCUG UGAUG GCAUGCACUAUGC GCG AAGUUGCUGU | 14142 | ACAGCAACTT G CAGGA | 7079 |
| 2604 | UCUUU UGAUG GCAUGCACUAUGC GCG AACAUUUUGA | 14143 | TCAAAATGTT G AAAGA | 7080 |
| 2626 | AUGCU UGAUG GCAUGCACUAUGC GCG ACUGUGUGUU | 14144 | AACACACAGT G AGCAT | 7081 |
| 2633 | GAGCU UGAUG GCAUGCACUAUGC GCG GAUGCUCACU | 14145 | AGTGAGCATC G AGCTC | 7082 |
| 2647 | GAGUU UGAUG GCAUGCACUAUGC GCG AGACAUGAGA | 14146 | TCTCATGTCT G AACTC | 7083 |
| 2704 | ACAGG UGAUG GCAUGCACUAUGC GCG ACCUAGAAGG | 14147 | CCTTCTAGGT G CCTGT | 7084 |
| 2736 | ACAAU UGAUG GCAUGCACUAUGC GCG ACCAUGAGUG | 14148 | CACTCATGGT G ATTGT | 7085 |
| 2750 | AUUUG UGAUG GCAUGCACUAUGC GCG AGAAUUCCAC | 14149 | GTGGAATTCT G CAAAT | 7086 |
| 2778 | CUCCU UGAUG GCAUGCACUAUGC GCG AGGUAAGUGG | 14150 | CCACTTACCT G AGGAG | 7087 |
| 2794 | AAAUU UGAUG GCAUGCACUAUGC GCG AUUUCUCUUG | 14151 | CAAGAGAAAT G AATTT | 7088 |
| 2825 | GGAAU UGAUG GCAUGCACUAUGC GCG GUGCCCCUUU | 14152 | AAAGGGGCAC G ATTCC | 7089 |

294

| | | | | |
|---|---|---|---|---|
| 2871 | CGUUU UGAUG GCAUGCACUAUGC GCG AGAUCCACAG | 14153 | CTGTGGATCT G AAACG | 7090 |
| 2879 | CCAAG UGAUG GCAUGCACUAUGC GCG GCCGUUUCAG | 14154 | CTGAAACGGC G CTTGG | 7091 |
| 2947 | UACAU UGAUG GCAUGCACUAUGC GCG ACUGAGGGAC | 14155 | GTCCCTCAGT G ATGTA | 7092 |
| 2971 | AUCUU UGAUG GCAUGCACUAUGC GCG AGGAGCUUCC | 14156 | GGAAGCTCCT G AAGAT | 7093 |
| 2994 | AAGGU UGAUG GCAUGCACUAUGC GCG AGGAAGUCCU | 14157 | AGGACTTCCT G ACCTT | 7094 |
| 3057 | UUUCG UGAUG GCAUGCACUAUGC GCG GAUGCCAAGA | 14158 | TCTTGGCATC G CGAAA | 7095 |
| 3059 | ACUUU UGAUG GCAUGCACUAUGC GCG GCGAUGCCAA | 14159 | TTGGCATCGC G AAAGT | 7096 |
| 3089 | UAUUU UGAUG GCAUGCACUAUGC GCG GUGCCGCCAG | 14160 | CTGGCGGCAC G AAATA | 7097 |
| 3130 | AAAGU UGAUG GCAUGCACUAUGC GCG ACAGAUUUUA | 14161 | TAAAATCTGT G ACTTT | 7098 |
| 3187 | GCGAG UGAUG GCAUGCACUAUGC GCG AUCUCCUUUU | 14162 | AAAAGGAGAT G CTCGC | 7099 |
| 3191 | GGAGG UGAUG GCAUGCACUAUGC GCG GAGCAUCUCC | 14163 | GGAGATGCTC G CCTCC | 7100 |
| 3201 | CAUUU UGAUG GCAUGCACUAUGC GCG AAAGGGAGGC | 14164 | GCCTCCCTTT G AAATG | 7101 |
| 3229 | UCUGU UGAUG GCAUGCACUAUGC GCG AAAAAUUGUU | 14165 | AACAATTTTT G ACAGA | 7102 |
| 3253 | GACGU UGAUG GCAUGCACUAUGC GCG ACUCUGGAUU | 14166 | AATCCAGAGT G ACGTC | 7103 |
| 3276 | CACAG UGAUG GCAUGCACUAUGC GCG AAAACACCAA | 14167 | TTGGTGTTTT G CTGTG | 7104 |
| 3301 | AGAAG UGAUG GCAUGCACUAUGC GCG ACCUAAGGAA | 14168 | TTCCTTAGGT G CTTCT | 7105 |
| 3328 | UUCAU UGAUG GCAUGCACUAUGC GCG AAUCUUUACC | 14169 | GGTAAAGATT G ATGAA | 7106 |
| 3331 | UUCUU UGAUG GCAUGCACUAUGC GCG AUCAAUCUUU | 14170 | AAAGATTGAT G AAGAA | 7107 |
| 3347 | UCAAU UGAUG GCAUGCACUAUGC GCG GCCUACAAAA | 14171 | TTTTGTAGGC G ATTGA | 7108 |
| 3351 | UCUUU UGAUG GCAUGCACUAUGC GCG AAUCGCCUAC | 14172 | GTAGGCGATT G AAAGA | 7109 |
| 3369 | GCCCU UGAUG GCAUGCACUAUGC GCG AUUCUAGUUC | 14173 | GAACTAGAAT G AGGGC | 7110 |
| 3379 | AUAAU UGAUG GCAUGCACUAUGC GCG AGGGGCCCUC | 14174 | GAGGGCCCCT G ATTAT | 7111 |
| 3411 | UCCAG UGAUG GCAUGCACUAUGC GCG AUGGUCUGGU | 14175 | ACCAGACCAT G CTGGA | 7112 |
| 3419 | GCCAG UGAUG GCAUGCACUAUGC GCG AGUCCAGCAU | 12935 | ATGCTGGACT G CTGGC | 5872 |
| 3486 | GCUUG UGAUG GCAUGCACUAUGC GCG AAGAGAUUUC | 14176 | GAAATCTCTT G CAAGC | 7113 |
| 3496 | CUGAG UGAUG GCAUGCACUAUGC GCG AUUAGCUUGC | 14177 | GCAAGCTAAT G CTCAG | 7114 |
| 3531 | GAUAU UGAUG GCAUGCACUAUGC GCG GGAAGAACAA | 14178 | TTGTTCTTCC G ATATC | 7115 |
| 3546 | AUGCU UGAUG GCAUGCACUAUGC GCG AAAGUCUCUG | 14179 | CAGAGACTTT G AGCAT | 7116 |
| 3576 | GUAGG UGAUG GCAUGCACUAUGC GCG AGAGAGAGUC | 14180 | GACTCTCTCT G CCTAC | 7117 |
| 3619 | GGGGU UGAUG GCAUGCACUAUGC GCG ACAUACUUCC | 14181 | GGAAGTATGT G ACCCC | 7118 |
| 3637 | GUUGU UGAUG GCAUGCACUAUGC GCG AUAAUGGAAU | 14182 | ATTCCATTAT G ACAAC | 7119 |
| 3666 | UUCUG UGAUG GCAUGCACUAUGC GCG AGAUACUGAC | 14183 | GTCAGTATCT G CAGAA | 7120 |
| 3680 | UCUUU UGAUG GCAUGCACUAUGC GCG GCUUACUGUU | 14184 | AACAGTAAGC G AAAGA | 7121 |

295

| | | | | |
|---|---|---|---|---|
| 3696 | ACACU UGAUG GCAUGCACUAUGC GCG ACAGGCCGGC | 14185 | GCCGGCCTGT G AGTGT | 7122 |
| 3712 | AUCUU UGAUG GCAUGCACUAUGC GCG AAAUGUUUUU | 14186 | AAAAACATTT G AAGAT | 7123 |
| 3757 | GUUGU UGAUG GCAUGCACUAUGC GCG AUCUGGGAUU | 14187 | AATCCCAGAT G ACAAC | 7124 |
| 3787 | UGAGG UGAUG GCAUGCACUAUGC GCG AAGAACCAUA | 14188 | TATGGTTCTT G CCTCA | 7125 |
| 3801 | GUUUU UGAUG GCAUGCACUAUGC GCG AGCUCUUCUG | 14189 | CAGAAGAGCT G AAAAC | 7126 |
| 3852 | CUGGG UGAUG GCAUGCACUAUGC GCG ACCAUUCCAC | 14190 | GTGGAATGGT G CCCAG | 7127 |
| 3883 | GCCUU UGAUG GCAUGCACUAUGC GCG AGAUGCCACA | 14191 | TGTGGCATCT G AAGGC | 7128 |
| 3928 | GUCAU UGAUG GCAUGCACUAUGC GCG GGAGUGAUAU | 14192 | ATATCACTCC G ATGAC | 7129 |
| 3931 | UGUGU UGAUG GCAUGCACUAUGC GCG AUCGGAGUGA | 14193 | TCACTCCGAT G ACACA | 7130 |
| 3958 | UUCCU UGAUG GCAUGCACUAUGC GCG ACUGGAGUAC | 14194 | GTACTCCAGT G AGGAA | 7131 |
| 3981 | UCUAU UGAUG GCAUGCACUAUGC GCG AGCUUUAAAA | 14195 | TTTTAAAGCT G ATAGA | 7132 |
| 3996 | GUUUG UGAUG GCAUGCACUAUGC GCG ACUCCAAUCU | 14196 | AGATTGGAGT G CAAAC | 7133 |
| 4030 | CGUGU UGAUG GCAUGCACUAUGC GCG AGGCUGGAGA | 14197 | TCTCCAGCCT G ACACG | 7134 |
| 4047 | GAGCU UGAUG GCAUGCACUAUGC GCG AGUGUGGUCC | 14198 | GGACCACACT G AGCTC | 7135 |
| 4103 | CCUCU UGAUG GCAUGCACUAUGC GCG AUGUGAUGUC | 14199 | GACATCACAT G AGAGG | 7136 |
| 4112 | CUGAG UGAUG GCAUGCACUAUGC GCG AGACCUCUCA | 14200 | TGAGAGGTCT G CTCAG | 7137 |
| 4123 | CACUU UGAUG GCAUGCACUAUGC GCG AAAAUCUGAG | 14201 | CTCAGATTTT G AAGTG | 7138 |
| 4157 | AAAUG UGAUG GCAUGCACUAUGC GCG GGCUACUUCC | 14202 | GGAAGTAGCC G CATTT | 7139 |
| 4163 | AAAAU UGAUG GCAUGCACUAUGC GCG AAAUGCGGCU | 14203 | AGCCGCATTT G ATTTT | 7140 |
| 4175 | GUUGU UGAUG GCAUGCACUAUGC GCG GAAAUGAAAA | 14204 | TTTTCATTTC G ACAAC | 7141 |
| 4200 | CCCUG UGAUG GCAUGCACUAUGC GCG AGUCCGAGGU | 14205 | ACCTCGGACT G CAGGG | 7142 |

Other embodiments are within the following claims.

SEQUENCE LISTING (14225 sequences)

SEQ ID NO: 1 - RNA, 17 nt, Homo sapiens
cggacacuccucucggc

SEQ ID NO: 2 - RNA, 17 nt, Homo sapiens
acacuccucucggcucc

SEQ ID NO: 3 - RNA, 17 nt, Homo sapiens
acuccucucggcuccuc

SEQ ID NO: 4 - RNA, 17 nt, Homo sapiens
ucucggcuccuccccgg

SEQ ID NO: 5 - RNA, 17 nt, Homo sapiens
cggcuccuccccggcag

SEQ ID NO: 6 - RNA, 17 nt, Homo sapiens
cggcggcucggagcggg

SEQ ID NO: 7 - RNA, 17 nt, Homo sapiens
agcgggcuccggggcuc

SEQ ID NO: 8 - RNA, 17 nt, Homo sapiens
ccggggcucgggugcag

SEQ ID NO: 9 - RNA, 17 nt, Homo sapiens
gcgaggauuacccgggg

SEQ ID NO: 10 - RNA, 17 nt, Homo sapiens
cgaggauuacccgggga

SEQ ID NO: 11 - RNA, 17 nt, Homo sapiens
gaagugguugucuccug

SEQ ID NO: 12 - RNA, 17 nt, Homo sapiens
gugguugucuccuggcu

SEQ ID NO: 13 - RNA, 17 nt, Homo sapiens
gguugucuccuggcugg

SEQ ID NO: 14 - RNA, 17 nt, Homo sapiens
cgggcgcucagggcgcg

SEQ ID NO: 15 - RNA, 17 nt, Homo sapiens
gacggacucuggcggcc

SEQ ID NO: 16 - RNA, 17 nt, Homo sapiens
ggccgggucguuggccg

SEQ ID NO: 17 - RNA, 17 nt, Homo sapiens
cgggucguuggccgggg

SEQ ID NO: 18 - RNA, 17 nt, Homo sapiens
ggccgcgucgcgcucac

SEQ ID NO: 19 - RNA, 17 nt, Homo sapiens
gucgcgcucaccauggu

SEQ ID NO: 20 - RNA, 17 nt, Homo sapiens
accauggucagcuacug

SEQ ID NO: 21 - RNA, 17 nt, Homo sapiens
ggucagcuacugggaca

SEQ ID NO: 22 - RNA, 17 nt, Homo sapiens
accgggguccugcugug

SEQ ID NO: 23 - RNA, 17 nt, Homo sapiens
gcgcugcucagcugucu

SEQ ID NO: 24 - RNA, 17 nt, Homo sapiens
ucagcugucugcuucuc

SEQ ID NO: 25 - RNA, 17 nt, Homo sapiens
ugucugcuucucacagg

SEQ ID NO: 26 - RNA, 17 nt, Homo sapiens
gucugcuucucacagga

SEQ ID NO: 27 - RNA, 17 nt, Homo sapiens
cugcuucucacaggauc

SEQ ID NO: 28 - RNA, 17 nt, Homo sapiens
cacaggaucuaguucag

SEQ ID NO: 29 - RNA, 17 nt, Homo sapiens
caggaucuaguucaggu

SEQ ID NO: 30 - RNA, 17 nt, Homo sapiens
gaucuaguucagguuca

SEQ ID NO: 31 - RNA, 17 nt, Homo sapiens
aucuaguucagguucaa

SEQ ID NO: 32 - RNA, 17 nt, Homo sapiens
guucagguucaaaauua

SEQ ID NO: 33 - RNA, 17 nt, Homo sapiens
uucagguucaaaauuaa

SEQ ID NO: 34 - RNA, 17 nt, Homo sapiens
uucaaaauuaaaagauc

SEQ ID NO: 35 - RNA, 17 nt, Homo sapiens
ucaaaauuaaaagaucc

SEQ ID NO: 36 - RNA, 17 nt, Homo sapiens
uaaaagauccugaacug

SEQ ID NO: 37 - RNA, 17 nt, Homo sapiens
aacugaguuuaaaaggc

SEQ ID NO: 38 - RNA, 17 nt, Homo sapiens
acugaguuuaaaaggca

SEQ ID NO: 39 - RNA, 17 nt, Homo sapiens
cugaguuuaaaaggcac

SEQ ID NO: 40 - RNA, 17 nt, Homo sapiens
cagcacaucaugcaagc

SEQ ID NO: 41 - RNA, 17 nt, Homo sapiens
cacugcaucuccaaugc

SEQ ID NO: 42 - RNA, 17 nt, Homo sapiens
cugcaucuccaaugcag

SEQ ID NO: 43 - RNA, 17 nt, Homo sapiens
cagcccauaaauggucu

SEQ ID NO: 44 - RNA, 17 nt, Homo sapiens
uaaauggucuuugccug

SEQ ID NO: 45 - RNA, 17 nt, Homo sapiens
aauggucuuugccugaa

SEQ ID NO: 46 - RNA, 17 nt, Homo sapiens
auggucuuugccugaaa

SEQ ID NO: 47 - RNA, 17 nt, Homo sapiens
uggugaguaaggaaagc

SEQ ID NO: 48 - RNA, 17 nt, Homo sapiens
cugagcauaacuaaauc

SEQ ID NO: 49 - RNA, 17 nt, Homo sapiens
gcauaacuaaaucugcc

SEQ ID NO: 50 - RNA, 17 nt, Homo sapiens
aacuaaaucugccugug

SEQ ID NO: 51 - RNA, 17 nt, Homo sapiens
caaacaauucugcagua

SEQ ID NO: 52 - RNA, 17 nt, Homo sapiens
aaacaauucugcaguac

SEQ ID NO: 53 - RNA, 17 nt, Homo sapiens
ucugcaguacuuuaacc

SEQ ID NO: 54 - RNA, 17 nt, Homo sapiens
gcaguacuuuaaccuug

SEQ ID NO: 55 - RNA, 17 nt, Homo sapiens
caguacuuuaaccuuga

SEQ ID NO: 56 - RNA, 17 nt, Homo sapiens
aguacuuuaaccuugaa

SEQ ID NO: 57 - RNA, 17 nt, Homo sapiens
uuuaaccuugaacacag

SEQ ID NO: 58 - RNA, 17 nt, Homo sapiens
acacagcucaagcaaac

SEQ ID NO: 59 - RNA, 17 nt, Homo sapiens
cacuggcuucuacagcu

SEQ ID NO: 60 - RNA, 17 nt, Homo sapiens
acuggcuucuacagcug

SEQ ID NO: 61 - RNA, 17 nt, Homo sapiens
uggcuucuacagcugca

SEQ ID NO: 62 - RNA, 17 nt, Homo sapiens
cugcaaauaucuagcug

SEQ ID NO: 63 - RNA, 17 nt, Homo sapiens
gcaaauaucuagcugua

SEQ ID NO: 64 - RNA, 17 nt, Homo sapiens
aaauaucuagcuguacc

SEQ ID NO: 65 - RNA, 17 nt, Homo sapiens
cuagcuguaccuacuuc

SEQ ID NO: 66 - RNA, 17 nt, Homo sapiens
cuguaccuacuucaaag

SEQ ID NO: 67 - RNA, 17 nt, Homo sapiens
uaccuacuucaaagaag

SEQ ID NO: 68 - RNA, 17 nt, Homo sapiens
accuacuucaaagaaga

SEQ ID NO: 69 - RNA, 17 nt, Homo sapiens
aacagaaucugcaaucu

SEQ ID NO: 70 - RNA, 17 nt, Homo sapiens
ucugcaaucuauauauu

SEQ ID NO: 71 - RNA, 17 nt, Homo sapiens
ugcaaucuauauauuua

SEQ ID NO: 72 - RNA, 17 nt, Homo sapiens
caaucuauauauuuauu

SEQ ID NO: 73 - RNA, 17 nt, Homo sapiens
aucuauauauuuauuag

SEQ ID NO: 74 - RNA, 17 nt, Homo sapiens
cuauauauuuauuagug

SEQ ID NO: 75 - RNA, 17 nt, Homo sapiens
uauauauuuauuaguga

SEQ ID NO: 76 - RNA, 17 nt, Homo sapiens
auauauuuauuagugau

SEQ ID NO: 77 - RNA, 17 nt, Homo sapiens
auauuuauuagugauac

SEQ ID NO: 78 - RNA, 17 nt, Homo sapiens
uauuuauuagugauaca

SEQ ID NO: 79 - RNA, 17 nt, Homo sapiens
uuagugauacagguaga

SEQ ID NO: 80 - RNA, 17 nt, Homo sapiens
auacagguagaccuuuc

SEQ ID NO: 81 - RNA, 17 nt, Homo sapiens
guagaccuuucguagag

SEQ ID NO: 82 - RNA, 17 nt, Homo sapiens
uagaccuuucguagaga

SEQ ID NO: 83 - RNA, 17 nt, Homo sapiens
agaccuuucguagagau

SEQ ID NO: 84 - RNA, 17 nt, Homo sapiens
ccuuucguagagaugua

SEQ ID NO: 85 - RNA, 17 nt, Homo sapiens
agagauguacagugaaa

SEQ ID NO: 86 - RNA, 17 nt, Homo sapiens
agugaaauccccgaaau

SEQ ID NO: 87 - RNA, 17 nt, Homo sapiens
cccgaaauuauacacau

SEQ ID NO: 88 - RNA, 17 nt, Homo sapiens
ccgaaauuauacacaug

SEQ ID NO: 89 - RNA, 17 nt, Homo sapiens
gaaauuauacacaugac

SEQ ID NO: 90 - RNA, 17 nt, Homo sapiens
agggagcucgucauucc

SEQ ID NO: 91 - RNA, 17 nt, Homo sapiens
gagcucgucauucccug

SEQ ID NO: 92 - RNA, 17 nt, Homo sapiens
cucgucauucccugccg

SEQ ID NO: 93 - RNA, 17 nt, Homo sapiens
ucgucauucccugccgg

SEQ ID NO: 94 - RNA, 17 nt, Homo sapiens
ugccggguuacgucacc

SEQ ID NO: 95 - RNA, 17 nt, Homo sapiens
gccggguuacgucaccu

SEQ ID NO: 96 - RNA, 17 nt, Homo sapiens
gguuacgucaccuaaca

SEQ ID NO: 97 - RNA, 17 nt, Homo sapiens
cgucaccuaacaucacu

SEQ ID NO: 98 - RNA, 17 nt, Homo sapiens
ccuaacaucacuguuac

SEQ ID NO: 99 - RNA, 17 nt, Homo sapiens
aucacuguuacuuuaaa

SEQ ID NO: 100 - RNA, 17 nt, Homo sapiens
ucacuguuacuuuaaaa

SEQ ID NO: 101 - RNA, 17 nt, Homo sapiens
cuguuacuuuaaaaaag

SEQ ID NO: 102 - RNA, 17 nt, Homo sapiens
uguuacuuuaaaaaagu

SEQ ID NO: 103 - RNA, 17 nt, Homo sapiens
guuacuuuaaaaaaguu

SEQ ID NO: 104 - RNA, 17 nt, Homo sapiens
aaaaaaguuuccacuug

SEQ ID NO: 105 - RNA, 17 nt, Homo sapiens
aaaaaguuuccacuuga

SEQ ID NO: 106 - RNA, 17 nt, Homo sapiens
aaaaguuuccacuugac

SEQ ID NO: 107 - RNA, 17 nt, Homo sapiens
uuuccacuugacacuuu

SEQ ID NO: 108 - RNA, 17 nt, Homo sapiens
uugacacuuugaucccu

SEQ ID NO: 109 - RNA, 17 nt, Homo sapiens
ugacacuuugaucccug

SEQ ID NO: 110 - RNA, 17 nt, Homo sapiens
acuuugaucccugaugg

SEQ ID NO: 111 - RNA, 17 nt, Homo sapiens
aaacgcauaaucuggga

SEQ ID NO: 112 - RNA, 17 nt, Homo sapiens
cgcauaaucugggacag

SEQ ID NO: 113 - RNA, 17 nt, Homo sapiens
gggacaguagaaagggc

SEQ ID NO: 114 - RNA, 17 nt, Homo sapiens
aaagggcuucaucauau

SEQ ID NO: 115 - RNA, 17 nt, Homo sapiens
aagggcuucaucauauc

SEQ ID NO: 116 - RNA, 17 nt, Homo sapiens
ggcuucaucauaucaaa

SEQ ID NO: 117 - RNA, 17 nt, Homo sapiens
uucaucauaucaaaugc

SEQ ID NO: 118 - RNA, 17 nt, Homo sapiens
caucauaucaaaugcaa

SEQ ID NO: 119 - RNA, 17 nt, Homo sapiens
ugcaacguacaaagaaa

SEQ ID NO: 120 - RNA, 17 nt, Homo sapiens
aaagaaauagggcuucu

SEQ ID NO: 121 - RNA, 17 nt, Homo sapiens
auagggcuucugaccug

SEQ ID NO: 122 - RNA, 17 nt, Homo sapiens
uagggcuucugaccugu

SEQ ID NO: 123 - RNA, 17 nt, Homo sapiens
gcaacagucaaugggca

SEQ ID NO: 124 - RNA, 17 nt, Homo sapiens
augggcauuuguauaag

SEQ ID NO: 125 - RNA, 17 nt, Homo sapiens
ugggcauuuguauaaga

SEQ ID NO: 126 - RNA, 17 nt, Homo sapiens
gcauuuguauaagacaa

SEQ ID NO: 127 - RNA, 17 nt, Homo sapiens
auuuguauaagacaaac

SEQ ID NO: 128 - RNA, 17 nt, Homo sapiens
gacaaacuaucucacac

SEQ ID NO: 129 - RNA, 17 nt, Homo sapiens
caaacuaucucacacau

SEQ ID NO: 130 - RNA, 17 nt, Homo sapiens
aacuaucucacacaucg

SEQ ID NO: 131 - RNA, 17 nt, Homo sapiens
ucacacaucgacaaacc

SEQ ID NO: 132 - RNA, 17 nt, Homo sapiens
aaaccaauacaaucaua

SEQ ID NO: 133 - RNA, 17 nt, Homo sapiens
aauacaaucauagaugu

SEQ ID NO: 134 - RNA, 17 nt, Homo sapiens
acaaucauagaugucca

SEQ ID NO: 135 - RNA, 17 nt, Homo sapiens
auagauguccaaauaag

SEQ ID NO: 136 - RNA, 17 nt, Homo sapiens
guccaaauaagcacacc

SEQ ID NO: 137 - RNA, 17 nt, Homo sapiens
cgcccagucaaauuacu

SEQ ID NO: 138 - RNA, 17 nt, Homo sapiens
agucaaauuacuuagag

SEQ ID NO: 139 - RNA, 17 nt, Homo sapiens
gucaaauuacuuagagg

SEQ ID NO: 140 - RNA, 17 nt, Homo sapiens
aaauuacuuagaggcca

SEQ ID NO: 141 - RNA, 17 nt, Homo sapiens
aauuacuuagaggccau

SEQ ID NO: 142 - RNA, 17 nt, Homo sapiens
gaggccauacucuuguc

SEQ ID NO: 143 - RNA, 17 nt, Homo sapiens
gccauacucuuguccuc

SEQ ID NO: 144 - RNA, 17 nt, Homo sapiens
cauacucuuguccucaa

SEQ ID NO: 145 - RNA, 17 nt, Homo sapiens
acucuuguccucaauug

SEQ ID NO: 146 - RNA, 17 nt, Homo sapiens
cuuguccucaauuguac

SEQ ID NO: 147 - RNA, 17 nt, Homo sapiens
uccucaauuguacugcu

SEQ ID NO: 148 - RNA, 17 nt, Homo sapiens
ucaauuguacugcuacc

SEQ ID NO: 149 - RNA, 17 nt, Homo sapiens
guacugcuaccacuccc

SEQ ID NO: 150 - RNA, 17 nt, Homo sapiens
cuaccacucccuugaac

SEQ ID NO: 151 - RNA, 17 nt, Homo sapiens
cacucccuugaacacga

SEQ ID NO: 152 - RNA, 17 nt, Homo sapiens
acgagaguucaaaugac

SEQ ID NO: 153 - RNA, 17 nt, Homo sapiens
cgagaguucaaaugacc

SEQ ID NO: 154 - RNA, 17 nt, Homo sapiens
ccuggaguuacccugau

SEQ ID NO: 155 - RNA, 17 nt, Homo sapiens
cuggaguuacccugaug

SEQ ID NO: 156 - RNA, 17 nt, Homo sapiens
aaaaaaauaagagagcu

SEQ ID NO: 157 - RNA, 17 nt, Homo sapiens
agagagcuuccguaagg

SEQ ID NO: 158 - RNA, 17 nt, Homo sapiens
gagagcuuccguaaggc

SEQ ID NO: 159 - RNA, 17 nt, Homo sapiens
gcuuccguaaggcgacg

SEQ ID NO: 160 - RNA, 17 nt, Homo sapiens
cgacgaauugaccaaag

SEQ ID NO: 161 - RNA, 17 nt, Homo sapiens
aaagcaauucccaugcc

SEQ ID NO: 162 - RNA, 17 nt, Homo sapiens
aagcaauucccaugcca

SEQ ID NO: 163 - RNA, 17 nt, Homo sapiens
gccaacauauucuacag

SEQ ID NO: 164 - RNA, 17 nt, Homo sapiens
caacauauucuacagug

SEQ ID NO: 165 - RNA, 17 nt, Homo sapiens
aacauauucuacagugu

SEQ ID NO: 166 - RNA, 17 nt, Homo sapiens
cauauucuacaguguuc

SEQ ID NO: 167 - RNA, 17 nt, Homo sapiens
uacaguguucuuacuau

SEQ ID NO: 168 - RNA, 17 nt, Homo sapiens
acaguguucuuacuauu

SEQ ID NO: 169 - RNA, 17 nt, Homo sapiens
aguguucuuacuauuga

SEQ ID NO: 170 - RNA, 17 nt, Homo sapiens
guguucuuacuauugac

SEQ ID NO: 171 - RNA, 17 nt, Homo sapiens
uucuuacuauugacaaa

SEQ ID NO: 172 - RNA, 17 nt, Homo sapiens
cuuacuauugacaaaau

SEQ ID NO: 173 - RNA, 17 nt, Homo sapiens
aaaggacuuuauacuug

SEQ ID NO: 174 - RNA, 17 nt, Homo sapiens
aaggacuuuauacuugu

SEQ ID NO: 175 - RNA, 17 nt, Homo sapiens
aggacuuuauacuuguc

SEQ ID NO: 176 - RNA, 17 nt, Homo sapiens
gacuuuauacuugucgu

SEQ ID NO: 177 - RNA, 17 nt, Homo sapiens
uuuauacuugucgugua

SEQ ID NO: 178 - RNA, 17 nt, Homo sapiens
auacuugucguguaagg

SEQ ID NO: 179 - RNA, 17 nt, Homo sapiens
ugucguguaaggagugg

SEQ ID NO: 180 - RNA, 17 nt, Homo sapiens
uggaccaucauucaaau

SEQ ID NO: 181 - RNA, 17 nt, Homo sapiens
accaucauucaaaucug

SEQ ID NO: 182 - RNA, 17 nt, Homo sapiens
ccaucauucaaaucugu

SEQ ID NO: 183 - RNA, 17 nt, Homo sapiens
auucaaaucuguuaaca

SEQ ID NO: 184 - RNA, 17 nt, Homo sapiens
aaaucuguuaacaccuc

SEQ ID NO: 185 - RNA, 17 nt, Homo sapiens
aaucuguuaacaccuca

SEQ ID NO: 186 - RNA, 17 nt, Homo sapiens
uaacaccucagugcaua

SEQ ID NO: 187 - RNA, 17 nt, Homo sapiens
cagugcauauauaugau

SEQ ID NO: 188 - RNA, 17 nt, Homo sapiens
gugcauauauaugauaa

SEQ ID NO: 189 - RNA, 17 nt, Homo sapiens
gcauauauaugauaaag

SEQ ID NO: 190 - RNA, 17 nt, Homo sapiens
uauaugauaaagcauuc

SEQ ID NO: 191 - RNA, 17 nt, Homo sapiens
uaaagcauucaucacug

SEQ ID NO: 192 - RNA, 17 nt, Homo sapiens
aaagcauucaucacugu

SEQ ID NO: 193 - RNA, 17 nt, Homo sapiens
gcauucaucacugugaa

SEQ ID NO: 194 - RNA, 17 nt, Homo sapiens
ugaaacaucgaaaacag

SEQ ID NO: 195 - RNA, 17 nt, Homo sapiens
caggugcuugaaaccgu

SEQ ID NO: 196 - RNA, 17 nt, Homo sapiens
gaaaccguagcuggcaa

SEQ ID NO: 197 - RNA, 17 nt, Homo sapiens
caagcggucuuaccggc

SEQ ID NO: 198 - RNA, 17 nt, Homo sapiens
agcggucuuaccggcuc

SEQ ID NO: 199 - RNA, 17 nt, Homo sapiens
gcggucuuaccggcucu

SEQ ID NO: 200 - RNA, 17 nt, Homo sapiens
uaccggcucucuaugaa

SEQ ID NO: 201 - RNA, 17 nt, Homo sapiens
ccggcucucuaugaaag

SEQ ID NO: 202 - RNA, 17 nt, Homo sapiens
ggcucucuaugaaagug

SEQ ID NO: 203 - RNA, 17 nt, Homo sapiens
gaaggcauuucccucgc

SEQ ID NO: 204 - RNA, 17 nt, Homo sapiens
aaggcauuucccucgcc

SEQ ID NO: 205 - RNA, 17 nt, Homo sapiens
aggcauuucccucgccg

SEQ ID NO: 206 - RNA, 17 nt, Homo sapiens
auuucccucgccggaag

SEQ ID NO: 207 - RNA, 17 nt, Homo sapiens
ccggaaguuguaugguu

SEQ ID NO: 208 - RNA, 17 nt, Homo sapiens
gaaguuguaugguuaaa

SEQ ID NO: 209 - RNA, 17 nt, Homo sapiens
uguaugguuaaaagaug

SEQ ID NO: 210 - RNA, 17 nt, Homo sapiens
guaugguuaaaagaugg

SEQ ID NO: 211 - RNA, 17 nt, Homo sapiens
agauggguuaccugcga

SEQ ID NO: 212 - RNA, 17 nt, Homo sapiens
gauggguuaccugcgac

SEQ ID NO: 213 - RNA, 17 nt, Homo sapiens
ugagaaaucugcucgcu

SEQ ID NO: 214 - RNA, 17 nt, Homo sapiens
aaucugcucgcuauuug

SEQ ID NO: 215 - RNA, 17 nt, Homo sapiens
ugcucgcuauuugacuc

SEQ ID NO: 216 - RNA, 17 nt, Homo sapiens
cucgcuauuugacucgu

SEQ ID NO: 217 - RNA, 17 nt, Homo sapiens
ucgcuauuugacucgug

SEQ ID NO: 218 - RNA, 17 nt, Homo sapiens
auuugacucguggcuac

SEQ ID NO: 219 - RNA, 17 nt, Homo sapiens
ucguggcuacucguuaa

SEQ ID NO: 220 - RNA, 17 nt, Homo sapiens
uggcuacucguuaauua

SEQ ID NO: 221 - RNA, 17 nt, Homo sapiens
cuacucguuaauuauca

SEQ ID NO: 222 - RNA, 17 nt, Homo sapiens
uacucguuaauuaucaa

SEQ ID NO: 223 - RNA, 17 nt, Homo sapiens
ucguuaauuaucaagga

SEQ ID NO: 224 - RNA, 17 nt, Homo sapiens
cguuaauuaucaaggac

SEQ ID NO: 225 - RNA, 17 nt, Homo sapiens
uuaauuaucaaggacgu

SEQ ID NO: 226 - RNA, 17 nt, Homo sapiens
aaggacguaacugaaga

SEQ ID NO: 227 - RNA, 17 nt, Homo sapiens
cagggaauuauacaauc

SEQ ID NO: 228 - RNA, 17 nt, Homo sapiens
agggaauuauacaaucu

SEQ ID NO: 229 - RNA, 17 nt, Homo sapiens
ggaauuauacaaucuug

SEQ ID NO: 230 - RNA, 17 nt, Homo sapiens
uauacaaucuugcugag

SEQ ID NO: 231 - RNA, 17 nt, Homo sapiens
uacaaucuugcugagca

SEQ ID NO: 232 - RNA, 17 nt, Homo sapiens
cugagcauaaaacaguc

SEQ ID NO: 233 - RNA, 17 nt, Homo sapiens
aaaacagucaaaugugu

SEQ ID NO: 234 - RNA, 17 nt, Homo sapiens
aaauguguuuaaaaacc

SEQ ID NO: 235 - RNA, 17 nt, Homo sapiens
aauguguuuaaaaaccu

SEQ ID NO: 236 - RNA, 17 nt, Homo sapiens
auguguuuaaaaaccuc

SEQ ID NO: 237 - RNA, 17 nt, Homo sapiens
aaaaaccucacugccac

SEQ ID NO: 238 - RNA, 17 nt, Homo sapiens
cugccacucuaauuguc

SEQ ID NO: 239 - RNA, 17 nt, Homo sapiens
gccacucuaauugucaa

SEQ ID NO: 240 - RNA, 17 nt, Homo sapiens
acucuaauugucaaugu

SEQ ID NO: 241 - RNA, 17 nt, Homo sapiens
cuaauugucaaugugaa

SEQ ID NO: 242 - RNA, 17 nt, Homo sapiens
ccccagauuuacgaaaa

SEQ ID NO: 243 - RNA, 17 nt, Homo sapiens
cccagauuuacgaaaag

SEQ ID NO: 244 - RNA, 17 nt, Homo sapiens
ccagauuuacgaaaagg

SEQ ID NO: 245 - RNA, 17 nt, Homo sapiens
ggccgugucaucguuuc

SEQ ID NO: 246 - RNA, 17 nt, Homo sapiens
cgugucaucguuuccag

SEQ ID NO: 247 - RNA, 17 nt, Homo sapiens
gucaucguuuccagacc

SEQ ID NO: 248 - RNA, 17 nt, Homo sapiens
ucaucguuuccagaccc

SEQ ID NO: 249 - RNA, 17 nt, Homo sapiens
caucguuuccagacccg

SEQ ID NO: 250 - RNA, 17 nt, Homo sapiens
acccggcucucuaccca

SEQ ID NO: 251 - RNA, 17 nt, Homo sapiens
ccggcucucuacccacu

SEQ ID NO: 252 - RNA, 17 nt, Homo sapiens
ggcucucuacccacugg

SEQ ID NO: 253 - RNA, 17 nt, Homo sapiens
agacaaauccugacuug

SEQ ID NO: 254 - RNA, 17 nt, Homo sapiens
uccugacuuguaccgca

SEQ ID NO: 255 - RNA, 17 nt, Homo sapiens
ugacuuguaccgcauau

SEQ ID NO: 256 - RNA, 17 nt, Homo sapiens
uaccgcauaugguaucc

SEQ ID NO: 257 - RNA, 17 nt, Homo sapiens
cauaugguaucccucaa

SEQ ID NO: 258 - RNA, 17 nt, Homo sapiens
uaugguaucccucaacc

SEQ ID NO: 259 - RNA, 17 nt, Homo sapiens
guaucccucaaccuaca

SEQ ID NO: 260 - RNA, 17 nt, Homo sapiens
cucaaccuacaaucaag

SEQ ID NO: 261 - RNA, 17 nt, Homo sapiens
ccuacaaucaagugguu

SEQ ID NO: 262 - RNA, 17 nt, Homo sapiens
caagugguucuggcacc

SEQ ID NO: 263 - RNA, 17 nt, Homo sapiens
aagugguucuggcaccc

SEQ ID NO: 264 - RNA, 17 nt, Homo sapiens
accccuguaaccauaau

SEQ ID NO: 265 - RNA, 17 nt, Homo sapiens
guaaccauaaucauucc

SEQ ID NO: 266 - RNA, 17 nt, Homo sapiens
accauaaucauuccgaa

SEQ ID NO: 267 - RNA, 17 nt, Homo sapiens
auaaucauuccgaagca

SEQ ID NO: 268 - RNA, 17 nt, Homo sapiens
uaaucauuccgaagcaa

SEQ ID NO: 269 - RNA, 17 nt, Homo sapiens
gugugacuuuuguucca

SEQ ID NO: 270 - RNA, 17 nt, Homo sapiens
ugugacuuuuguuccaa

SEQ ID NO: 271 - RNA, 17 nt, Homo sapiens
gugacuuuuguuccaau

SEQ ID NO: 272 - RNA, 17 nt, Homo sapiens
acuuuuguuccaauaau

SEQ ID NO: 273 - RNA, 17 nt, Homo sapiens
cuuuuguuccaauaaug

SEQ ID NO: 274 - RNA, 17 nt, Homo sapiens
guuccaauaaugaagag

SEQ ID NO: 275 - RNA, 17 nt, Homo sapiens
ugaagaguccuuuaucc

SEQ ID NO: 276 - RNA, 17 nt, Homo sapiens
agaguccuuuauccugg

SEQ ID NO: 277 - RNA, 17 nt, Homo sapiens
gaguccuuuauccugga

SEQ ID NO: 278 - RNA, 17 nt, Homo sapiens
aguccuuuauccuggau

SEQ ID NO: 279 - RNA, 17 nt, Homo sapiens
uccuuuauccuggaugc

SEQ ID NO: 280 - RNA, 17 nt, Homo sapiens
aacagaauugagagcau

SEQ ID NO: 281 - RNA, 17 nt, Homo sapiens
gagagcaucacucagcg

SEQ ID NO: 282 - RNA, 17 nt, Homo sapiens
gcaucacucagcgcaug

SEQ ID NO: 283 - RNA, 17 nt, Homo sapiens
auggcaauaauagaagg

SEQ ID NO: 284 - RNA, 17 nt, Homo sapiens
gcaauaauagaaggaaa

SEQ ID NO: 285 - RNA, 17 nt, Homo sapiens
gaaagaauaagauggcu

SEQ ID NO: 286 - RNA, 17 nt, Homo sapiens
agauggcuagcaccuug

SEQ ID NO: 287 - RNA, 17 nt, Homo sapiens
uagcaccuugguugugg

SEQ ID NO: 288 - RNA, 17 nt, Homo sapiens
accuugguuguggcuga

SEQ ID NO: 289 - RNA, 17 nt, Homo sapiens
ggcugacucuagaauuu

SEQ ID NO: 290 - RNA, 17 nt, Homo sapiens
cugacucuagaauuucu

SEQ ID NO: 291 - RNA, 17 nt, Homo sapiens
ucuagaauuucuggaau

SEQ ID NO: 292 - RNA, 17 nt, Homo sapiens
cuagaauuucuggaauc

SEQ ID NO: 293 - RNA, 17 nt, Homo sapiens
uagaauuucuggaaucu

SEQ ID NO: 294 - RNA, 17 nt, Homo sapiens
ucuggaaucuacauuug

SEQ ID NO: 295 - RNA, 17 nt, Homo sapiens
uggaaucuacauuugca

SEQ ID NO: 296 - RNA, 17 nt, Homo sapiens
aucuacauuugcauagc

SEQ ID NO: 297 - RNA, 17 nt, Homo sapiens
ucuacauuugcauagcu

SEQ ID NO: 298 - RNA, 17 nt, Homo sapiens
auuugcauagcuuccaa

SEQ ID NO: 299 - RNA, 17 nt, Homo sapiens
gcauagcuuccaauaaa

SEQ ID NO: 300 - RNA, 17 nt, Homo sapiens
cauagcuuccaauaaag

SEQ ID NO: 301 - RNA, 17 nt, Homo sapiens
cuuccaauaaaguuggg

SEQ ID NO: 302 - RNA, 17 nt, Homo sapiens
aauaaaguugggacugu

SEQ ID NO: 303 - RNA, 17 nt, Homo sapiens
agaaacauaagcuuuua

SEQ ID NO: 304 - RNA, 17 nt, Homo sapiens
cauaagcuuuuauauca

SEQ ID NO: 305 - RNA, 17 nt, Homo sapiens
auaagcuuuuauaucac

SEQ ID NO: 306 - RNA, 17 nt, Homo sapiens
uaagcuuuuauaucaca

SEQ ID NO: 307 - RNA, 17 nt, Homo sapiens
aagcuuuuauaucacag

SEQ ID NO: 308 - RNA, 17 nt, Homo sapiens
gcuuuuauaucacagau

SEQ ID NO: 309 - RNA, 17 nt, Homo sapiens
uuuuauaucacagaugu

SEQ ID NO: 310 - RNA, 17 nt, Homo sapiens
aaauggguuucauguua

SEQ ID NO: 311 - RNA, 17 nt, Homo sapiens
aauggguuucauguuaa

SEQ ID NO: 312 - RNA, 17 nt, Homo sapiens
auggguuucauguuaac

SEQ ID NO: 313 - RNA, 17 nt, Homo sapiens
uuucauguuaacuugga

SEQ ID NO: 314 - RNA, 17 nt, Homo sapiens
uucauguuaacuuggaa

SEQ ID NO: 315 - RNA, 17 nt, Homo sapiens
uguuaacuuggaaaaaa

SEQ ID NO: 316 - RNA, 17 nt, Homo sapiens
gaaacugucuugcacag

SEQ ID NO: 317 - RNA, 17 nt, Homo sapiens
aacugucuugcacaguu

SEQ ID NO: 318 - RNA, 17 nt, Homo sapiens
ugcacaguuaacaaguu

SEQ ID NO: 319 - RNA, 17 nt, Homo sapiens
gcacaguuaacaaguuc

SEQ ID NO: 320 - RNA, 17 nt, Homo sapiens
uaacaaguucuuauaca

SEQ ID NO: 321 - RNA, 17 nt, Homo sapiens
aacaaguucuuauacag

SEQ ID NO: 322 - RNA, 17 nt, Homo sapiens
caaguucuuauacagag

SEQ ID NO: 323 - RNA, 17 nt, Homo sapiens
aaguucuuauacagaga

SEQ ID NO: 324 - RNA, 17 nt, Homo sapiens
guucuuauacagagacg

SEQ ID NO: 325 - RNA, 17 nt, Homo sapiens
agagacguuacuuggau

SEQ ID NO: 326 - RNA, 17 nt, Homo sapiens
gagacguuacuuggauu

SEQ ID NO: 327 - RNA, 17 nt, Homo sapiens
acguuacuuggauuuua

SEQ ID NO: 328 - RNA, 17 nt, Homo sapiens
acuuggauuuuacugcg

SEQ ID NO: 329 - RNA, 17 nt, Homo sapiens
cuuggauuuuacugcgg

SEQ ID NO: 330 - RNA, 17 nt, Homo sapiens
uuggauuuuacugcgga

SEQ ID NO: 331 - RNA, 17 nt, Homo sapiens
uggauuuuacugcggac

SEQ ID NO: 332 - RNA, 17 nt, Homo sapiens
cggacaguuaauaacag

SEQ ID NO: 333 - RNA, 17 nt, Homo sapiens
ggacaguuaauaacaga

SEQ ID NO: 334 - RNA, 17 nt, Homo sapiens
caguuaauaacagaaca

SEQ ID NO: 335 - RNA, 17 nt, Homo sapiens
aaugcacuacaguauua

SEQ ID NO: 336 - RNA, 17 nt, Homo sapiens
acuacaguauuagcaag

SEQ ID NO: 337 - RNA, 17 nt, Homo sapiens
uacaguauuagcaagca

SEQ ID NO: 338 - RNA, 17 nt, Homo sapiens
acaguauuagcaagcaa

SEQ ID NO: 339 - RNA, 17 nt, Homo sapiens
auggccaucacuaagga

SEQ ID NO: 340 - RNA, 17 nt, Homo sapiens
ccaucacuaaggagcac

SEQ ID NO: 341 - RNA, 17 nt, Homo sapiens
ggagcacuccaucacuc

SEQ ID NO: 342 - RNA, 17 nt, Homo sapiens
cacuccaucacucuuaa

SEQ ID NO: 343 - RNA, 17 nt, Homo sapiens
ccaucacucuuaaucuu

SEQ ID NO: 344 - RNA, 17 nt, Homo sapiens
aucacucuuaaucuuac

SEQ ID NO: 345 - RNA, 17 nt, Homo sapiens
ucacucuuaaucuuacc

SEQ ID NO: 346 - RNA, 17 nt, Homo sapiens
cucuuaaucuuaccauc

SEQ ID NO: 347 - RNA, 17 nt, Homo sapiens
cuuaaucuuaccaucau

SEQ ID NO: 348 - RNA, 17 nt, Homo sapiens
uuaaucuuaccaucaug

SEQ ID NO: 349 - RNA, 17 nt, Homo sapiens
cuuaccaucaugaaugu

SEQ ID NO: 350 - RNA, 17 nt, Homo sapiens
augaauguuucccugca

SEQ ID NO: 351 - RNA, 17 nt, Homo sapiens
ugaauguuucccugcaa

SEQ ID NO: 352 - RNA, 17 nt, Homo sapiens
gaauguuucccugcaag

SEQ ID NO: 353 - RNA, 17 nt, Homo sapiens
ugcaagauucaggcacc

SEQ ID NO: 354 - RNA, 17 nt, Homo sapiens
gcaagauucaggcaccu

SEQ ID NO: 355 - RNA, 17 nt, Homo sapiens
aggcaccuaugccugca

SEQ ID NO: 356 - RNA, 17 nt, Homo sapiens
aggaauguauacacagg

SEQ ID NO: 357 - RNA, 17 nt, Homo sapiens
gaauguauacacagggg

SEQ ID NO: 358 - RNA, 17 nt, Homo sapiens
gaagaaauccuccagaa

SEQ ID NO: 359 - RNA, 17 nt, Homo sapiens
gaaauccuccagaagaa

SEQ ID NO: 360 - RNA, 17 nt, Homo sapiens
aaagaaauuacaaucag

SEQ ID NO: 361 - RNA, 17 nt, Homo sapiens
aagaaauuacaaucaga

SEQ ID NO: 362 - RNA, 17 nt, Homo sapiens
auuacaaucagagauca

SEQ ID NO: 363 - RNA, 17 nt, Homo sapiens
ucagagaucaggaagca

SEQ ID NO: 364 - RNA, 17 nt, Homo sapiens
agcaccauaccuccugc

SEQ ID NO: 365 - RNA, 17 nt, Homo sapiens
ccauaccuccugcgaaa

SEQ ID NO: 366 - RNA, 17 nt, Homo sapiens
cgaaaccucagugauca

SEQ ID NO: 367 - RNA, 17 nt, Homo sapiens
ucagugaucacacagug

SEQ ID NO: 368 - RNA, 17 nt, Homo sapiens
guggccaucagcaguuc

SEQ ID NO: 369 - RNA, 17 nt, Homo sapiens
ucagcaguuccaccacu

SEQ ID NO: 370 - RNA, 17 nt, Homo sapiens
cagcaguuccaccacuu

SEQ ID NO: 371 - RNA, 17 nt, Homo sapiens
ccaccacuuuagacugu

SEQ ID NO: 372 - RNA, 17 nt, Homo sapiens
caccacuuuagacuguc

SEQ ID NO: 373 - RNA, 17 nt, Homo sapiens
accacuuuagacuguca

SEQ ID NO: 374 - RNA, 17 nt, Homo sapiens
uagacugucaugcuaau

SEQ ID NO: 375 - RNA, 17 nt, Homo sapiens
gucaugcuaaugguguc

SEQ ID NO: 376 - RNA, 17 nt, Homo sapiens
aaugguguccccgagcc

SEQ ID NO: 377 - RNA, 17 nt, Homo sapiens
ccgagccucagaucacu

SEQ ID NO: 378 - RNA, 17 nt, Homo sapiens
ccucagaucacuugguu

SEQ ID NO: 379 - RNA, 17 nt, Homo sapiens
agaucacuugguuuaaa

SEQ ID NO: 380 - RNA, 17 nt, Homo sapiens
cacuugguuuaaaaaca

SEQ ID NO: 381 - RNA, 17 nt, Homo sapiens
acuugguuuaaaaacaa

SEQ ID NO: 382 - RNA, 17 nt, Homo sapiens
cuugguuuaaaaacaac

SEQ ID NO: 383 - RNA, 17 nt, Homo sapiens
cacaaaauacaacaaga

SEQ ID NO: 384 - RNA, 17 nt, Homo sapiens
ccuggaauuauuuuagg

SEQ ID NO: 385 - RNA, 17 nt, Homo sapiens
cuggaauuauuuuagga

SEQ ID NO: 386 - RNA, 17 nt, Homo sapiens
ggaauuauuuuaggacc

SEQ ID NO: 387 - RNA, 17 nt, Homo sapiens
gaauuauuuuaggacca

SEQ ID NO: 388 - RNA, 17 nt, Homo sapiens
aauuauuuuaggaccag

SEQ ID NO: 389 - RNA, 17 nt, Homo sapiens
auuauuuuaggaccagg

SEQ ID NO: 390 - RNA, 17 nt, Homo sapiens
cacgcuguuuauugaaa

SEQ ID NO: 391 - RNA, 17 nt, Homo sapiens
acgcuguuuauugaaag

SEQ ID NO: 392 - RNA, 17 nt, Homo sapiens
cgcuguuuauugaaaga

SEQ ID NO: 393 - RNA, 17 nt, Homo sapiens
cuguuuauugaaagagu

SEQ ID NO: 394 - RNA, 17 nt, Homo sapiens
gaaagagucacagaaga

SEQ ID NO: 395 - RNA, 17 nt, Homo sapiens
gaaggugucuaucacug

SEQ ID NO: 396 - RNA, 17 nt, Homo sapiens
aggugucuaucacugca

SEQ ID NO: 397 - RNA, 17 nt, Homo sapiens
gugucuaucacugcaaa

SEQ ID NO: 398 - RNA, 17 nt, Homo sapiens
gaagggcucuguggaaa

SEQ ID NO: 399 - RNA, 17 nt, Homo sapiens
uggaaaguucagcauac

SEQ ID NO: 400 - RNA, 17 nt, Homo sapiens
ggaaaguucagcauacc

SEQ ID NO: 401 - RNA, 17 nt, Homo sapiens
uucagcauaccucacug

SEQ ID NO: 402 - RNA, 17 nt, Homo sapiens
gcauaccucacuguuca

SEQ ID NO: 403 - RNA, 17 nt, Homo sapiens
cucacuguucaaggaac

SEQ ID NO: 404 - RNA, 17 nt, Homo sapiens
ucacuguucaaggaacc

SEQ ID NO: 405 - RNA, 17 nt, Homo sapiens
aggaaccucggacaagu

SEQ ID NO: 406 - RNA, 17 nt, Homo sapiens
ggacaagucuaaucugg

SEQ ID NO: 407 - RNA, 17 nt, Homo sapiens
acaagucuaaucuggag

SEQ ID NO: 408 - RNA, 17 nt, Homo sapiens
agucuaaucuggagcug

SEQ ID NO: 409 - RNA, 17 nt, Homo sapiens
gagcugaucacucuaac

SEQ ID NO: 410 - RNA, 17 nt, Homo sapiens
ugaucacucuaacaugc

SEQ ID NO: 411 - RNA, 17 nt, Homo sapiens
aucacucuaacaugcac

SEQ ID NO: 412 - RNA, 17 nt, Homo sapiens
cugcgacucucuucugg

SEQ ID NO: 413 - RNA, 17 nt, Homo sapiens
gcgacucucuucuggcu

SEQ ID NO: 414 - RNA, 17 nt, Homo sapiens
gacucucuucuggcucc

SEQ ID NO: 415 - RNA, 17 nt, Homo sapiens
acucucuucuggcuccu

SEQ ID NO: 416 - RNA, 17 nt, Homo sapiens
uucuggcuccuauuaac

SEQ ID NO: 417 - RNA, 17 nt, Homo sapiens
uggcuccuauuaacccu

SEQ ID NO: 418 - RNA, 17 nt, Homo sapiens
gcuccuauuaacccucc

SEQ ID NO: 419 - RNA, 17 nt, Homo sapiens
cuccuauuaacccuccu

SEQ ID NO: 420 - RNA, 17 nt, Homo sapiens
uuaacccuccuuauccg

SEQ ID NO: 421 - RNA, 17 nt, Homo sapiens
acccuccuuauccgaaa

SEQ ID NO: 422 - RNA, 17 nt, Homo sapiens
cccuccuuauccgaaaa

SEQ ID NO: 423 - RNA, 17 nt, Homo sapiens
cuccuuauccgaaaaau

SEQ ID NO: 424 - RNA, 17 nt, Homo sapiens
gaaaaggucuucuucug

SEQ ID NO: 425 - RNA, 17 nt, Homo sapiens
aaaggucuucuucugaa

SEQ ID NO: 426 - RNA, 17 nt, Homo sapiens
aaggucuucuucugaaa

SEQ ID NO: 427 - RNA, 17 nt, Homo sapiens
ggucuucuucugaaaua

SEQ ID NO: 428 - RNA, 17 nt, Homo sapiens
gucuucuucugaaauaa

SEQ ID NO: 429 - RNA, 17 nt, Homo sapiens
ucugaaauaaagacuga

SEQ ID NO: 430 - RNA, 17 nt, Homo sapiens
gacugacuaccuaucaa

SEQ ID NO: 431 - RNA, 17 nt, Homo sapiens
gacuaccuaucaauuau

SEQ ID NO: 432 - RNA, 17 nt, Homo sapiens
cuaccuaucaauuauaa

SEQ ID NO: 433 - RNA, 17 nt, Homo sapiens
cuaucaauuauaaugga

SEQ ID NO: 434 - RNA, 17 nt, Homo sapiens
uaucaauuauaauggac

SEQ ID NO: 435 - RNA, 17 nt, Homo sapiens
ucaauuauaauggaccc

SEQ ID NO: 436 - RNA, 17 nt, Homo sapiens
gaugaaguuccuuugga

SEQ ID NO: 437 - RNA, 17 nt, Homo sapiens
augaaguuccuuuggau

SEQ ID NO: 438 - RNA, 17 nt, Homo sapiens
aaguuccuuuggaugag

SEQ ID NO: 439 - RNA, 17 nt, Homo sapiens
aguuccuuuggaugagc

SEQ ID NO: 440 - RNA, 17 nt, Homo sapiens
gagcggcucccuuauga

SEQ ID NO: 441 - RNA, 17 nt, Homo sapiens
ggcucccuuaugaugcc

SEQ ID NO: 442 - RNA, 17 nt, Homo sapiens
gcucccuuaugaugcca

SEQ ID NO: 443 - RNA, 17 nt, Homo sapiens
gugggaguuugcccggg

SEQ ID NO: 444 - RNA, 17 nt, Homo sapiens
ugggaguuugcccggga

SEQ ID NO: 445 - RNA, 17 nt, Homo sapiens
gagagacuuaaacuggg

SEQ ID NO: 446 - RNA, 17 nt, Homo sapiens
agagacuuaaacugggc

SEQ ID NO: 447 - RNA, 17 nt, Homo sapiens
gggcaaaucacuuggaa

SEQ ID NO: 448 - RNA, 17 nt, Homo sapiens
aaaucacuuggaagagg

SEQ ID NO: 449 - RNA, 17 nt, Homo sapiens
gaggggcuuuuggaaaa

SEQ ID NO: 450 - RNA, 17 nt, Homo sapiens
aggggcuuuuggaaaag

SEQ ID NO: 451 - RNA, 17 nt, Homo sapiens
ggggcuuuuggaaaagu

SEQ ID NO: 452 - RNA, 17 nt, Homo sapiens
aaagugguucaagcauc

SEQ ID NO: 453 - RNA, 17 nt, Homo sapiens
aagugguucaagcauca

SEQ ID NO: 454 - RNA, 17 nt, Homo sapiens
ucaagcaucagcauuug

SEQ ID NO: 455 - RNA, 17 nt, Homo sapiens
aucagcauuuggcauua

SEQ ID NO: 456 - RNA, 17 nt, Homo sapiens
ucagcauuuggcauuaa

SEQ ID NO: 457 - RNA, 17 nt, Homo sapiens
uuuggcauuaagaaauc

SEQ ID NO: 458 - RNA, 17 nt, Homo sapiens
uuggcauuaagaaauca

SEQ ID NO: 459 - RNA, 17 nt, Homo sapiens
uaagaaaucaccuacgu

SEQ ID NO: 460 - RNA, 17 nt, Homo sapiens
aaucaccuacgugccgg

SEQ ID NO: 461 - RNA, 17 nt, Homo sapiens
cagcgaguacaaagcuc

SEQ ID NO: 462 - RNA, 17 nt, Homo sapiens
acaaagcucugaugacu

SEQ ID NO: 463 - RNA, 17 nt, Homo sapiens
acugagcuaaaaaucuu

SEQ ID NO: 464 - RNA, 17 nt, Homo sapiens
cuaaaaaucuugaccca

SEQ ID NO: 465 - RNA, 17 nt, Homo sapiens
aaaaaucuugacccaca

SEQ ID NO: 466 - RNA, 17 nt, Homo sapiens
acccacauuggccacca

SEQ ID NO: 467 - RNA, 17 nt, Homo sapiens
gccaccaucugaacgug

SEQ ID NO: 468 - RNA, 17 nt, Homo sapiens
aacgugguuaaccugcu

SEQ ID NO: 469 - RNA, 17 nt, Homo sapiens
acgugguuaaccugcug

SEQ ID NO: 470 - RNA, 17 nt, Homo sapiens
gagggccucugauggug

SEQ ID NO: 471 - RNA, 17 nt, Homo sapiens
auggugauuguugaaua

SEQ ID NO: 472 - RNA, 17 nt, Homo sapiens
gugauuguugaauacug

SEQ ID NO: 473 - RNA, 17 nt, Homo sapiens
uguugaauacugcaaau

SEQ ID NO: 474 - RNA, 17 nt, Homo sapiens
cugcaaauauggaaauc

SEQ ID NO: 475 - RNA, 17 nt, Homo sapiens
auggaaaucucuccaac

SEQ ID NO: 476 - RNA, 17 nt, Homo sapiens
ggaaaucucuccaacua

SEQ ID NO: 477 - RNA, 17 nt, Homo sapiens
aaaucucuccaacuacc

SEQ ID NO: 478 - RNA, 17 nt, Homo sapiens
cuccaacuaccucaaga

SEQ ID NO: 479 - RNA, 17 nt, Homo sapiens
aacuaccucaagagcaa

SEQ ID NO: 480 - RNA, 17 nt, Homo sapiens
acgugacuuauuuuuuc

SEQ ID NO: 481 - RNA, 17 nt, Homo sapiens
cgugacuuauuuuuucu

SEQ ID NO: 482 - RNA, 17 nt, Homo sapiens
ugacuuauuuuuucuca

SEQ ID NO: 483 - RNA, 17 nt, Homo sapiens
gacuuauuuuuucucaa

SEQ ID NO: 484 - RNA, 17 nt, Homo sapiens
acuuauuuuuucucaac

SEQ ID NO: 485 - RNA, 17 nt, Homo sapiens
cuuauuuuuucucaaca

SEQ ID NO: 486 - RNA, 17 nt, Homo sapiens
uuauuuuuucucaacaa

SEQ ID NO: 487 - RNA, 17 nt, Homo sapiens
uauuuuuucucaacaag

SEQ ID NO: 488 - RNA, 17 nt, Homo sapiens
uuuuuucucaacaagga

SEQ ID NO: 489 - RNA, 17 nt, Homo sapiens
gcagcacuacacaugga

SEQ ID NO: 490 - RNA, 17 nt, Homo sapiens
uggagccuaagaaagaa

SEQ ID NO: 491 - RNA, 17 nt, Homo sapiens
ccaagacuagauagcgu

SEQ ID NO: 492 - RNA, 17 nt, Homo sapiens
gacuagauagcgucacc

SEQ ID NO: 493 - RNA, 17 nt, Homo sapiens
gauagcgucaccagcag

SEQ ID NO: 494 - RNA, 17 nt, Homo sapiens
cgaaagcuuugcgagcu

SEQ ID NO: 495 - RNA, 17 nt, Homo sapiens
gaaagcuuugcgagcuc

SEQ ID NO: 496 - RNA, 17 nt, Homo sapiens
ugcgagcuccggcuuuc

SEQ ID NO: 497 - RNA, 17 nt, Homo sapiens
cuccggcuuucaggaag

SEQ ID NO: 498 - RNA, 17 nt, Homo sapiens
uccggcuuucaggaaga

SEQ ID NO: 499 - RNA, 17 nt, Homo sapiens
ccggcuuucaggaagau

SEQ ID NO: 500 - RNA, 17 nt, Homo sapiens
aggaagauaaaagucug

SEQ ID NO: 501 - RNA, 17 nt, Homo sapiens
auaaaagucugagugau

SEQ ID NO: 502 - RNA, 17 nt, Homo sapiens
agugauguugaggaaga

SEQ ID NO: 503 - RNA, 17 nt, Homo sapiens
aggaggauucugacggu

SEQ ID NO: 504 - RNA, 17 nt, Homo sapiens
ggaggauucugacgguu

SEQ ID NO: 505 - RNA, 17 nt, Homo sapiens
cugacgguuucuacaag

SEQ ID NO: 506 - RNA, 17 nt, Homo sapiens
ugacgguuucuacaagg

SEQ ID NO: 507 - RNA, 17 nt, Homo sapiens
gacgguuucuacaagga

SEQ ID NO: 508 - RNA, 17 nt, Homo sapiens
cgguuucuacaaggagc

SEQ ID NO: 509 - RNA, 17 nt, Homo sapiens
gagcccaucacuaugga

SEQ ID NO: 510 - RNA, 17 nt, Homo sapiens
ccaucacuauggaagau

SEQ ID NO: 511 - RNA, 17 nt, Homo sapiens
uggaagaucugauuucu

SEQ ID NO: 512 - RNA, 17 nt, Homo sapiens
gaucugauuucuuacag

SEQ ID NO: 513 - RNA, 17 nt, Homo sapiens
aucugauuucuuacagu

SEQ ID NO: 514 - RNA, 17 nt, Homo sapiens
ucugauuucuuacaguu

SEQ ID NO: 515 - RNA, 17 nt, Homo sapiens
ugauuucuuacaguuuu

SEQ ID NO: 516 - RNA, 17 nt, Homo sapiens
gauuucuuacaguuuuc

SEQ ID NO: 517 - RNA, 17 nt, Homo sapiens
cuuacaguuuucaagug

SEQ ID NO: 518 - RNA, 17 nt, Homo sapiens
uuacaguuuucaagugg

SEQ ID NO: 519 - RNA, 17 nt, Homo sapiens
uacaguuuucaaguggc

SEQ ID NO: 520 - RNA, 17 nt, Homo sapiens
acaguuuucaaguggcc

SEQ ID NO: 521 - RNA, 17 nt, Homo sapiens
cauggaguuccugucuu

SEQ ID NO: 522 - RNA, 17 nt, Homo sapiens
auggaguuccugucuuc

SEQ ID NO: 523 - RNA, 17 nt, Homo sapiens
guuccugucuuccagaa

SEQ ID NO: 524 - RNA, 17 nt, Homo sapiens
uccugucuuccagaaag

SEQ ID NO: 525 - RNA, 17 nt, Homo sapiens
ccugucuuccagaaagu

SEQ ID NO: 526 - RNA, 17 nt, Homo sapiens
aagugcauucaucggga

SEQ ID NO: 527 - RNA, 17 nt, Homo sapiens
agugcauucaucgggac

SEQ ID NO: 528 - RNA, 17 nt, Homo sapiens
gcauucaucgggaccug

SEQ ID NO: 529 - RNA, 17 nt, Homo sapiens
agaaacauucuuuuauc

SEQ ID NO: 530 - RNA, 17 nt, Homo sapiens
gaaacauucuuuuaucu

SEQ ID NO: 531 - RNA, 17 nt, Homo sapiens
aacauucuuuuaucuga

SEQ ID NO: 532 - RNA, 17 nt, Homo sapiens
acauucuuuuaucugag

SEQ ID NO: 533 - RNA, 17 nt, Homo sapiens
cauucuuuuaucugaga

SEQ ID NO: 534 - RNA, 17 nt, Homo sapiens
auucuuuuaucugagaa

SEQ ID NO: 535 - RNA, 17 nt, Homo sapiens
ucuuuuaucugagaaca

SEQ ID NO: 536 - RNA, 17 nt, Homo sapiens
gugaagauuugugauuu

SEQ ID NO: 537 - RNA, 17 nt, Homo sapiens
ugaagauuugugauuuu

SEQ ID NO: 538 - RNA, 17 nt, Homo sapiens
uuugugauuuuggccuu

SEQ ID NO: 539 - RNA, 17 nt, Homo sapiens
uugugauuuuggccuug

SEQ ID NO: 540 - RNA, 17 nt, Homo sapiens
ugugauuuuggccuugc

SEQ ID NO: 541 - RNA, 17 nt, Homo sapiens
uuuggccuugcccggga

SEQ ID NO: 542 - RNA, 17 nt, Homo sapiens
cccgggauauuuauaag

SEQ ID NO: 543 - RNA, 17 nt, Homo sapiens
cgggauauuuauaagaa

SEQ ID NO: 544 - RNA, 17 nt, Homo sapiens
gggauauuuauaagaac

SEQ ID NO: 545 - RNA, 17 nt, Homo sapiens
ggauauuuauaagaacc

SEQ ID NO: 546 - RNA, 17 nt, Homo sapiens
auauuuauaagaacccc

SEQ ID NO: 547 - RNA, 17 nt, Homo sapiens
accccgauuaugugaga

SEQ ID NO: 548 - RNA, 17 nt, Homo sapiens
ccccgauuaugugagaa

SEQ ID NO: 549 - RNA, 17 nt, Homo sapiens
aaggagauacucgacuu

SEQ ID NO: 550 - RNA, 17 nt, Homo sapiens
gagauacucgacuuccu

SEQ ID NO: 551 - RNA, 17 nt, Homo sapiens
acucgacuuccucugaa

SEQ ID NO: 552 - RNA, 17 nt, Homo sapiens
cucgacuuccucugaaa

SEQ ID NO: 553 - RNA, 17 nt, Homo sapiens
gacuuccucugaaaugg

SEQ ID NO: 554 - RNA, 17 nt, Homo sapiens
ggauggcucccgaaucu

SEQ ID NO: 555 - RNA, 17 nt, Homo sapiens
ucccgaaucuaucuuug

SEQ ID NO: 556 - RNA, 17 nt, Homo sapiens
ccgaaucuaucuuugac

SEQ ID NO: 557 - RNA, 17 nt, Homo sapiens
gaaucuaucuuugacaa

SEQ ID NO: 558 - RNA, 17 nt, Homo sapiens
aucuaucuuugacaaaa

SEQ ID NO: 559 - RNA, 17 nt, Homo sapiens
ucuaucuuugacaaaau

SEQ ID NO: 560 - RNA, 17 nt, Homo sapiens
gacaaaaucuacagcac

SEQ ID NO: 561 - RNA, 17 nt, Homo sapiens
caaaaucuacagcacca

SEQ ID NO: 562 - RNA, 17 nt, Homo sapiens
cguguggucuuacggag

SEQ ID NO: 563 - RNA, 17 nt, Homo sapiens
uguggucuuacggagua

SEQ ID NO: 564 - RNA, 17 nt, Homo sapiens
guggucuuacggaguau

SEQ ID NO: 565 - RNA, 17 nt, Homo sapiens
uacggaguauugcugug

SEQ ID NO: 566 - RNA, 17 nt, Homo sapiens
cggaguauugcuguggg

SEQ ID NO: 567 - RNA, 17 nt, Homo sapiens
ugggaaaucuucuccuu

SEQ ID NO: 568 - RNA, 17 nt, Homo sapiens
ggaaaucuucuccuuag

SEQ ID NO: 569 - RNA, 17 nt, Homo sapiens
gaaaucuucuccuuagg

SEQ ID NO: 570 - RNA, 17 nt, Homo sapiens
aaucuucuccuuaggug

SEQ ID NO: 571 - RNA, 17 nt, Homo sapiens
cuucuccuuaggugggu

SEQ ID NO: 572 - RNA, 17 nt, Homo sapiens
uucuccuuagguggguc

SEQ ID NO: 573 - RNA, 17 nt, Homo sapiens
aggugggucuccauacc

SEQ ID NO: 574 - RNA, 17 nt, Homo sapiens
gugggucuccauaccca

SEQ ID NO: 575 - RNA, 17 nt, Homo sapiens
gucuccauacccaggag

SEQ ID NO: 576 - RNA, 17 nt, Homo sapiens
ccaggaguacaaaugga

SEQ ID NO: 577 - RNA, 17 nt, Homo sapiens
ugaggacuuuugcaguc

SEQ ID NO: 578 - RNA, 17 nt, Homo sapiens
gaggacuuuugcagucg

SEQ ID NO: 579 - RNA, 17 nt, Homo sapiens
aggacuuuugcagucgc

SEQ ID NO: 580 - RNA, 17 nt, Homo sapiens
uuugcagucgccugagg

SEQ ID NO: 581 - RNA, 17 nt, Homo sapiens
ugagagcuccugaguac

SEQ ID NO: 582 - RNA, 17 nt, Homo sapiens
uccugaguacucuacuc

SEQ ID NO: 583 - RNA, 17 nt, Homo sapiens
ugaguacucuacuccug

SEQ ID NO: 584 - RNA, 17 nt, Homo sapiens
aguacucuacuccugaa

SEQ ID NO: 585 - RNA, 17 nt, Homo sapiens
acucuacuccugaaauc

SEQ ID NO: 586 - RNA, 17 nt, Homo sapiens
ccugaaaucuaucagau

SEQ ID NO: 587 - RNA, 17 nt, Homo sapiens
ugaaaucuaucagauca

SEQ ID NO: 588 - RNA, 17 nt, Homo sapiens
aaaucuaucagaucaug

SEQ ID NO: 589 - RNA, 17 nt, Homo sapiens
uaucagaucaugcugga

SEQ ID NO: 590 - RNA, 17 nt, Homo sapiens
gccaagauuugcagaac

SEQ ID NO: 591 - RNA, 17 nt, Homo sapiens
ccaagauuugcagaacu

SEQ ID NO: 592 - RNA, 17 nt, Homo sapiens
gcagaacuuguggaaaa

SEQ ID NO: 593 - RNA, 17 nt, Homo sapiens
gaaaaacuaggugauuu

SEQ ID NO: 594 - RNA, 17 nt, Homo sapiens
uaggugauuugcuucaa

SEQ ID NO: 595 - RNA, 17 nt, Homo sapiens
aggugauuugcuucaag

SEQ ID NO: 596 - RNA, 17 nt, Homo sapiens
gauuugcuucaagcaaa

SEQ ID NO: 597 - RNA, 17 nt, Homo sapiens
auuugcuucaagcaaau

SEQ ID NO: 598 - RNA, 17 nt, Homo sapiens
gcaaauguacaacagga

SEQ ID NO: 599 - RNA, 17 nt, Homo sapiens
aggaugguaaagacuac

SEQ ID NO: 600 - RNA, 17 nt, Homo sapiens
uaaagacuacaucccaa

SEQ ID NO: 601 - RNA, 17 nt, Homo sapiens
gacuacaucccaaucaa

SEQ ID NO: 602 - RNA, 17 nt, Homo sapiens
aucccaaucaaugccau

SEQ ID NO: 603 - RNA, 17 nt, Homo sapiens
aaugccauacugacagg

SEQ ID NO: 604 - RNA, 17 nt, Homo sapiens
caggaaauaguggguuu

SEQ ID NO: 605 - RNA, 17 nt, Homo sapiens
uaguggguuuacauacu

SEQ ID NO: 606 - RNA, 17 nt, Homo sapiens
aguggguuuacauacuc

SEQ ID NO: 607 - RNA, 17 nt, Homo sapiens
guggguuuacauacuca

SEQ ID NO: 608 - RNA, 17 nt, Homo sapiens
guuuacauacucaacuc

SEQ ID NO: 609 - RNA, 17 nt, Homo sapiens
uacauacucaacuccug

SEQ ID NO: 610 - RNA, 17 nt, Homo sapiens
acucaacuccugccuuc

SEQ ID NO: 611 - RNA, 17 nt, Homo sapiens
uccugccuucucugagg

SEQ ID NO: 612 - RNA, 17 nt, Homo sapiens
ccugccuucucugagga

SEQ ID NO: 613 - RNA, 17 nt, Homo sapiens
ugccuucucugaggacu

SEQ ID NO: 614 - RNA, 17 nt, Homo sapiens
ugaggacuucuucaagg

SEQ ID NO: 615 - RNA, 17 nt, Homo sapiens
gaggacuucuucaagga

SEQ ID NO: 616 - RNA, 17 nt, Homo sapiens
ggacuucuucaaggaaa

SEQ ID NO: 617 - RNA, 17 nt, Homo sapiens
gacuucuucaaggaaag

SEQ ID NO: 618 - RNA, 17 nt, Homo sapiens
aggaaaguauuucagcu

SEQ ID NO: 619 - RNA, 17 nt, Homo sapiens
gaaaguauuucagcucc

SEQ ID NO: 620 - RNA, 17 nt, Homo sapiens
aaaguauuucagcuccg

SEQ ID NO: 621 - RNA, 17 nt, Homo sapiens
aaguauuucagcuccga

SEQ ID NO: 622 - RNA, 17 nt, Homo sapiens
uuucagcuccgaaguuu

SEQ ID NO: 623 - RNA, 17 nt, Homo sapiens
uccgaaguuuaauucag

SEQ ID NO: 624 - RNA, 17 nt, Homo sapiens
ccgaaguuuaauucagg

SEQ ID NO: 625 - RNA, 17 nt, Homo sapiens
cgaaguuuaauucagga

SEQ ID NO: 626 - RNA, 17 nt, Homo sapiens
aguuuaauucaggaagc

SEQ ID NO: 627 - RNA, 17 nt, Homo sapiens
guuuaauucaggaagcu

SEQ ID NO: 628 - RNA, 17 nt, Homo sapiens
aggaagcucugaugaug

SEQ ID NO: 629 - RNA, 17 nt, Homo sapiens
gaugaugucagauaugu

SEQ ID NO: 630 - RNA, 17 nt, Homo sapiens
ugucagauauguaaaug

SEQ ID NO: 631 - RNA, 17 nt, Homo sapiens
agauauguaaaugcuuu

SEQ ID NO: 632 - RNA, 17 nt, Homo sapiens
uaaaugcuuucaaguuc

SEQ ID NO: 633 - RNA, 17 nt, Homo sapiens
aaaugcuuucaaguuca

SEQ ID NO: 634 - RNA, 17 nt, Homo sapiens
aaugcuuucaaguucau

SEQ ID NO: 635 - RNA, 17 nt, Homo sapiens
uuucaaguucaugagcc

SEQ ID NO: 636 - RNA, 17 nt, Homo sapiens
uucaaguucaugagccu

SEQ ID NO: 637 - RNA, 17 nt, Homo sapiens
gaaagaaucaaaaccuu

SEQ ID NO: 638 - RNA, 17 nt, Homo sapiens
caaaaccuuugaagaac

SEQ ID NO: 639 - RNA, 17 nt, Homo sapiens
aaaaccuuugaagaacu

SEQ ID NO: 640 - RNA, 17 nt, Homo sapiens
gaagaacuuuuaccgaa

SEQ ID NO: 641 - RNA, 17 nt, Homo sapiens
aagaacuuuuaccgaau

SEQ ID NO: 642 - RNA, 17 nt, Homo sapiens
agaacuuuuaccgaaug

SEQ ID NO: 643 - RNA, 17 nt, Homo sapiens
gaacuuuuaccgaaugc

SEQ ID NO: 644 - RNA, 17 nt, Homo sapiens
ugccaccuccauguuug

SEQ ID NO: 645 - RNA, 17 nt, Homo sapiens
cuccauguuugaugacu

SEQ ID NO: 646 - RNA, 17 nt, Homo sapiens
uccauguuugaugacua

SEQ ID NO: 647 - RNA, 17 nt, Homo sapiens
ugaugacuaccagggcg

SEQ ID NO: 648 - RNA, 17 nt, Homo sapiens
gcagcacucuguuggcc

SEQ ID NO: 649 - RNA, 17 nt, Homo sapiens
cacucuguuggccucuc

SEQ ID NO: 650 - RNA, 17 nt, Homo sapiens
guuggccucucccaugc

SEQ ID NO: 651 - RNA, 17 nt, Homo sapiens
uggccucucccaugcug

SEQ ID NO: 652 - RNA, 17 nt, Homo sapiens
gaagcgcuucaccugga

SEQ ID NO: 653 - RNA, 17 nt, Homo sapiens
aagcgcuucaccuggac

SEQ ID NO: 654 - RNA, 17 nt, Homo sapiens
caaggccucgcucaaga

SEQ ID NO: 655 - RNA, 17 nt, Homo sapiens
gccucgcucaagauuga

SEQ ID NO: 656 - RNA, 17 nt, Homo sapiens
cucaagauugacuugag

SEQ ID NO: 657 - RNA, 17 nt, Homo sapiens
gauugacuugagaguaa

SEQ ID NO: 658 - RNA, 17 nt, Homo sapiens
uugagaguaaccaguaa

SEQ ID NO: 659 - RNA, 17 nt, Homo sapiens
uaaccaguaaaaguaag

SEQ ID NO: 660 - RNA, 17 nt, Homo sapiens
guaaaaguaaggagucg

SEQ ID NO: 661 - RNA, 17 nt, Homo sapiens
uaaggagucggggcugu

SEQ ID NO: 662 - RNA, 17 nt, Homo sapiens
ggggcugucugauguca

SEQ ID NO: 663 - RNA, 17 nt, Homo sapiens
ucugaugucagcaggcc

SEQ ID NO: 664 - RNA, 17 nt, Homo sapiens
ggcccaguuucugccau

SEQ ID NO: 665 - RNA, 17 nt, Homo sapiens
gcccaguuucugccauu

SEQ ID NO: 666 - RNA, 17 nt, Homo sapiens
cccaguuucugccauuc

SEQ ID NO: 667 - RNA, 17 nt, Homo sapiens
ucugccauuccagcugu

SEQ ID NO: 668 - RNA, 17 nt, Homo sapiens
cugccauuccagcugug

SEQ ID NO: 669 - RNA, 17 nt, Homo sapiens
gggcacgucagcgaagg

SEQ ID NO: 670 - RNA, 17 nt, Homo sapiens
gcgcagguucaccuacg

SEQ ID NO: 671 - RNA, 17 nt, Homo sapiens
cgcagguucaccuacga

SEQ ID NO: 672 - RNA, 17 nt, Homo sapiens
guucaccuacgaccacg

SEQ ID NO: 673 - RNA, 17 nt, Homo sapiens
aggaaaaucgcgugcug

SEQ ID NO: 674 - RNA, 17 nt, Homo sapiens
gugcugcuccccgcccc

SEQ ID NO: 675 - RNA, 17 nt, Homo sapiens
cccagacuacaacucgg

SEQ ID NO: 676 - RNA, 17 nt, Homo sapiens
cuacaacucgguggucc

SEQ ID NO: 677 - RNA, 17 nt, Homo sapiens
ucggugguccuguacuc

SEQ ID NO: 678 - RNA, 17 nt, Homo sapiens
gguccuguacuccaccc

SEQ ID NO: 679 - RNA, 17 nt, Homo sapiens
ccuguacuccaccccac

SEQ ID NO: 680 - RNA, 17 nt, Homo sapiens
ccacccaucuagaguuu

SEQ ID NO: 681 - RNA, 17 nt, Homo sapiens
acccaucuagaguuuga

SEQ ID NO: 682 - RNA, 17 nt, Homo sapiens
ucuagaguuugacacga

SEQ ID NO: 683 - RNA, 17 nt, Homo sapiens
cuagaguuugacacgaa

SEQ ID NO: 684 - RNA, 17 nt, Homo sapiens
cgaagccuuauuucuag

SEQ ID NO: 685 - RNA, 17 nt, Homo sapiens
gaagccuuauuucuaga

SEQ ID NO: 686 - RNA, 17 nt, Homo sapiens
agccuuauuucuagaag

SEQ ID NO: 687 - RNA, 17 nt, Homo sapiens
gccuuauuucuagaagc

SEQ ID NO: 688 - RNA, 17 nt, Homo sapiens
ccuuauuucuagaagca

SEQ ID NO: 689 - RNA, 17 nt, Homo sapiens
uuauuucuagaagcaca

SEQ ID NO: 690 - RNA, 17 nt, Homo sapiens
acauguguauuuauacc

SEQ ID NO: 691 - RNA, 17 nt, Homo sapiens
auguguauuuauacccc

SEQ ID NO: 692 - RNA, 17 nt, Homo sapiens
uguguauuuauaccccc

SEQ ID NO: 693 - RNA, 17 nt, Homo sapiens
guguauuuauaccccca

SEQ ID NO: 694 - RNA, 17 nt, Homo sapiens
guauuuauacccccagg

SEQ ID NO: 695 - RNA, 17 nt, Homo sapiens
aggaaacuagcuuuugc

SEQ ID NO: 696 - RNA, 17 nt, Homo sapiens
aacuagcuuuugccagu

SEQ ID NO: 697 - RNA, 17 nt, Homo sapiens
acuagcuuuugccagua

SEQ ID NO: 698 - RNA, 17 nt, Homo sapiens
cuagcuuuugccaguau

SEQ ID NO: 699 - RNA, 17 nt, Homo sapiens
uugccaguauuaugcau

SEQ ID NO: 700 - RNA, 17 nt, Homo sapiens
gccaguauuaugcauau

SEQ ID NO: 701 - RNA, 17 nt, Homo sapiens
ccaguauuaugcauaua

SEQ ID NO: 702 - RNA, 17 nt, Homo sapiens
uuaugcauauauaaguu

SEQ ID NO: 703 - RNA, 17 nt, Homo sapiens
augcauauauaaguuua

SEQ ID NO: 704 - RNA, 17 nt, Homo sapiens
gcauauauaaguuuaca

SEQ ID NO: 705 - RNA, 17 nt, Homo sapiens
auauaaguuuacaccuu

SEQ ID NO: 706 - RNA, 17 nt, Homo sapiens
uauaaguuuacaccuuu

SEQ ID NO: 707 - RNA, 17 nt, Homo sapiens
auaaguuuacaccuuua

SEQ ID NO: 708 - RNA, 17 nt, Homo sapiens
uuacaccuuuaucuuuc

SEQ ID NO: 709 - RNA, 17 nt, Homo sapiens
uacaccuuuaucuuucc

SEQ ID NO: 710 - RNA, 17 nt, Homo sapiens
acaccuuuaucuuucca

SEQ ID NO: 711 - RNA, 17 nt, Homo sapiens
accuuuaucuuuccaug

SEQ ID NO: 712 - RNA, 17 nt, Homo sapiens
cuuuaucuuuccauggg

SEQ ID NO: 713 - RNA, 17 nt, Homo sapiens
uuuaucuuuccauggga

SEQ ID NO: 714 - RNA, 17 nt, Homo sapiens
uuaucuuuccaugggag

SEQ ID NO: 715 - RNA, 17 nt, Homo sapiens
cagcugcuuuuugugau

SEQ ID NO: 716 - RNA, 17 nt, Homo sapiens
agcugcuuuuugugauu

SEQ ID NO: 717 - RNA, 17 nt, Homo sapiens
gcugcuuuuugugauuu

SEQ ID NO: 718 - RNA, 17 nt, Homo sapiens
cugcuuuuugugauuuu

SEQ ID NO: 719 - RNA, 17 nt, Homo sapiens
uuugugauuuuuuuaau

SEQ ID NO: 720 - RNA, 17 nt, Homo sapiens
uugugauuuuuuuaaua

SEQ ID NO: 721 - RNA, 17 nt, Homo sapiens
ugugauuuuuuuaauag

SEQ ID NO: 722 - RNA, 17 nt, Homo sapiens
gugauuuuuuuaauagu

SEQ ID NO: 723 - RNA, 17 nt, Homo sapiens
ugauuuuuuuaauagug

SEQ ID NO: 724 - RNA, 17 nt, Homo sapiens
gauuuuuuuaauagugc

SEQ ID NO: 725 - RNA, 17 nt, Homo sapiens
auuuuuuuaauagugcu

SEQ ID NO: 726 - RNA, 17 nt, Homo sapiens
uuuuuaauagugcuuuu

SEQ ID NO: 727 - RNA, 17 nt, Homo sapiens
auagugcuuuuuuuuuu

SEQ ID NO: 728 - RNA, 17 nt, Homo sapiens
uagugcuuuuuuuuuuu

SEQ ID NO: 729 - RNA, 17 nt, Homo sapiens
agugcuuuuuuuuuuug

SEQ ID NO: 730 - RNA, 17 nt, Homo sapiens
gugcuuuuuuuuuuuga

SEQ ID NO: 731 - RNA, 17 nt, Homo sapiens
ugcuuuuuuuuuuugac

SEQ ID NO: 732 - RNA, 17 nt, Homo sapiens
gcuuuuuuuuuuugacu

SEQ ID NO: 733 - RNA, 17 nt, Homo sapiens
cuuuuuuuuuuugacua

SEQ ID NO: 734 - RNA, 17 nt, Homo sapiens
uuuuuuuuuuugacuaa

SEQ ID NO: 735 - RNA, 17 nt, Homo sapiens
uuuuuuuuuugacuaac

SEQ ID NO: 736 - RNA, 17 nt, Homo sapiens
uuuuuuuuugacuaaca

SEQ ID NO: 737 - RNA, 17 nt, Homo sapiens
uuuugacuaacaagaau

SEQ ID NO: 738 - RNA, 17 nt, Homo sapiens
aagaauguaacuccaga

SEQ ID NO: 739 - RNA, 17 nt, Homo sapiens
auguaacuccagauaga

SEQ ID NO: 740 - RNA, 17 nt, Homo sapiens
cuccagauagagaaaua

SEQ ID NO: 741 - RNA, 17 nt, Homo sapiens
agagaaauagugacaag

SEQ ID NO: 742 - RNA, 17 nt, Homo sapiens
agaacacuacugcuaaa

SEQ ID NO: 743 - RNA, 17 nt, Homo sapiens
cuacugcuaaauccuca

SEQ ID NO: 744 - RNA, 17 nt, Homo sapiens
ugcuaaauccucauguu

SEQ ID NO: 745 - RNA, 17 nt, Homo sapiens
uaaauccucauguuacu

SEQ ID NO: 746 - RNA, 17 nt, Homo sapiens
ccucauguuacucagug

SEQ ID NO: 747 - RNA, 17 nt, Homo sapiens
cucauguuacucagugu

SEQ ID NO: 748 - RNA, 17 nt, Homo sapiens
auguuacucaguguuag

SEQ ID NO: 749 - RNA, 17 nt, Homo sapiens
cucaguguuagagaaau

SEQ ID NO: 750 - RNA, 17 nt, Homo sapiens
ucaguguuagagaaauc

SEQ ID NO: 751 - RNA, 17 nt, Homo sapiens
agagaaauccuuccuaa

SEQ ID NO: 752 - RNA, 17 nt, Homo sapiens
gaaauccuuccuaaacc

SEQ ID NO: 753 - RNA, 17 nt, Homo sapiens
aaauccuuccuaaaccc

SEQ ID NO: 754 - RNA, 17 nt, Homo sapiens
uccuuccuaaacccaau

SEQ ID NO: 755 - RNA, 17 nt, Homo sapiens
caaugacuucccugcuc

SEQ ID NO: 756 - RNA, 17 nt, Homo sapiens
aaugacuucccugcucc

SEQ ID NO: 757 - RNA, 17 nt, Homo sapiens
ucccugcuccaaccccc

SEQ ID NO: 758 - RNA, 17 nt, Homo sapiens
cgccaccucagggcacg

SEQ ID NO: 759 - RNA, 17 nt, Homo sapiens
ggaccaguuugauugag

SEQ ID NO: 760 - RNA, 17 nt, Homo sapiens
gaccaguuugauugagg

SEQ ID NO: 761 - RNA, 17 nt, Homo sapiens
aguuugauugaggagcu

SEQ ID NO: 762 - RNA, 17 nt, Homo sapiens
gcacugaucacccaaug

SEQ ID NO: 763 - RNA, 17 nt, Homo sapiens
caaugcaucacguaccc

SEQ ID NO: 764 - RNA, 17 nt, Homo sapiens
caucacguaccccacug

SEQ ID NO: 765 - RNA, 17 nt, Homo sapiens
aagcccguuagccccag

SEQ ID NO: 766 - RNA, 17 nt, Homo sapiens
agcccguuagccccagg

SEQ ID NO: 767 - RNA, 17 nt, Homo sapiens
caggggaucacuggcug

SEQ ID NO: 768 - RNA, 17 nt, Homo sapiens
agcaacaucucgggagu

SEQ ID NO: 769 - RNA, 17 nt, Homo sapiens
caacaucucgggagucc

SEQ ID NO: 770 - RNA, 17 nt, Homo sapiens
ucgggaguccucuagca

SEQ ID NO: 771 - RNA, 17 nt, Homo sapiens
ggaguccucuagcaggc

SEQ ID NO: 772 - RNA, 17 nt, Homo sapiens
aguccucuagcaggccu

SEQ ID NO: 773 - RNA, 17 nt, Homo sapiens
gcaggccuaagacaugu

SEQ ID NO: 774 - RNA, 17 nt, Homo sapiens
gaaagaauuugagacgc

SEQ ID NO: 775 - RNA, 17 nt, Homo sapiens
aaagaauuugagacgca

SEQ ID NO: 776 - RNA, 17 nt, Homo sapiens
acggggcucagcaaugc

SEQ ID NO: 777 - RNA, 17 nt, Homo sapiens
aaugccauuucaguggc

SEQ ID NO: 778 - RNA, 17 nt, Homo sapiens
augccauuucaguggcu

SEQ ID NO: 779 - RNA, 17 nt, Homo sapiens
ugccauuucaguggcuu

SEQ ID NO: 780 - RNA, 17 nt, Homo sapiens
caguggcuucccagcuc

SEQ ID NO: 781 - RNA, 17 nt, Homo sapiens
aguggcuucccagcucu

SEQ ID NO: 782 - RNA, 17 nt, Homo sapiens
ucccagcucugacccuu

SEQ ID NO: 783 - RNA, 17 nt, Homo sapiens
cugacccuucuacauuu

SEQ ID NO: 784 - RNA, 17 nt, Homo sapiens
ugacccuucuacauuug

SEQ ID NO: 785 - RNA, 17 nt, Homo sapiens
acccuucuacauuugag

SEQ ID NO: 786 - RNA, 17 nt, Homo sapiens
uucuacauuugagggcc

SEQ ID NO: 787 - RNA, 17 nt, Homo sapiens
ucuacauuugagggccc

SEQ ID NO: 788 - RNA, 17 nt, Homo sapiens
ggggacauuuucuggau

SEQ ID NO: 789 - RNA, 17 nt, Homo sapiens
gggacauuuucuggauu

SEQ ID NO: 790 - RNA, 17 nt, Homo sapiens
ggacauuuucuggauuc

SEQ ID NO: 791 - RNA, 17 nt, Homo sapiens
gacauuuucuggauucu

SEQ ID NO: 792 - RNA, 17 nt, Homo sapiens
uucuggauucugggagg

SEQ ID NO: 793 - RNA, 17 nt, Homo sapiens
ucuggauucugggaggc

SEQ ID NO: 794 - RNA, 17 nt, Homo sapiens
ggacaaauaucuuuuuu

SEQ ID NO: 795 - RNA, 17 nt, Homo sapiens
acaaauaucuuuuuugg

SEQ ID NO: 796 - RNA, 17 nt, Homo sapiens
aaauaucuuuuuuggaa

SEQ ID NO: 797 - RNA, 17 nt, Homo sapiens
aauaucuuuuuuggaac

SEQ ID NO: 798 - RNA, 17 nt, Homo sapiens
auaucuuuuuuggaacu

SEQ ID NO: 799 - RNA, 17 nt, Homo sapiens
uaucuuuuuuggaacua

SEQ ID NO: 800 - RNA, 17 nt, Homo sapiens
aucuuuuuuggaacuaa

SEQ ID NO: 801 - RNA, 17 nt, Homo sapiens
uuggaacuaaagcaaau

SEQ ID NO: 802 - RNA, 17 nt, Homo sapiens
aagcaaauuuuagaccu

SEQ ID NO: 803 - RNA, 17 nt, Homo sapiens
agcaaauuuuagaccuu

SEQ ID NO: 804 - RNA, 17 nt, Homo sapiens
gcaaauuuuagaccuuu

SEQ ID NO: 805 - RNA, 17 nt, Homo sapiens
caaauuuuagaccuuua

SEQ ID NO: 806 - RNA, 17 nt, Homo sapiens
uuagaccuuuaccuaug

SEQ ID NO: 807 - RNA, 17 nt, Homo sapiens
uagaccuuuaccuaugg

SEQ ID NO: 808 - RNA, 17 nt, Homo sapiens
agaccuuuaccuaugga

SEQ ID NO: 809 - RNA, 17 nt, Homo sapiens
cuuuaccuauggaagug

SEQ ID NO: 810 - RNA, 17 nt, Homo sapiens
gaagugguucuaugucc

SEQ ID NO: 811 - RNA, 17 nt, Homo sapiens
aagugguucuaugucca

SEQ ID NO: 812 - RNA, 17 nt, Homo sapiens
gugguucuauguccauu

SEQ ID NO: 813 - RNA, 17 nt, Homo sapiens
uucuauguccauucuca

SEQ ID NO: 814 - RNA, 17 nt, Homo sapiens
auguccauucucauucg

SEQ ID NO: 815 - RNA, 17 nt, Homo sapiens
uguccauucucauucgu

SEQ ID NO: 816 - RNA, 17 nt, Homo sapiens
uccauucucauucgugg

SEQ ID NO: 817 - RNA, 17 nt, Homo sapiens
auucucauucguggcau

SEQ ID NO: 818 - RNA, 17 nt, Homo sapiens
uucucauucguggcaug

SEQ ID NO: 819 - RNA, 17 nt, Homo sapiens
uggcauguuuugauuug

SEQ ID NO: 820 - RNA, 17 nt, Homo sapiens
ggcauguuuugauuugu

SEQ ID NO: 821 - RNA, 17 nt, Homo sapiens
gcauguuuugauuugua

SEQ ID NO: 822 - RNA, 17 nt, Homo sapiens
guuuugauuuguagcac

SEQ ID NO: 823 - RNA, 17 nt, Homo sapiens
uuuugauuuguagcacu

SEQ ID NO: 824 - RNA, 17 nt, Homo sapiens
ugauuuguagcacugag

SEQ ID NO: 825 - RNA, 17 nt, Homo sapiens
guggcacucaacucuga

SEQ ID NO: 826 - RNA, 17 nt, Homo sapiens
acucaacucugagccca

SEQ ID NO: 827 - RNA, 17 nt, Homo sapiens
gagcccauacuuuuggc

SEQ ID NO: 828 - RNA, 17 nt, Homo sapiens
cccauacuuuuggcucc

SEQ ID NO: 829 - RNA, 17 nt, Homo sapiens
ccauacuuuuggcuccu

SEQ ID NO: 830 - RNA, 17 nt, Homo sapiens
cauacuuuuggcuccuc

SEQ ID NO: 831 - RNA, 17 nt, Homo sapiens
uuuuggcuccucuagua

SEQ ID NO: 832 - RNA, 17 nt, Homo sapiens
uggcuccucuaguaaga

SEQ ID NO: 833 - RNA, 17 nt, Homo sapiens
gcuccucuaguaagaug

SEQ ID NO: 834 - RNA, 17 nt, Homo sapiens
ccucuaguaagaugcac

SEQ ID NO: 835 - RNA, 17 nt, Homo sapiens
ugaaaacuuagccagag

SEQ ID NO: 836 - RNA, 17 nt, Homo sapiens
gaaaacuuagccagagu

SEQ ID NO: 837 - RNA, 17 nt, Homo sapiens
gccagaguuagguuguc

SEQ ID NO: 838 - RNA, 17 nt, Homo sapiens
ccagaguuagguugucu

SEQ ID NO: 839 - RNA, 17 nt, Homo sapiens
aguuagguugucuccag

SEQ ID NO: 840 - RNA, 17 nt, Homo sapiens
uagguugucuccaggcc

SEQ ID NO: 841 - RNA, 17 nt, Homo sapiens
gguugucuccaggccau

SEQ ID NO: 842 - RNA, 17 nt, Homo sapiens
gauggccuuacacugaa

SEQ ID NO: 843 - RNA, 17 nt, Homo sapiens
auggccuuacacugaaa

SEQ ID NO: 844 - RNA, 17 nt, Homo sapiens
gaaaaugucacauucua

SEQ ID NO: 845 - RNA, 17 nt, Homo sapiens
ugucacauucuauuuug

SEQ ID NO: 846 - RNA, 17 nt, Homo sapiens
gucacauucuauuuugg

SEQ ID NO: 847 - RNA, 17 nt, Homo sapiens
cacauucuauuuugggu

SEQ ID NO: 848 - RNA, 17 nt, Homo sapiens
cauucuauuuuggguau

SEQ ID NO: 849 - RNA, 17 nt, Homo sapiens
auucuauuuuggguauu

SEQ ID NO: 850 - RNA, 17 nt, Homo sapiens
uucuauuuuggguauua

SEQ ID NO: 851 - RNA, 17 nt, Homo sapiens
uuuuggguauuaauaua

SEQ ID NO: 852 - RNA, 17 nt, Homo sapiens
uuggguauuaauauaua

SEQ ID NO: 853 - RNA, 17 nt, Homo sapiens
uggguauuaauauauag

SEQ ID NO: 854 - RNA, 17 nt, Homo sapiens
guauuaauauauagucc

SEQ ID NO: 855 - RNA, 17 nt, Homo sapiens
auuaauauauaguccag

SEQ ID NO: 856 - RNA, 17 nt, Homo sapiens
uaauauauaguccagac

SEQ ID NO: 857 - RNA, 17 nt, Homo sapiens
uauauaguccagacacu

SEQ ID NO: 858 - RNA, 17 nt, Homo sapiens
cagacacuuaacucaau

SEQ ID NO: 859 - RNA, 17 nt, Homo sapiens
agacacuuaacucaauu

SEQ ID NO: 860 - RNA, 17 nt, Homo sapiens
acuuaacucaauuucuu

SEQ ID NO: 861 - RNA, 17 nt, Homo sapiens
aacucaauuucuuggua

SEQ ID NO: 862 - RNA, 17 nt, Homo sapiens
acucaauuucuugguau

SEQ ID NO: 863 - RNA, 17 nt, Homo sapiens
cucaauuucuugguauu

SEQ ID NO: 864 - RNA, 17 nt, Homo sapiens
caauuucuugguauuau

SEQ ID NO: 865 - RNA, 17 nt, Homo sapiens
uucuugguauuauucug

SEQ ID NO: 866 - RNA, 17 nt, Homo sapiens
cuugguauuauucuguu

SEQ ID NO: 867 - RNA, 17 nt, Homo sapiens
uugguauuauucuguuu

SEQ ID NO: 868 - RNA, 17 nt, Homo sapiens
gguauuauucuguuuug

SEQ ID NO: 869 - RNA, 17 nt, Homo sapiens
guauuauucuguuuugc

SEQ ID NO: 870 - RNA, 17 nt, Homo sapiens
uauucuguuuugcacag

SEQ ID NO: 871 - RNA, 17 nt, Homo sapiens
auucuguuuugcacagu

SEQ ID NO: 872 - RNA, 17 nt, Homo sapiens
uucuguuuugcacaguu

SEQ ID NO: 873 - RNA, 17 nt, Homo sapiens
ugcacaguuaguuguga

SEQ ID NO: 874 - RNA, 17 nt, Homo sapiens
gcacaguuaguugugaa

SEQ ID NO: 875 - RNA, 17 nt, Homo sapiens
caguuaguugugaaaga

SEQ ID NO: 876 - RNA, 17 nt, Homo sapiens
aaugcaguccugaggag

SEQ ID NO: 877 - RNA, 17 nt, Homo sapiens
aggagaguuuucuccau

SEQ ID NO: 878 - RNA, 17 nt, Homo sapiens
ggagaguuuucuccaua

SEQ ID NO: 879 - RNA, 17 nt, Homo sapiens
gagaguuuucuccauau

SEQ ID NO: 880 - RNA, 17 nt, Homo sapiens
agaguuuucuccauauc

SEQ ID NO: 881 - RNA, 17 nt, Homo sapiens
aguuuucuccauaucaa

SEQ ID NO: 882 - RNA, 17 nt, Homo sapiens
uucuccauaucaaaacg

SEQ ID NO: 883 - RNA, 17 nt, Homo sapiens
cuccauaucaaaacgag

SEQ ID NO: 884 - RNA, 17 nt, Homo sapiens
aaaaaggucaauaaggu

SEQ ID NO: 885 - RNA, 17 nt, Homo sapiens
aggucaauaaggucaag

SEQ ID NO: 886 - RNA, 17 nt, Homo sapiens
aauaaggucaagggaag

SEQ ID NO: 887 - RNA, 17 nt, Homo sapiens
gaccccgucucuauacc

SEQ ID NO: 888 - RNA, 17 nt, Homo sapiens
ccccgucucuauaccaa

SEQ ID NO: 889 - RNA, 17 nt, Homo sapiens
ccgucucuauaccaacc

SEQ ID NO: 890 - RNA, 17 nt, Homo sapiens
gucucuauaccaaccaa

SEQ ID NO: 891 - RNA, 17 nt, Homo sapiens
aaaccaauucaccaaca

SEQ ID NO: 892 - RNA, 17 nt, Homo sapiens
aaccaauucaccaacac

SEQ ID NO: 893 - RNA, 17 nt, Homo sapiens
aacacaguugggaccca

SEQ ID NO: 894 - RNA, 17 nt, Homo sapiens
caggaagucagucacgu

SEQ ID NO: 895 - RNA, 17 nt, Homo sapiens
aagucagucacguuucc

SEQ ID NO: 896 - RNA, 17 nt, Homo sapiens
agucacguuuccuuuuc

SEQ ID NO: 897 - RNA, 17 nt, Homo sapiens
gucacguuuccuuuuca

SEQ ID NO: 898 - RNA, 17 nt, Homo sapiens
ucacguuuccuuuucau

SEQ ID NO: 899 - RNA, 17 nt, Homo sapiens
cguuuccuuuucauuua

SEQ ID NO: 900 - RNA, 17 nt, Homo sapiens
guuuccuuuucauuuaa

SEQ ID NO: 901 - RNA, 17 nt, Homo sapiens
uuuccuuuucauuuaau

SEQ ID NO: 902 - RNA, 17 nt, Homo sapiens
uuccuuuucauuuaaug

SEQ ID NO: 903 - RNA, 17 nt, Homo sapiens
cuuuucauuuaaugggg

SEQ ID NO: 904 - RNA, 17 nt, Homo sapiens
uuuucauuuaaugggga

SEQ ID NO: 905 - RNA, 17 nt, Homo sapiens
uuucauuuaauggggau

SEQ ID NO: 906 - RNA, 17 nt, Homo sapiens
auggggauuccacuauc

SEQ ID NO: 907 - RNA, 17 nt, Homo sapiens
uggggauuccacuaucu

SEQ ID NO: 908 - RNA, 17 nt, Homo sapiens
auuccacuaucucacac

SEQ ID NO: 909 - RNA, 17 nt, Homo sapiens
uccacuaucucacacua

SEQ ID NO: 910 - RNA, 17 nt, Homo sapiens
cacuaucucacacuaau

SEQ ID NO: 911 - RNA, 17 nt, Homo sapiens
cucacacuaaucugaaa

SEQ ID NO: 912 - RNA, 17 nt, Homo sapiens
acacuaaucugaaagga

SEQ ID NO: 913 - RNA, 17 nt, Homo sapiens
aagagcauuagcuggcg

SEQ ID NO: 914 - RNA, 17 nt, Homo sapiens
agagcauuagcuggcgc

SEQ ID NO: 915 - RNA, 17 nt, Homo sapiens
uggcgcauauuaagcac

SEQ ID NO: 916 - RNA, 17 nt, Homo sapiens
gcgcauauuaagcacuu

SEQ ID NO: 917 - RNA, 17 nt, Homo sapiens
cgcauauuaagcacuuu

SEQ ID NO: 918 - RNA, 17 nt, Homo sapiens
uaagcacuuuaagcucc

SEQ ID NO: 919 - RNA, 17 nt, Homo sapiens
aagcacuuuaagcuccu

SEQ ID NO: 920 - RNA, 17 nt, Homo sapiens
agcacuuuaagcuccuu

SEQ ID NO: 921 - RNA, 17 nt, Homo sapiens
uuuaagcuccuugagua

SEQ ID NO: 922 - RNA, 17 nt, Homo sapiens
aagcuccuugaguaaaa

SEQ ID NO: 923 - RNA, 17 nt, Homo sapiens
ccuugaguaaaaaggug

SEQ ID NO: 924 - RNA, 17 nt, Homo sapiens
aaggugguauguaauuu

SEQ ID NO: 925 - RNA, 17 nt, Homo sapiens
ugguauguaauuuaugc

SEQ ID NO: 926 - RNA, 17 nt, Homo sapiens
uauguaauuuaugcaag

SEQ ID NO: 927 - RNA, 17 nt, Homo sapiens
auguaauuuaugcaagg

SEQ ID NO: 928 - RNA, 17 nt, Homo sapiens
uguaauuuaugcaaggu

SEQ ID NO: 929 - RNA, 17 nt, Homo sapiens
ugcaagguauuucucca

SEQ ID NO: 930 - RNA, 17 nt, Homo sapiens
caagguauuucuccagu

SEQ ID NO: 931 - RNA, 17 nt, Homo sapiens
aagguauuucuccaguu

SEQ ID NO: 932 - RNA, 17 nt, Homo sapiens
agguauuucuccaguug

SEQ ID NO: 933 - RNA, 17 nt, Homo sapiens
guauuucuccaguuggg

SEQ ID NO: 934 - RNA, 17 nt, Homo sapiens
ucuccaguugggacuca

SEQ ID NO: 935 - RNA, 17 nt, Homo sapiens
uugggacucaggauauu

SEQ ID NO: 936 - RNA, 17 nt, Homo sapiens
cucaggauauuaguuaa

SEQ ID NO: 937 - RNA, 17 nt, Homo sapiens
caggauauuaguuaaug

SEQ ID NO: 938 - RNA, 17 nt, Homo sapiens
aggauauuaguuaauga

SEQ ID NO: 939 - RNA, 17 nt, Homo sapiens
auauuaguuaaugagcc

SEQ ID NO: 940 - RNA, 17 nt, Homo sapiens
uauuaguuaaugagcca

SEQ ID NO: 941 - RNA, 17 nt, Homo sapiens
ugagccaucacuagaag

SEQ ID NO: 942 - RNA, 17 nt, Homo sapiens
ccaucacuagaagaaaa

SEQ ID NO: 943 - RNA, 17 nt, Homo sapiens
aagcccauuuucaacug

SEQ ID NO: 944 - RNA, 17 nt, Homo sapiens
agcccauuuucaacugc

SEQ ID NO: 945 - RNA, 17 nt, Homo sapiens
gcccauuuucaacugcu

SEQ ID NO: 946 - RNA, 17 nt, Homo sapiens
cccauuuucaacugcuu

SEQ ID NO: 947 - RNA, 17 nt, Homo sapiens
caacugcuuugaaacuu

SEQ ID NO: 948 - RNA, 17 nt, Homo sapiens
aacugcuuugaaacuug

SEQ ID NO: 949 - RNA, 17 nt, Homo sapiens
uugaaacuugccugggg

SEQ ID NO: 950 - RNA, 17 nt, Homo sapiens
ccuggggucugagcaug

SEQ ID NO: 951 - RNA, 17 nt, Homo sapiens
augggaauagggagaca

SEQ ID NO: 952 - RNA, 17 nt, Homo sapiens
gacaggguaggaaaggg

SEQ ID NO: 953 - RNA, 17 nt, Homo sapiens
gggcgccuacucuucag

SEQ ID NO: 954 - RNA, 17 nt, Homo sapiens
cgccuacucuucagggu

SEQ ID NO: 955 - RNA, 17 nt, Homo sapiens
ccuacucuucagggucu

SEQ ID NO: 956 - RNA, 17 nt, Homo sapiens
cuacucuucagggucua

SEQ ID NO: 957 - RNA, 17 nt, Homo sapiens
uucagggucuaaagauc

SEQ ID NO: 958 - RNA, 17 nt, Homo sapiens
cagggucuaaagaucaa

SEQ ID NO: 959 - RNA, 17 nt, Homo sapiens
cuaaagaucaagugggc

SEQ ID NO: 960 - RNA, 17 nt, Homo sapiens
gugggccuuggaucgcu

SEQ ID NO: 961 - RNA, 17 nt, Homo sapiens
ccuuggaucgcuaagcu

SEQ ID NO: 962 - RNA, 17 nt, Homo sapiens
ggaucgcuaagcuggcu

SEQ ID NO: 963 - RNA, 17 nt, Homo sapiens
agcuggcucuguuugau

SEQ ID NO: 964 - RNA, 17 nt, Homo sapiens
ggcucuguuugaugcua

SEQ ID NO: 965 - RNA, 17 nt, Homo sapiens
gcucuguuugaugcuau

SEQ ID NO: 966 - RNA, 17 nt, Homo sapiens
uugaugcuauuuaugca

SEQ ID NO: 967 - RNA, 17 nt, Homo sapiens
gaugcuauuuaugcaag

SEQ ID NO: 968 - RNA, 17 nt, Homo sapiens
augcuauuuaugcaagu

SEQ ID NO: 969 - RNA, 17 nt, Homo sapiens
ugcuauuuaugcaaguu

SEQ ID NO: 970 - RNA, 17 nt, Homo sapiens
augcaaguuagggucua

SEQ ID NO: 971 - RNA, 17 nt, Homo sapiens
ugcaaguuagggucuau

SEQ ID NO: 972 - RNA, 17 nt, Homo sapiens
guuagggucuauguauu

SEQ ID NO: 973 - RNA, 17 nt, Homo sapiens
uagggucuauguauuua

SEQ ID NO: 974 - RNA, 17 nt, Homo sapiens
gucuauguauuuaggau

SEQ ID NO: 975 - RNA, 17 nt, Homo sapiens
cuauguauuuaggaugc

SEQ ID NO: 976 - RNA, 17 nt, Homo sapiens
uauguauuuaggaugcg

SEQ ID NO: 977 - RNA, 17 nt, Homo sapiens
auguauuuaggaugcgc

SEQ ID NO: 978 - RNA, 17 nt, Homo sapiens
augcgccuacucuucag

SEQ ID NO: 979 - RNA, 17 nt, Homo sapiens
cuauguauuuaggaugu

SEQ ID NO: 980 - RNA, 17 nt, Homo sapiens
uauguauuuaggauguc

SEQ ID NO: 981 - RNA, 17 nt, Homo sapiens
auguauuuaggaugucu

SEQ ID NO: 982 - RNA, 17 nt, Homo sapiens
uaggaugucugcaccuu

SEQ ID NO: 983 - RNA, 17 nt, Homo sapiens
cugcaccuucugcagcc

SEQ ID NO: 984 - RNA, 17 nt, Homo sapiens
ugcaccuucugcagcca

SEQ ID NO: 985 - RNA, 17 nt, Homo sapiens
cagccagucagaagcug

SEQ ID NO: 986 - RNA, 17 nt, Homo sapiens
caguggauugcugcuuc

SEQ ID NO: 987 - RNA, 17 nt, Homo sapiens
uugcugcuucuugggga

SEQ ID NO: 988 - RNA, 17 nt, Homo sapiens
ugcugcuucuuggggag

SEQ ID NO: 989 - RNA, 17 nt, Homo sapiens
cugcuucuuggggagaa

SEQ ID NO: 990 - RNA, 17 nt, Homo sapiens
agaagaguaugcuuccu

SEQ ID NO: 991 - RNA, 17 nt, Homo sapiens
aguaugcuuccuuuuau

SEQ ID NO: 992 - RNA, 17 nt, Homo sapiens
guaugcuuccuuuuauc

SEQ ID NO: 993 - RNA, 17 nt, Homo sapiens
ugcuuccuuuuauccau

SEQ ID NO: 994 - RNA, 17 nt, Homo sapiens
gcuuccuuuuauccaug

SEQ ID NO: 995 - RNA, 17 nt, Homo sapiens
cuuccuuuuauccaugu

SEQ ID NO: 996 - RNA, 17 nt, Homo sapiens
uuccuuuuauccaugua

SEQ ID NO: 997 - RNA, 17 nt, Homo sapiens
ccuuuuauccauguaau

SEQ ID NO: 998 - RNA, 17 nt, Homo sapiens
auccauguaauuuaacu

SEQ ID NO: 999 - RNA, 17 nt, Homo sapiens
cauguaauuuaacugua

SEQ ID NO: 1000 - RNA, 17 nt, Homo sapiens
auguaauuuaacuguag

SEQ ID NO: 1001 - RNA, 17 nt, Homo sapiens
uguaauuuaacuguaga

SEQ ID NO: 1002 - RNA, 17 nt, Homo sapiens
uuaacuguagaaccuga

SEQ ID NO: 1003 - RNA, 17 nt, Homo sapiens
ccugagcucuaaguaac

SEQ ID NO: 1004 - RNA, 17 nt, Homo sapiens
ugagcucuaaguaaccg

SEQ ID NO: 1005 - RNA, 17 nt, Homo sapiens
cucuaaguaaccgaaga

SEQ ID NO: 1006 - RNA, 17 nt, Homo sapiens
aagaauguaugccucug

SEQ ID NO: 1007 - RNA, 17 nt, Homo sapiens
guaugccucuguucuua

SEQ ID NO: 1008 - RNA, 17 nt, Homo sapiens
gccucuguucuuaugug

SEQ ID NO: 1009 - RNA, 17 nt, Homo sapiens
ccucuguucuuaugugc

SEQ ID NO: 1010 - RNA, 17 nt, Homo sapiens
ucuguucuuaugugcca

SEQ ID NO: 1011 - RNA, 17 nt, Homo sapiens
cuguucuuaugugccac

SEQ ID NO: 1012 - RNA, 17 nt, Homo sapiens
ugccacauccuuguuua

SEQ ID NO: 1013 - RNA, 17 nt, Homo sapiens
cacauccuuguuuaaag

SEQ ID NO: 1014 - RNA, 17 nt, Homo sapiens
auccuuguuuaaaggcu

SEQ ID NO: 1015 - RNA, 17 nt, Homo sapiens
uccuuguuuaaaggcuc

SEQ ID NO: 1016 - RNA, 17 nt, Homo sapiens
ccuuguuuaaaggcucu

SEQ ID NO: 1017 - RNA, 17 nt, Homo sapiens
uaaaggcucucuguaug

SEQ ID NO: 1018 - RNA, 17 nt, Homo sapiens
aaggcucucuguaugaa

SEQ ID NO: 1019 - RNA, 17 nt, Homo sapiens
cucucuguaugaagaga

SEQ ID NO: 1020 - RNA, 17 nt, Homo sapiens
gggaccgucaucagcac

SEQ ID NO: 1021 - RNA, 17 nt, Homo sapiens
accgucaucagcacauu

SEQ ID NO: 1022 - RNA, 17 nt, Homo sapiens
cagcacauucccuagug

SEQ ID NO: 1023 - RNA, 17 nt, Homo sapiens
agcacauucccuaguga

SEQ ID NO: 1024 - RNA, 17 nt, Homo sapiens
cauucccuagugagccu

SEQ ID NO: 1025 - RNA, 17 nt, Homo sapiens
gugagccuacuggcucc

SEQ ID NO: 1026 - RNA, 17 nt, Homo sapiens
uacuggcuccuggcagc

SEQ ID NO: 1027 - RNA, 17 nt, Homo sapiens
cagcggcuuuuguggaa

SEQ ID NO: 1028 - RNA, 17 nt, Homo sapiens
agcggcuuuuguggaag

SEQ ID NO: 1029 - RNA, 17 nt, Homo sapiens
gcggcuuuuguggaaga

SEQ ID NO: 1030 - RNA, 17 nt, Homo sapiens
ggaagacucacuagcca

SEQ ID NO: 1031 - RNA, 17 nt, Homo sapiens
gacucacuagccagaag

SEQ ID NO: 1032 - RNA, 17 nt, Homo sapiens
gggacaguccucuccac

SEQ ID NO: 1033 - RNA, 17 nt, Homo sapiens
acaguccucuccaccaa

SEQ ID NO: 1034 - RNA, 17 nt, Homo sapiens
aguccucuccaccaaga

SEQ ID NO: 1035 - RNA, 17 nt, Homo sapiens
accaagaucuaaaucca

SEQ ID NO: 1036 - RNA, 17 nt, Homo sapiens
caagaucuaaauccaaa

SEQ ID NO: 1037 - RNA, 17 nt, Homo sapiens
aucuaaauccaaacaaa

SEQ ID NO: 1038 - RNA, 17 nt, Homo sapiens
agcaggcuagagccaga

SEQ ID NO: 1039 - RNA, 17 nt, Homo sapiens
ggacaaaucuuuguugu

SEQ ID NO: 1040 - RNA, 17 nt, Homo sapiens
acaaaucuuuguuguuc

SEQ ID NO: 1041 - RNA, 17 nt, Homo sapiens
caaaucuuuguuguucc

SEQ ID NO: 1042 - RNA, 17 nt, Homo sapiens
aucuuuguuguuccucu

SEQ ID NO: 1043 - RNA, 17 nt, Homo sapiens
uuuguuguuccucuucu

SEQ ID NO: 1044 - RNA, 17 nt, Homo sapiens
uuguuguuccucuucuu

SEQ ID NO: 1045 - RNA, 17 nt, Homo sapiens
uuguuccucuucuuuac

SEQ ID NO: 1046 - RNA, 17 nt, Homo sapiens
guuccucuucuuuacac

SEQ ID NO: 1047 - RNA, 17 nt, Homo sapiens
uuccucuucuuuacaca

SEQ ID NO: 1048 - RNA, 17 nt, Homo sapiens
ccucuucuuuacacaua

SEQ ID NO: 1049 - RNA, 17 nt, Homo sapiens
cucuucuuuacacauac

SEQ ID NO: 1050 - RNA, 17 nt, Homo sapiens
ucuucuuuacacauacg

SEQ ID NO: 1051 - RNA, 17 nt, Homo sapiens
uuacacauacgcaaacc

SEQ ID NO: 1052 - RNA, 17 nt, Homo sapiens
cuggcaauuuuauaaau

SEQ ID NO: 1053 - RNA, 17 nt, Homo sapiens
uggcaauuuuauaaauc

SEQ ID NO: 1054 - RNA, 17 nt, Homo sapiens
ggcaauuuuauaaauca

SEQ ID NO: 1055 - RNA, 17 nt, Homo sapiens
gcaauuuuauaaaucag

SEQ ID NO: 1056 - RNA, 17 nt, Homo sapiens
aauuuuauaaaucaggu

SEQ ID NO: 1057 - RNA, 17 nt, Homo sapiens
uuauaaaucagguaacu

SEQ ID NO: 1058 - RNA, 17 nt, Homo sapiens
aaucagguaacuggaag

SEQ ID NO: 1059 - RNA, 17 nt, Homo sapiens
aaggagguuaaacucag

SEQ ID NO: 1060 - RNA, 17 nt, Homo sapiens
aggagguuaaacucaga

SEQ ID NO: 1061 - RNA, 17 nt, Homo sapiens
guuaaacucagaaaaaa

SEQ ID NO: 1062 - RNA, 17 nt, Homo sapiens
gaagaccucagucaauu

SEQ ID NO: 1063 - RNA, 17 nt, Homo sapiens
accucagucaauucucu

SEQ ID NO: 1064 - RNA, 17 nt, Homo sapiens
cagucaauucucuacuu

SEQ ID NO: 1065 - RNA, 17 nt, Homo sapiens
agucaauucucuacuuu

SEQ ID NO: 1066 - RNA, 17 nt, Homo sapiens
ucaauucucuacuuuuu

SEQ ID NO: 1067 - RNA, 17 nt, Homo sapiens
aauucucuacuuuuuuu

SEQ ID NO: 1068 - RNA, 17 nt, Homo sapiens
ucucuacuuuuuuuuuu

SEQ ID NO: 1069 - RNA, 17 nt, Homo sapiens
cucuacuuuuuuuuuuu

SEQ ID NO: 1070 - RNA, 17 nt, Homo sapiens
ucuacuuuuuuuuuuuu

SEQ ID NO: 1071 - RNA, 17 nt, Homo sapiens
cuacuuuuuuuuuuuuu

SEQ ID NO: 1072 - RNA, 17 nt, Homo sapiens
uacuuuuuuuuuuuuuu

SEQ ID NO: 1073 - RNA, 17 nt, Homo sapiens
acuuuuuuuuuuuuuuu

SEQ ID NO: 1074 - RNA, 17 nt, Homo sapiens
cuuuuuuuuuuuuuuuu

SEQ ID NO: 1075 - RNA, 17 nt, Homo sapiens
uuuuuuuuuuuuuuuuc

SEQ ID NO: 1076 - RNA, 17 nt, Homo sapiens
uuuuuuuuuuuuuuucc

SEQ ID NO: 1077 - RNA, 17 nt, Homo sapiens
uuuuuuuuuuuuuucca

SEQ ID NO: 1078 - RNA, 17 nt, Homo sapiens
uuuuuuuuuuuuuccaa

SEQ ID NO: 1079 - RNA, 17 nt, Homo sapiens
uuuuuuuuuuuuccaaa

SEQ ID NO: 1080 - RNA, 17 nt, Homo sapiens
uuuuuuuuuuuccaaau

SEQ ID NO: 1081 - RNA, 17 nt, Homo sapiens
uuuuuuuuuuccaaauc

SEQ ID NO: 1082 - RNA, 17 nt, Homo sapiens
uuuuuuuuuccaaauca

SEQ ID NO: 1083 - RNA, 17 nt, Homo sapiens
uuuuuuuuccaaaucag

SEQ ID NO: 1084 - RNA, 17 nt, Homo sapiens
uuccaaaucagauaaua

SEQ ID NO: 1085 - RNA, 17 nt, Homo sapiens
aaucagauaauagccca

SEQ ID NO: 1086 - RNA, 17 nt, Homo sapiens
cagauaauagcccagca

SEQ ID NO: 1087 - RNA, 17 nt, Homo sapiens
cagcaaauagugauaac

SEQ ID NO: 1088 - RNA, 17 nt, Homo sapiens
auagugauaacaaauaa

SEQ ID NO: 1089 - RNA, 17 nt, Homo sapiens
uaacaaauaaaaccuua

SEQ ID NO: 1090 - RNA, 17 nt, Homo sapiens
uaaaaccuuagcuguuc

SEQ ID NO: 1091 - RNA, 17 nt, Homo sapiens
aaaaccuuagcuguuca

SEQ ID NO: 1092 - RNA, 17 nt, Homo sapiens
uuagcuguucaugucuu

SEQ ID NO: 1093 - RNA, 17 nt, Homo sapiens
uagcuguucaugucuug

SEQ ID NO: 1094 - RNA, 17 nt, Homo sapiens
guucaugucuugauuuc

SEQ ID NO: 1095 - RNA, 17 nt, Homo sapiens
ucaugucuugauuucaa

SEQ ID NO: 1096 - RNA, 17 nt, Homo sapiens
gucuugauuucaauaau

SEQ ID NO: 1097 - RNA, 17 nt, Homo sapiens
ucuugauuucaauaauu

SEQ ID NO: 1098 - RNA, 17 nt, Homo sapiens
cuugauuucaauaauua

SEQ ID NO: 1099 - RNA, 17 nt, Homo sapiens
auuucaauaauuaauuc

SEQ ID NO: 1100 - RNA, 17 nt, Homo sapiens
ucaauaauuaauucuua

SEQ ID NO: 1101 - RNA, 17 nt, Homo sapiens
caauaauuaauucuuaa

SEQ ID NO: 1102 - RNA, 17 nt, Homo sapiens
uaauuaauucuuaauca

SEQ ID NO: 1103 - RNA, 17 nt, Homo sapiens
aauuaauucuuaaucau

SEQ ID NO: 1104 - RNA, 17 nt, Homo sapiens
uuaauucuuaaucauua

SEQ ID NO: 1105 - RNA, 17 nt, Homo sapiens
uaauucuuaaucauuaa

SEQ ID NO: 1106 - RNA, 17 nt, Homo sapiens
uucuuaaucauuaagag

SEQ ID NO: 1107 - RNA, 17 nt, Homo sapiens
uuaaucauuaagagacc

SEQ ID NO: 1108 - RNA, 17 nt, Homo sapiens
uaaucauuaagagacca

SEQ ID NO: 1109 - RNA, 17 nt, Homo sapiens
gagaccauaauaaauac

SEQ ID NO: 1110 - RNA, 17 nt, Homo sapiens
accauaauaaauacucc

SEQ ID NO: 1111 - RNA, 17 nt, Homo sapiens
uaauaaauacuccuuuu

SEQ ID NO: 1112 - RNA, 17 nt, Homo sapiens
uaaauacuccuuuucaa

SEQ ID NO: 1113 - RNA, 17 nt, Homo sapiens
auacuccuuuucaagag

SEQ ID NO: 1114 - RNA, 17 nt, Homo sapiens
uacuccuuuucaagaga

SEQ ID NO: 1115 - RNA, 17 nt, Homo sapiens
acuccuuuucaagagaa

SEQ ID NO: 1116 - RNA, 17 nt, Homo sapiens
cuccuuuucaagagaaa

SEQ ID NO: 1117 - RNA, 17 nt, Homo sapiens
aaaaccauuagaauugu

SEQ ID NO: 1118 - RNA, 17 nt, Homo sapiens
aaaccauuagaauuguu

SEQ ID NO: 1119 - RNA, 17 nt, Homo sapiens
auuagaauuguuacuca

SEQ ID NO: 1120 - RNA, 17 nt, Homo sapiens
agaauuguuacucagcu

SEQ ID NO: 1121 - RNA, 17 nt, Homo sapiens
gaauuguuacucagcuc

SEQ ID NO: 1122 - RNA, 17 nt, Homo sapiens
uuguuacucagcuccuu

SEQ ID NO: 1123 - RNA, 17 nt, Homo sapiens
acucagcuccuucaaac

SEQ ID NO: 1124 - RNA, 17 nt, Homo sapiens
cagcuccuucaaacuca

SEQ ID NO: 1125 - RNA, 17 nt, Homo sapiens
agcuccuucaaacucag

SEQ ID NO: 1126 - RNA, 17 nt, Homo sapiens
uucaaacucagguuugu

SEQ ID NO: 1127 - RNA, 17 nt, Homo sapiens
acucagguuuguagcau

SEQ ID NO: 1128 - RNA, 17 nt, Homo sapiens
cucagguuuguagcaua

SEQ ID NO: 1129 - RNA, 17 nt, Homo sapiens
agguuuguagcauacau

SEQ ID NO: 1130 - RNA, 17 nt, Homo sapiens
uguagcauacaugaguc

SEQ ID NO: 1131 - RNA, 17 nt, Homo sapiens
acaugaguccauccauc

SEQ ID NO: 1132 - RNA, 17 nt, Homo sapiens
gaguccauccaucaguc

SEQ ID NO: 1133 - RNA, 17 nt, Homo sapiens
ccauccaucagucaaag

SEQ ID NO: 1134 - RNA, 17 nt, Homo sapiens
ccaucagucaaagaaug

SEQ ID NO: 1135 - RNA, 17 nt, Homo sapiens
agaaugguuccaucugg

SEQ ID NO: 1136 - RNA, 17 nt, Homo sapiens
gaaugguuccaucugga

SEQ ID NO: 1137 - RNA, 17 nt, Homo sapiens
gguuccaucuggagucu

SEQ ID NO: 1138 - RNA, 17 nt, Homo sapiens
ucuggagucuuaaugua

SEQ ID NO: 1139 - RNA, 17 nt, Homo sapiens
uggagucuuaauguaga

SEQ ID NO: 1140 - RNA, 17 nt, Homo sapiens
ggagucuuaauguagaa

SEQ ID NO: 1141 - RNA, 17 nt, Homo sapiens
cuuaauguagaaagaaa

SEQ ID NO: 1142 - RNA, 17 nt, Homo sapiens
uggagacuuguaauaau

SEQ ID NO: 1143 - RNA, 17 nt, Homo sapiens
agacuuguaauaaugag

SEQ ID NO: 1144 - RNA, 17 nt, Homo sapiens
cuuguaauaaugagcua

SEQ ID NO: 1145 - RNA, 17 nt, Homo sapiens
aaugagcuaguuacaaa

SEQ ID NO: 1146 - RNA, 17 nt, Homo sapiens
gagcuaguuacaaagug

SEQ ID NO: 1147 - RNA, 17 nt, Homo sapiens
agcuaguuacaaagugc

SEQ ID NO: 1148 - RNA, 17 nt, Homo sapiens
aaagugcuuguucauua

SEQ ID NO: 1149 - RNA, 17 nt, Homo sapiens
gugcuuguucauuaaaa

SEQ ID NO: 1150 - RNA, 17 nt, Homo sapiens
ugcuuguucauuaaaau

SEQ ID NO: 1151 - RNA, 17 nt, Homo sapiens
uuguucauuaaaauagc

SEQ ID NO: 1152 - RNA, 17 nt, Homo sapiens
uguucauuaaaauagca

SEQ ID NO: 1153 - RNA, 17 nt, Homo sapiens
auuaaaauagcacugaa

SEQ ID NO: 1154 - RNA, 17 nt, Homo sapiens
cugaaaauugaaacaug

SEQ ID NO: 1155 - RNA, 17 nt, Homo sapiens
acaugaauuaacugaua

SEQ ID NO: 1156 - RNA, 17 nt, Homo sapiens
caugaauuaacugauaa

SEQ ID NO: 1157 - RNA, 17 nt, Homo sapiens
uaacugauaauauucca

SEQ ID NO: 1158 - RNA, 17 nt, Homo sapiens
cugauaauauuccaauc

SEQ ID NO: 1159 - RNA, 17 nt, Homo sapiens
gauaauauuccaaucau

SEQ ID NO: 1160 - RNA, 17 nt, Homo sapiens
auaauauuccaaucauu

SEQ ID NO: 1161 - RNA, 17 nt, Homo sapiens
auuccaaucauuugcca

SEQ ID NO: 1162 - RNA, 17 nt, Homo sapiens
ccaaucauuugccauuu

SEQ ID NO: 1163 - RNA, 17 nt, Homo sapiens
caaucauuugccauuua

SEQ ID NO: 1164 - RNA, 17 nt, Homo sapiens
uuugccauuuaugacaa

SEQ ID NO: 1165 - RNA, 17 nt, Homo sapiens
uugccauuuaugacaaa

SEQ ID NO: 1166 - RNA, 17 nt, Homo sapiens
ugccauuuaugacaaaa

SEQ ID NO: 1167 - RNA, 17 nt, Homo sapiens
aaaaugguuggcacuaa

SEQ ID NO: 1168 - RNA, 17 nt, Homo sapiens
uuggcacuaacaaagaa

SEQ ID NO: 1169 - RNA, 17 nt, Homo sapiens
cgagcacuuccuuucag

SEQ ID NO: 1170 - RNA, 17 nt, Homo sapiens
gagcacuuccuuucaga

SEQ ID NO: 1171 - RNA, 17 nt, Homo sapiens
cacuuccuuucagaguu

SEQ ID NO: 1172 - RNA, 17 nt, Homo sapiens
acuuccuuucagaguuu

SEQ ID NO: 1173 - RNA, 17 nt, Homo sapiens
cuuccuuucagaguuuc

SEQ ID NO: 1174 - RNA, 17 nt, Homo sapiens
uucagaguuucugagau

SEQ ID NO: 1175 - RNA, 17 nt, Homo sapiens
ucagaguuucugagaua

SEQ ID NO: 1176 - RNA, 17 nt, Homo sapiens
cagaguuucugagauaa

SEQ ID NO: 1177 - RNA, 17 nt, Homo sapiens
ucugagauaauguacgu

SEQ ID NO: 1178 - RNA, 17 nt, Homo sapiens
gauaauguacguggaac

SEQ ID NO: 1179 - RNA, 17 nt, Homo sapiens
ggaacagucugggugga

SEQ ID NO: 1180 - RNA, 17 nt, Homo sapiens
gugcaagucugugucuu

SEQ ID NO: 1181 - RNA, 17 nt, Homo sapiens
gucugugucuugucagu

SEQ ID NO: 1182 - RNA, 17 nt, Homo sapiens
cugugucuugucagucc

SEQ ID NO: 1183 - RNA, 17 nt, Homo sapiens
ugucuugucaguccaag

SEQ ID NO: 1184 - RNA, 17 nt, Homo sapiens
uugucaguccaagaagu

SEQ ID NO: 1185 - RNA, 17 nt, Homo sapiens
cgagauguuaauuuuag

SEQ ID NO: 1186 - RNA, 17 nt, Homo sapiens
gagauguuaauuuuagg

SEQ ID NO: 1187 - RNA, 17 nt, Homo sapiens
auguuaauuuuagggac

SEQ ID NO: 1188 - RNA, 17 nt, Homo sapiens
uguuaauuuuagggacc

SEQ ID NO: 1189 - RNA, 17 nt, Homo sapiens
guuaauuuuagggaccc

SEQ ID NO: 1190 - RNA, 17 nt, Homo sapiens
uuaauuuuagggacccg

SEQ ID NO: 1191 - RNA, 17 nt, Homo sapiens
ccgugccuuguuuccua

SEQ ID NO: 1192 - RNA, 17 nt, Homo sapiens
ugccuuguuuccuagcc

SEQ ID NO: 1193 - RNA, 17 nt, Homo sapiens
gccuuguuuccuagccc

SEQ ID NO: 1194 - RNA, 17 nt, Homo sapiens
ccuuguuuccuagccca

SEQ ID NO: 1195 - RNA, 17 nt, Homo sapiens
uguuuccuagcccacaa

SEQ ID NO: 1196 - RNA, 17 nt, Homo sapiens
gcaaacaucaaacagau

SEQ ID NO: 1197 - RNA, 17 nt, Homo sapiens
aaacagauacucgcuag

SEQ ID NO: 1198 - RNA, 17 nt, Homo sapiens
cagauacucgcuagccu

SEQ ID NO: 1199 - RNA, 17 nt, Homo sapiens
uacucgcuagccucauu

SEQ ID NO: 1200 - RNA, 17 nt, Homo sapiens
gcuagccucauuuaaau

SEQ ID NO: 1201 - RNA, 17 nt, Homo sapiens
agccucauuuaaauuga

SEQ ID NO: 1202 - RNA, 17 nt, Homo sapiens
gccucauuuaaauugau

SEQ ID NO: 1203 - RNA, 17 nt, Homo sapiens
ccucauuuaaauugauu

SEQ ID NO: 1204 - RNA, 17 nt, Homo sapiens
auuuaaauugauuaaag

SEQ ID NO: 1205 - RNA, 17 nt, Homo sapiens
aaauugauuaaaggagg

SEQ ID NO: 1206 - RNA, 17 nt, Homo sapiens
aauugauuaaaggagga

SEQ ID NO: 1207 - RNA, 17 nt, Homo sapiens
gagugcaucuuuggccg

SEQ ID NO: 1208 - RNA, 17 nt, Homo sapiens
gugcaucuuuggccgac

SEQ ID NO: 1209 - RNA, 17 nt, Homo sapiens
ugcaucuuuggccgaca

SEQ ID NO: 1210 - RNA, 17 nt, Homo sapiens
agugguguaacugugug

SEQ ID NO: 1211 - RNA, 17 nt, Homo sapiens
guggguguauguguguu

SEQ ID NO: 1212 - RNA, 17 nt, Homo sapiens
auguguguuuugugcau

SEQ ID NO: 1213 - RNA, 17 nt, Homo sapiens
uguguguuuugugcaua

SEQ ID NO: 1214 - RNA, 17 nt, Homo sapiens
guguguuuugugcauaa

SEQ ID NO: 1215 - RNA, 17 nt, Homo sapiens
uugugcauaacuauuua

SEQ ID NO: 1216 - RNA, 17 nt, Homo sapiens
gcauaacuauuuaagga

SEQ ID NO: 1217 - RNA, 17 nt, Homo sapiens
auaacuauuuaaggaaa

SEQ ID NO: 1218 - RNA, 17 nt, Homo sapiens
uaacuauuuaaggaaac

SEQ ID NO: 1219 - RNA, 17 nt, Homo sapiens
aacuauuuaaggaaacu

SEQ ID NO: 1220 - RNA, 17 nt, Homo sapiens
acuggaauuuuaaaguu

SEQ ID NO: 1221 - RNA, 17 nt, Homo sapiens
cuggaauuuuaaaguua

SEQ ID NO: 1222 - RNA, 17 nt, Homo sapiens
uggaauuuuaaaguuac

SEQ ID NO: 1223 - RNA, 17 nt, Homo sapiens
ggaauuuuaaaguuacu

SEQ ID NO: 1224 - RNA, 17 nt, Homo sapiens
uuuaaaguuacuuuuau

SEQ ID NO: 1225 - RNA, 17 nt, Homo sapiens
uuaaaguuacuuuuaua

SEQ ID NO: 1226 - RNA, 17 nt, Homo sapiens
aaguuacuuuuauacaa

SEQ ID NO: 1227 - RNA, 17 nt, Homo sapiens
aguuacuuuuauacaaa

SEQ ID NO: 1228 - RNA, 17 nt, Homo sapiens
guuacuuuuauacaaac

SEQ ID NO: 1229 - RNA, 17 nt, Homo sapiens
uuacuuuuauacaaacc

SEQ ID NO: 1230 - RNA, 17 nt, Homo sapiens
acuuuuauacaaaccaa

SEQ ID NO: 1231 - RNA, 17 nt, Homo sapiens
ccaagaauauaugcuac

SEQ ID NO: 1232 - RNA, 17 nt, Homo sapiens
aagaauauaugcuacag

SEQ ID NO: 1233 - RNA, 17 nt, Homo sapiens
uauaugcuacagauaua

SEQ ID NO: 1234 - RNA, 17 nt, Homo sapiens
cuacagauauaagacag

SEQ ID NO: 1235 - RNA, 17 nt, Homo sapiens
acagauauaagacagac

SEQ ID NO: 1236 - RNA, 17 nt, Homo sapiens
gacaugguuugguccua

SEQ ID NO: 1237 - RNA, 17 nt, Homo sapiens
acaugguuugguccuau

SEQ ID NO: 1238 - RNA, 17 nt, Homo sapiens
gguuugguccuauauuu

SEQ ID NO: 1239 - RNA, 17 nt, Homo sapiens
uugguccuauauuucua

SEQ ID NO: 1240 - RNA, 17 nt, Homo sapiens
gguccuauauuucuagu

SEQ ID NO: 1241 - RNA, 17 nt, Homo sapiens
uccuauauuucuaguca

SEQ ID NO: 1242 - RNA, 17 nt, Homo sapiens
ccuauauuucuagucau

SEQ ID NO: 1243 - RNA, 17 nt, Homo sapiens
cuauauuucuagucaug

SEQ ID NO: 1244 - RNA, 17 nt, Homo sapiens
auauuucuagucaugau

SEQ ID NO: 1245 - RNA, 17 nt, Homo sapiens
uuucuagucaugaugaa

SEQ ID NO: 1246 - RNA, 17 nt, Homo sapiens
augaauguauuuuguau

SEQ ID NO: 1247 - RNA, 17 nt, Homo sapiens
gaauguauuuuguauac

SEQ ID NO: 1248 - RNA, 17 nt, Homo sapiens
aauguauuuuguauacc

SEQ ID NO: 1249 - RNA, 17 nt, Homo sapiens
auguauuuuguauacca

SEQ ID NO: 1250 - RNA, 17 nt, Homo sapiens
uauuuuguauaccaucu

SEQ ID NO: 1251 - RNA, 17 nt, Homo sapiens
uuuuguauaccaucuuc

SEQ ID NO: 1252 - RNA, 17 nt, Homo sapiens
uauaccaucuucauaua

SEQ ID NO: 1253 - RNA, 17 nt, Homo sapiens
uaccaucuucauauaau

SEQ ID NO: 1254 - RNA, 17 nt, Homo sapiens
accaucuucauauaaua

SEQ ID NO: 1255 - RNA, 17 nt, Homo sapiens
aucuucauauaauauac

SEQ ID NO: 1256 - RNA, 17 nt, Homo sapiens
cuucauauaauauacuu

SEQ ID NO: 1257 - RNA, 17 nt, Homo sapiens
cauauaauauacuuaaa

SEQ ID NO: 1258 - RNA, 17 nt, Homo sapiens
uauaauauacuuaaaaa

SEQ ID NO: 1259 - RNA, 17 nt, Homo sapiens
aauauacuuaaaaauau

SEQ ID NO: 1260 - RNA, 17 nt, Homo sapiens
auauacuuaaaaauauu

SEQ ID NO: 1261 - RNA, 17 nt, Homo sapiens
uuaaaaauauuucuuaa

SEQ ID NO: 1262 - RNA, 17 nt, Homo sapiens
aaaaauauuucuuaauu

SEQ ID NO: 1263 - RNA, 17 nt, Homo sapiens
aaaauauuucuuaauug

SEQ ID NO: 1264 - RNA, 17 nt, Homo sapiens
aaauauuucuuaauugg

SEQ ID NO: 1265 - RNA, 17 nt, Homo sapiens
auauuucuuaauuggga

SEQ ID NO: 1266 - RNA, 17 nt, Homo sapiens
uauuucuuaauugggau

SEQ ID NO: 1267 - RNA, 17 nt, Homo sapiens
uucuuaauugggauuug

SEQ ID NO: 1268 - RNA, 17 nt, Homo sapiens
auugggauuuguaaucg

SEQ ID NO: 1269 - RNA, 17 nt, Homo sapiens
uugggauuuguaaucgu

SEQ ID NO: 1270 - RNA, 17 nt, Homo sapiens
ggauuuguaaucguacc

SEQ ID NO: 1271 - RNA, 17 nt, Homo sapiens
uuuguaaucguaccaac

SEQ ID NO: 1272 - RNA, 17 nt, Homo sapiens
guaaucguaccaacuua

SEQ ID NO: 1273 - RNA, 17 nt, Homo sapiens
uaccaacuuaauugaua

SEQ ID NO: 1274 - RNA, 17 nt, Homo sapiens
accaacuuaauugauaa

SEQ ID NO: 1275 - RNA, 17 nt, Homo sapiens
aacuuaauugauaaacu

SEQ ID NO: 1276 - RNA, 17 nt, Homo sapiens
uaauugauaaacuuggc

SEQ ID NO: 1277 - RNA, 17 nt, Homo sapiens
gauaaacuuggcaacug

SEQ ID NO: 1278 - RNA, 17 nt, Homo sapiens
caacugcuuuuauguuc

SEQ ID NO: 1279 - RNA, 17 nt, Homo sapiens
aacugcuuuuauguucu

SEQ ID NO: 1280 - RNA, 17 nt, Homo sapiens
acugcuuuuauguucug

SEQ ID NO: 1281 - RNA, 17 nt, Homo sapiens
cugcuuuuauguucugu

SEQ ID NO: 1282 - RNA, 17 nt, Homo sapiens
uuuuauguucugucucc

SEQ ID NO: 1283 - RNA, 17 nt, Homo sapiens
uuuauguucugucuccu

SEQ ID NO: 1284 - RNA, 17 nt, Homo sapiens
uguucugucuccuucca

SEQ ID NO: 1285 - RNA, 17 nt, Homo sapiens
uucugucuccuuccaua

SEQ ID NO: 1286 - RNA, 17 nt, Homo sapiens
ugucuccuuccauaaau

SEQ ID NO: 1287 - RNA, 17 nt, Homo sapiens
gucuccuuccauaaauu

SEQ ID NO: 1288 - RNA, 17 nt, Homo sapiens
ccuuccauaaauuuuuc

SEQ ID NO: 1289 - RNA, 17 nt, Homo sapiens
ccauaaauuuuucaaaa

SEQ ID NO: 1290 - RNA, 17 nt, Homo sapiens
cauaaauuuuucaaaau

SEQ ID NO: 1291 - RNA, 17 nt, Homo sapiens
auaaauuuuucaaaaua

SEQ ID NO: 1292 - RNA, 17 nt, Homo sapiens
uaaauuuuucaaaauac

SEQ ID NO: 1293 - RNA, 17 nt, Homo sapiens
aaauuuuucaaaauacu

SEQ ID NO: 1294 - RNA, 17 nt, Homo sapiens
uucaaaauacuaauuca

SEQ ID NO: 1295 - RNA, 17 nt, Homo sapiens
aaaauacuaauucaaca

SEQ ID NO: 1296 - RNA, 17 nt, Homo sapiens
auacuaauucaacaaag

SEQ ID NO: 1297 - RNA, 17 nt, Homo sapiens
uacuaauucaacaaaga

SEQ ID NO: 1298 - RNA, 17 nt, Homo sapiens
aaaaagcucuuuuuuuu

SEQ ID NO: 1299 - RNA, 17 nt, Homo sapiens
aaagcucuuuuuuuucc

SEQ ID NO: 1300 - RNA, 17 nt, Homo sapiens
aagcucuuuuuuuuccu

SEQ ID NO: 1301 - RNA, 17 nt, Homo sapiens
agcucuuuuuuuuccua

SEQ ID NO: 1302 - RNA, 17 nt, Homo sapiens
gcucuuuuuuuuccuaa

SEQ ID NO: 1303 - RNA, 17 nt, Homo sapiens
cucuuuuuuuuccuaaa

SEQ ID NO: 1304 - RNA, 17 nt, Homo sapiens
ucuuuuuuuuccuaaaa

SEQ ID NO: 1305 - RNA, 17 nt, Homo sapiens
cuuuuuuuuccuaaaau

SEQ ID NO: 1306 - RNA, 17 nt, Homo sapiens
uuuuuuuuccuaaaaua

SEQ ID NO: 1307 - RNA, 17 nt, Homo sapiens
uuuuuccuaaaauaaac

SEQ ID NO: 1308 - RNA, 17 nt, Homo sapiens
ccuaaaauaaacucaaa

SEQ ID NO: 1309 - RNA, 17 nt, Homo sapiens
aauaaacucaaauuuau

SEQ ID NO: 1310 - RNA, 17 nt, Homo sapiens
acucaaauuuauccuug

SEQ ID NO: 1311 - RNA, 17 nt, Homo sapiens
cucaaauuuauccuugu

SEQ ID NO: 1312 - RNA, 17 nt, Homo sapiens
ucaaauuuauccuuguu

SEQ ID NO: 1313 - RNA, 17 nt, Homo sapiens
aaauuuauccuuguuua

SEQ ID NO: 1314 - RNA, 17 nt, Homo sapiens
uuuauccuuguuuagag

SEQ ID NO: 1315 - RNA, 17 nt, Homo sapiens
auccuuguuuagagcag

SEQ ID NO: 1316 - RNA, 17 nt, Homo sapiens
uccuuguuuagagcaga

SEQ ID NO: 1317 - RNA, 17 nt, Homo sapiens
ccuuguuuagagcagag

SEQ ID NO: 1318 - RNA, 17 nt, Homo sapiens
agaaaaauuaagaaaaa

SEQ ID NO: 1319 - RNA, 17 nt, Homo sapiens
gaaaaauuaagaaaaac

SEQ ID NO: 1320 - RNA, 17 nt, Homo sapiens
gaaaaacuuugaaaugg

SEQ ID NO: 1321 - RNA, 17 nt, Homo sapiens
aaaaacuuugaaauggu

SEQ ID NO: 1322 - RNA, 17 nt, Homo sapiens
gaaauggucucaaaaaa

SEQ ID NO: 1323 - RNA, 17 nt, Homo sapiens
aauggucucaaaaaauu

SEQ ID NO: 1324 - RNA, 17 nt, Homo sapiens
caaaaaauugcuaaaua

SEQ ID NO: 1325 - RNA, 17 nt, Homo sapiens
aaauugcuaaauauuuu

SEQ ID NO: 1326 - RNA, 17 nt, Homo sapiens
ugcuaaauauuuucaau

SEQ ID NO: 1327 - RNA, 17 nt, Homo sapiens
cuaaauauuuucaaugg

SEQ ID NO: 1328 - RNA, 17 nt, Homo sapiens
uaaauauuuucaaugga

SEQ ID NO: 1329 - RNA, 17 nt, Homo sapiens
aaauauuuucaauggaa

SEQ ID NO: 1330 - RNA, 17 nt, Homo sapiens
aauauuuucaauggaaa

SEQ ID NO: 1331 - RNA, 17 nt, Homo sapiens
ggaaaacuaaauguuag

SEQ ID NO: 1332 - RNA, 17 nt, Homo sapiens
cuaaauguuaguuuagc

SEQ ID NO: 1333 - RNA, 17 nt, Homo sapiens
uaaauguuaguuuagcu

SEQ ID NO: 1334 - RNA, 17 nt, Homo sapiens
auguuaguuuagcugau

SEQ ID NO: 1335 - RNA, 17 nt, Homo sapiens
uguuaguuuagcugauu

SEQ ID NO: 1336 - RNA, 17 nt, Homo sapiens
guuaguuuagcugauug

SEQ ID NO: 1337 - RNA, 17 nt, Homo sapiens
uagcugauuguaugggg

SEQ ID NO: 1338 - RNA, 17 nt, Homo sapiens
cugauuguaugggguuu

SEQ ID NO: 1339 - RNA, 17 nt, Homo sapiens
uaugggguuuucgaacc

SEQ ID NO: 1340 - RNA, 17 nt, Homo sapiens
augggguuuucgaaccu

SEQ ID NO: 1341 - RNA, 17 nt, Homo sapiens
ugggguuuucgaaccuu

SEQ ID NO: 1342 - RNA, 17 nt, Homo sapiens
gggguuuucgaaccuuu

SEQ ID NO: 1343 - RNA, 17 nt, Homo sapiens
ucgaaccuuucacuuuu

SEQ ID NO: 1344 - RNA, 17 nt, Homo sapiens
cgaaccuuucacuuuuu

SEQ ID NO: 1345 - RNA, 17 nt, Homo sapiens
gaaccuuucacuuuuug

SEQ ID NO: 1346 - RNA, 17 nt, Homo sapiens
cuuucacuuuuuguuug

SEQ ID NO: 1347 - RNA, 17 nt, Homo sapiens
uuucacuuuuuguuugu

SEQ ID NO: 1348 - RNA, 17 nt, Homo sapiens
uucacuuuuuguuuguu

SEQ ID NO: 1349 - RNA, 17 nt, Homo sapiens
ucacuuuuuguuuguuu

SEQ ID NO: 1350 - RNA, 17 nt, Homo sapiens
cuuuuuguuuguuuuac

SEQ ID NO: 1351 - RNA, 17 nt, Homo sapiens
uuuuuguuuguuuuacc

SEQ ID NO: 1352 - RNA, 17 nt, Homo sapiens
uuguuuguuuuaccuau

SEQ ID NO: 1353 - RNA, 17 nt, Homo sapiens
uguuuguuuuaccuauu

SEQ ID NO: 1354 - RNA, 17 nt, Homo sapiens
guuuguuuuaccuauuu

SEQ ID NO: 1355 - RNA, 17 nt, Homo sapiens
uuuguuuuaccuauuuc

SEQ ID NO: 1356 - RNA, 17 nt, Homo sapiens
uuuuaccuauuucacaa

SEQ ID NO: 1357 - RNA, 17 nt, Homo sapiens
uuaccuauuucacaacu

SEQ ID NO: 1358 - RNA, 17 nt, Homo sapiens
uaccuauuucacaacug

SEQ ID NO: 1359 - RNA, 17 nt, Homo sapiens
accuauuucacaacugu

SEQ ID NO: 1360 - RNA, 17 nt, Homo sapiens
aacuguguaaauugcca

SEQ ID NO: 1361 - RNA, 17 nt, Homo sapiens
guguaaauugccaauaa

SEQ ID NO: 1362 - RNA, 17 nt, Homo sapiens
uugccaauaauuccugu

SEQ ID NO: 1363 - RNA, 17 nt, Homo sapiens
ccaauaauuccugucca

SEQ ID NO: 1364 - RNA, 17 nt, Homo sapiens
caauaauuccuguccau

SEQ ID NO: 1365 - RNA, 17 nt, Homo sapiens
auuccuguccaugaaaa

SEQ ID NO: 1366 - RNA, 17 nt, Homo sapiens
augcaaauuauccagug

SEQ ID NO: 1367 - RNA, 17 nt, Homo sapiens
ugcaaauuauccagugu

SEQ ID NO: 1368 - RNA, 17 nt, Homo sapiens
caaauuauccaguguag

SEQ ID NO: 1369 - RNA, 17 nt, Homo sapiens
uccaguguagauauauu

SEQ ID NO: 1370 - RNA, 17 nt, Homo sapiens
guguagauauauuugac

SEQ ID NO: 1371 - RNA, 17 nt, Homo sapiens
guagauauauuugacca

SEQ ID NO: 1372 - RNA, 17 nt, Homo sapiens
agauauauuugaccauc

SEQ ID NO: 1373 - RNA, 17 nt, Homo sapiens
gauauauuugaccauca

SEQ ID NO: 1374 - RNA, 17 nt, Homo sapiens
uugaccaucacccuaug

SEQ ID NO: 1375 - RNA, 17 nt, Homo sapiens
aucacccuauggauauu

SEQ ID NO: 1376 - RNA, 17 nt, Homo sapiens
cuauggauauuggcuag

SEQ ID NO: 1377 - RNA, 17 nt, Homo sapiens
auggauauuggcuaguu

SEQ ID NO: 1378 - RNA, 17 nt, Homo sapiens
uauuggcuaguuuugcc

SEQ ID NO: 1379 - RNA, 17 nt, Homo sapiens
uggcuaguuuugccuuu

SEQ ID NO: 1380 - RNA, 17 nt, Homo sapiens
ggcuaguuuugccuuua

SEQ ID NO: 1381 - RNA, 17 nt, Homo sapiens
gcuaguuuugccuuuau

SEQ ID NO: 1382 - RNA, 17 nt, Homo sapiens
uuuugccuuuauuaagc

SEQ ID NO: 1383 - RNA, 17 nt, Homo sapiens
uuugccuuuauuaagca

SEQ ID NO: 1384 - RNA, 17 nt, Homo sapiens
uugccuuuauuaagcaa

SEQ ID NO: 1385 - RNA, 17 nt, Homo sapiens
gccuuuauuaagcaaau

SEQ ID NO: 1386 - RNA, 17 nt, Homo sapiens
ccuuuauuaagcaaauu

SEQ ID NO: 1387 - RNA, 17 nt, Homo sapiens
aagcaaauucauuucag

SEQ ID NO: 1388 - RNA, 17 nt, Homo sapiens
agcaaauucauuucagc

SEQ ID NO: 1389 - RNA, 17 nt, Homo sapiens
aaauucauuucagccug

SEQ ID NO: 1390 - RNA, 17 nt, Homo sapiens
aauucauuucagccuga

SEQ ID NO: 1391 - RNA, 17 nt, Homo sapiens
auucauuucagccugaa

SEQ ID NO: 1392 - RNA, 17 nt, Homo sapiens
cugaaugucugccuaua

SEQ ID NO: 1393 - RNA, 17 nt, Homo sapiens
gucugccuauauauucu

SEQ ID NO: 1394 - RNA, 17 nt, Homo sapiens
cugccuauauauucucu

SEQ ID NO: 1395 - RNA, 17 nt, Homo sapiens
gccuauauauucucugc

SEQ ID NO: 1396 - RNA, 17 nt, Homo sapiens
cuauauauucucugcuc

SEQ ID NO: 1397 - RNA, 17 nt, Homo sapiens
uauauauucucugcucu

SEQ ID NO: 1398 - RNA, 17 nt, Homo sapiens
uauauucucugcucuuu

SEQ ID NO: 1399 - RNA, 17 nt, Homo sapiens
ucucugcucuuuguauu

SEQ ID NO: 1400 - RNA, 17 nt, Homo sapiens
ucugcucuuuguauucu

SEQ ID NO: 1401 - RNA, 17 nt, Homo sapiens
cugcucuuuguauucuc

SEQ ID NO: 1402 - RNA, 17 nt, Homo sapiens
cucuuuguauucuccuu

SEQ ID NO: 1403 - RNA, 17 nt, Homo sapiens
cuuuguauucuccuuug

SEQ ID NO: 1404 - RNA, 17 nt, Homo sapiens
uuuguauucuccuuuga

SEQ ID NO: 1405 - RNA, 17 nt, Homo sapiens
uguauucuccuuugaac

SEQ ID NO: 1406 - RNA, 17 nt, Homo sapiens
auucuccuuugaacccg

SEQ ID NO: 1407 - RNA, 17 nt, Homo sapiens
uucuccuuugaacccgu

SEQ ID NO: 1408 - RNA, 17 nt, Homo sapiens
gaacccguuaaaacauc

SEQ ID NO: 1409 - RNA, 17 nt, Homo sapiens
aacccguuaaaacaucc

SEQ ID NO: 1410 - RNA, 17 nt, Homo sapiens
uaaaacauccuguggca

SEQ ID NO: 1411 - RNA, 18 nt, Homo sapiens
ccucucggcuccuccccg

SEQ ID NO: 1412 - RNA, 18 nt, Homo sapiens
ggcggcggcucggagcgg

SEQ ID NO: 1413 - RNA, 18 nt, Homo sapiens
gaggacggacucuggcgg

SEQ ID NO: 1414 - RNA, 18 nt, Homo sapiens
ucuggcggccgggucguu

SEQ ID NO: 1415 - RNA, 18 nt, Homo sapiens
ggguccugcugugcgcgc

SEQ ID NO: 1416 - RNA, 18 nt, Homo sapiens
gcgcgcugcucagcuguc

SEQ ID NO: 1417 - RNA, 18 nt, Homo sapiens
cugcucagcugucugcuu

SEQ ID NO: 1418 - RNA, 18 nt, Homo sapiens
cucagcugucugcuucuc

SEQ ID NO: 1419 - RNA, 18 nt, Homo sapiens
gcugucugcuucucacag

SEQ ID NO: 1420 - RNA, 18 nt, Homo sapiens
ggaagcagcccauaaaug

SEQ ID NO: 1421 - RNA, 18 nt, Homo sapiens
uaaaucugccuguggaag

SEQ ID NO: 1422 - RNA, 18 nt, Homo sapiens
gaacacagcucaagcaaa

SEQ ID NO: 1423 - RNA, 18 nt, Homo sapiens
uucuacagcugcaaauau

SEQ ID NO: 1424 - RNA, 18 nt, Homo sapiens
auucccugccggguuacg

SEQ ID NO: 1425 - RNA, 18 nt, Homo sapiens
gaucccugauggaaaacg

SEQ ID NO: 1426 - RNA, 18 nt, Homo sapiens
ggcuucugaccugugaag

SEQ ID NO: 1427 - RNA, 18 nt, Homo sapiens
uuacccugaugaaaaaaa

SEQ ID NO: 1428 - RNA, 18 nt, Homo sapiens
gcaagcggucuuaccggc

SEQ ID NO: 1429 - RNA, 18 nt, Homo sapiens
cuuaccggcucucuauga

SEQ ID NO: 1430 - RNA, 18 nt, Homo sapiens
gaaaucugcucgcuauuu

SEQ ID NO: 1431 - RNA, 18 nt, Homo sapiens
aaccccagauuuacgaaa

SEQ ID NO: 1432 - RNA, 18 nt, Homo sapiens
guuuccagacccggcucu

SEQ ID NO: 1433 - RNA, 18 nt, Homo sapiens
agacccggcucucuaccc

SEQ ID NO: 1434 - RNA, 18 nt, Homo sapiens
aaauccugacuuguaccg

SEQ ID NO: 1435 - RNA, 18 nt, Homo sapiens
uguggcugacucuagaau

SEQ ID NO: 1436 - RNA, 18 nt, Homo sapiens
uaucacagaugugccaaa

SEQ ID NO: 1437 - RNA, 18 nt, Homo sapiens
aaaugccgacggaaggag

SEQ ID NO: 1438 - RNA, 18 nt, Homo sapiens
ugaaacugucuugcacag

SEQ ID NO: 1439 - RNA, 18 nt, Homo sapiens
aucagcaguuccaccacu

SEQ ID NO: 1440 - RNA, 18 nt, Homo sapiens
agccucagaucacuuggu

SEQ ID NO: 1441 - RNA, 18 nt, Homo sapiens
gcacgcuguuuauugaaa

SEQ ID NO: 1442 - RNA, 18 nt, Homo sapiens
ccucacuguucaaggaac

SEQ ID NO: 1443 - RNA, 18 nt, Homo sapiens
uggagcugaucacucuaa

SEQ ID NO: 1444 - RNA, 18 nt, Homo sapiens
aaagacugacuaccuauc

SEQ ID NO: 1445 - RNA, 18 nt, Homo sapiens
ggacccagaugaaguucc

SEQ ID NO: 1446 - RNA, 18 nt, Homo sapiens
gugagcggcucccuuaug

SEQ ID NO: 1447 - RNA, 18 nt, Homo sapiens
cgugccggacuguggcug

SEQ ID NO: 1448 - RNA, 18 nt, Homo sapiens
aagcucugaugacugagc

SEQ ID NO: 1449 - RNA, 18 nt, Homo sapiens
uuaaccugcugggagccu

SEQ ID NO: 1450 - RNA, 18 nt, Homo sapiens
ggccucugauggugauug

SEQ ID NO: 1451 - RNA, 18 nt, Homo sapiens
agcuccggcuuucaggaa

SEQ ID NO: 1452 - RNA, 18 nt, Homo sapiens
ggauucugacgguuucua

SEQ ID NO: 1453 - RNA, 18 nt, Homo sapiens
ucugacgguuucuacaag

SEQ ID NO: 1454 - RNA, 18 nt, Homo sapiens
aagaucugauuucuuaca

SEQ ID NO: 1455 - RNA, 18 nt, Homo sapiens
ucuuacaguuuucaagug

SEQ ID NO: 1456 - RNA, 18 nt, Homo sapiens
aguuccugucuuccagaa

SEQ ID NO: 1457 - RNA, 18 nt, Homo sapiens
gaaccccgauuaugugag

SEQ ID NO: 1458 - RNA, 18 nt, Homo sapiens
uuuugcagucgccugagg

SEQ ID NO: 1459 - RNA, 18 nt, Homo sapiens
ucuaucagaucaugcugg

SEQ ID NO: 1460 - RNA, 18 nt, Homo sapiens
cuggacugcuggcacaga

SEQ ID NO: 1461 - RNA, 18 nt, Homo sapiens
aacuccugccuucucuga

SEQ ID NO: 1462 - RNA, 18 nt, Homo sapiens
uauuucagcuccgaaguu

SEQ ID NO: 1463 - RNA, 18 nt, Homo sapiens
aagcucugaugaugucag

SEQ ID NO: 1464 - RNA, 18 nt, Homo sapiens
gcacucuguuggccucuc

SEQ ID NO: 1465 - RNA, 18 nt, Homo sapiens
cggggcugucugauguca

SEQ ID NO: 1466 - RNA, 18 nt, Homo sapiens
gcugucugaugucagcag

SEQ ID NO: 1467 - RNA, 18 nt, Homo sapiens
aggcccaguuucugccau

SEQ ID NO: 1468 - RNA, 18 nt, Homo sapiens
cauuccagcugugggcac

SEQ ID NO: 1469 - RNA, 18 nt, Homo sapiens
gcgugcugcuccccgccc

SEQ ID NO: 1470 - RNA, 18 nt, Homo sapiens
gcuccccgcccccagacu

SEQ ID NO: 1471 - RNA, 18 nt, Homo sapiens
gcccccagacuacaacuc

SEQ ID NO: 1472 - RNA, 18 nt, Homo sapiens
ggagccagcugcuuuuug

SEQ ID NO: 1473 - RNA, 18 nt, Homo sapiens
gccagcugcuuuuuguga

SEQ ID NO: 1474 - RNA, 18 nt, Homo sapiens
cuucccugcuccaacccc

SEQ ID NO: 1475 - RNA, 18 nt, Homo sapiens
aggaccaguuugauugag

SEQ ID NO: 1476 - RNA, 18 nt, Homo sapiens
cugcacugaucacccaau

SEQ ID NO: 1477 - RNA, 18 nt, Homo sapiens
ugggccagcccugcagcc

SEQ ID NO: 1478 - RNA, 18 nt, Homo sapiens
cccugcagcccaaaaccc

SEQ ID NO: 1479 - RNA, 18 nt, Homo sapiens
cuucccagcucugacccu

SEQ ID NO: 1480 - RNA, 18 nt, Homo sapiens
cagcucugacccuucuac

SEQ ID NO: 1481 - RNA, 18 nt, Homo sapiens
aggagcagauggacagcg

SEQ ID NO: 1482 - RNA, 18 nt, Homo sapiens
uuauucuguuuugcacag

SEQ ID NO: 1483 - RNA, 18 nt, Homo sapiens
aaaugcaguccugaggag

SEQ ID NO: 1484 - RNA, 18 nt, Homo sapiens
gagggcugauggaggaaa

SEQ ID NO: 1485 - RNA, 18 nt, Homo sapiens
agaccccgucucuauacc

SEQ ID NO: 1486 - RNA, 18 nt, Homo sapiens
caacacaguugggaccca

SEQ ID NO: 1487 - RNA, 18 nt, Homo sapiens
uucuccaguugggacuca

SEQ ID NO: 1488 - RNA, 18 nt, Homo sapiens
uucaacugcuuugaaacu

SEQ ID NO: 1489 - RNA, 18 nt, Homo sapiens
uggcucuguuugaugcua

SEQ ID NO: 1490 - RNA, 18 nt, Homo sapiens
gauugcugcuucuugggg

SEQ ID NO: 1491 - RNA, 18 nt, Homo sapiens
ugccucuguucuuaugug

SEQ ID NO: 1492 - RNA, 18 nt, Homo sapiens
ggcagcggcuuuugugga

SEQ ID NO: 1493 - RNA, 18 nt, Homo sapiens
ugggacaguccucuccac

SEQ ID NO: 1494 - RNA, 18 nt, Homo sapiens
ugugacagcuggcaauuu

SEQ ID NO: 1495 - RNA, 18 nt, Homo sapiens
cuuagcuguucaugucuu

SEQ ID NO: 1496 - RNA, 18 nt, Homo sapiens
uuacucagcuccuucaaa

SEQ ID NO: 1497 - RNA, 18 nt, Homo sapiens
uggaacagucugggugga

SEQ ID NO: 1498 - RNA, 18 nt, Homo sapiens
cuugucaguccaagaagu

SEQ ID NO: 1499 - RNA, 18 nt, Homo sapiens
ggcaacugcuuuuauguu

SEQ ID NO: 1500 - RNA, 18 nt, Homo sapiens
auguucugucuccuucca

SEQ ID NO: 1501 - RNA, 18 nt, Homo sapiens
uuuagcugauuguauggg

SEQ ID NO: 1502 - RNA, 18 nt, Homo sapiens
aauuccuguccaugaaaa

SEQ ID NO: 1503 - RNA, 18 nt, Homo sapiens
cauuucagccugaauguc

SEQ ID NO: 1504 - RNA, 18 nt, Homo sapiens
aaugucugccuauauauu

SEQ ID NO: 1505 - RNA, 18 nt, Homo sapiens
auucucugcucuuuguau

SEQ ID NO: 1506 - RNA, 17 nt, Homo sapiens
cuggccgucgcccugug

SEQ ID NO: 1507 - RNA, 17 nt, Homo sapiens
cuguggcucugcgugga

SEQ ID NO: 1508 - RNA, 17 nt, Homo sapiens
ggccgccucuguggguu

SEQ ID NO: 1509 - RNA, 17 nt, Homo sapiens
cuguggguuugccuagu

SEQ ID NO: 1510 - RNA, 17 nt, Homo sapiens
uguggguuugccuagug

SEQ ID NO: 1511 - RNA, 17 nt, Homo sapiens
guuugccuaguguuucu

SEQ ID NO: 1512 - RNA, 17 nt, Homo sapiens
ccuaguguuucucuuga

SEQ ID NO: 1513 - RNA, 17 nt, Homo sapiens
cuaguguuucucuugau

SEQ ID NO: 1514 - RNA, 17 nt, Homo sapiens
uaguguuucucuugauc

SEQ ID NO: 1515 - RNA, 17 nt, Homo sapiens
guguuucucuugaucug

SEQ ID NO: 1516 - RNA, 17 nt, Homo sapiens
guuucucuugaucugcc

SEQ ID NO: 1517 - RNA, 17 nt, Homo sapiens
cucuugaucugcccagg

SEQ ID NO: 1518 - RNA, 17 nt, Homo sapiens
cccaggcucagcauaca

SEQ ID NO: 1519 - RNA, 17 nt, Homo sapiens
cucagcauacaaaaaga

SEQ ID NO: 1520 - RNA, 17 nt, Homo sapiens
aaagacauacuuacaau

SEQ ID NO: 1521 - RNA, 17 nt, Homo sapiens
gacauacuuacaauuaa

SEQ ID NO: 1522 - RNA, 17 nt, Homo sapiens
acauacuuacaauuaag

SEQ ID NO: 1523 - RNA, 17 nt, Homo sapiens
cuuacaauuaaggcuaa

SEQ ID NO: 1524 - RNA, 17 nt, Homo sapiens
uuacaauuaaggcuaau

SEQ ID NO: 1525 - RNA, 17 nt, Homo sapiens
uuaaggcuaauacaacu

SEQ ID NO: 1526 - RNA, 17 nt, Homo sapiens
aggcuaauacaacucuu

SEQ ID NO: 1527 - RNA, 17 nt, Homo sapiens
auacaacucuucaaauu

SEQ ID NO: 1528 - RNA, 17 nt, Homo sapiens
acaacucuucaaauuac

SEQ ID NO: 1529 - RNA, 17 nt, Homo sapiens
caacucuucaaauuacu

SEQ ID NO: 1530 - RNA, 17 nt, Homo sapiens
cuucaaauuacuugcag

SEQ ID NO: 1531 - RNA, 17 nt, Homo sapiens
uucaaauuacuugcagg

SEQ ID NO: 1532 - RNA, 17 nt, Homo sapiens
aaauuacuugcagggga

SEQ ID NO: 1533 - RNA, 17 nt, Homo sapiens
gagggacuuggacuggc

SEQ ID NO: 1534 - RNA, 17 nt, Homo sapiens
gacuggcuuuggcccaa

SEQ ID NO: 1535 - RNA, 17 nt, Homo sapiens
acuggcuuuggcccaau

SEQ ID NO: 1536 - RNA, 17 nt, Homo sapiens
ggcccaauaaucagagu

SEQ ID NO: 1537 - RNA, 17 nt, Homo sapiens
ccaauaaucagaguggc

SEQ ID NO: 1538 - RNA, 17 nt, Homo sapiens
gauggccucuucuguaa

SEQ ID NO: 1539 - RNA, 17 nt, Homo sapiens
uggccucuucuguaaga

SEQ ID NO: 1540 - RNA, 17 nt, Homo sapiens
ggccucuucuguaagac

SEQ ID NO: 1541 - RNA, 17 nt, Homo sapiens
ucuucuguaagacacuc

SEQ ID NO: 1542 - RNA, 17 nt, Homo sapiens
aagacacucacaauucc

SEQ ID NO: 1543 - RNA, 17 nt, Homo sapiens
cucacaauuccaaaagu

SEQ ID NO: 1544 - RNA, 17 nt, Homo sapiens
ucacaauuccaaaagug

SEQ ID NO: 1545 - RNA, 17 nt, Homo sapiens
aaagugaucggaaauga

SEQ ID NO: 1546 - RNA, 17 nt, Homo sapiens
uggagccuacaagugcu

SEQ ID NO: 1547 - RNA, 17 nt, Homo sapiens
caagugcuucuaccggg

SEQ ID NO: 1548 - RNA, 17 nt, Homo sapiens
aagugcuucuaccggga

SEQ ID NO: 1549 - RNA, 17 nt, Homo sapiens
gugcuucuaccgggaaa

SEQ ID NO: 1550 - RNA, 17 nt, Homo sapiens
aacugacuuggccucgg

SEQ ID NO: 1551 - RNA, 17 nt, Homo sapiens
cuuggccucggucauuu

SEQ ID NO: 1552 - RNA, 17 nt, Homo sapiens
gccucggucauuuaugu

SEQ ID NO: 1553 - RNA, 17 nt, Homo sapiens
ucggucauuuaugucua

SEQ ID NO: 1554 - RNA, 17 nt, Homo sapiens
cggucauuuaugucuau

SEQ ID NO: 1555 - RNA, 17 nt, Homo sapiens
ggucauuuaugucuaug

SEQ ID NO: 1556 - RNA, 17 nt, Homo sapiens
auuuaugucuauguuca

SEQ ID NO: 1557 - RNA, 17 nt, Homo sapiens
uuaugucuauguucaag

SEQ ID NO: 1558 - RNA, 17 nt, Homo sapiens
gucuauguucaagauua

SEQ ID NO: 1559 - RNA, 17 nt, Homo sapiens
ucuauguucaagauuac

SEQ ID NO: 1560 - RNA, 17 nt, Homo sapiens
uucaagauuacagaucu

SEQ ID NO: 1561 - RNA, 17 nt, Homo sapiens
ucaagauuacagaucuc

SEQ ID NO: 1562 - RNA, 17 nt, Homo sapiens
uuacagaucuccauuua

SEQ ID NO: 1563 - RNA, 17 nt, Homo sapiens
acagaucuccauuuauu

SEQ ID NO: 1564 - RNA, 17 nt, Homo sapiens
aucuccauuuauugcuu

SEQ ID NO: 1565 - RNA, 17 nt, Homo sapiens
ucuccauuuauugcuuc

SEQ ID NO: 1566 - RNA, 17 nt, Homo sapiens
cuccauuuauugcuucu

SEQ ID NO: 1567 - RNA, 17 nt, Homo sapiens
ccauuuauugcuucugu

SEQ ID NO: 1568 - RNA, 17 nt, Homo sapiens
uuauugcuucuguuagu

SEQ ID NO: 1569 - RNA, 17 nt, Homo sapiens
uauugcuucuguuagug

SEQ ID NO: 1570 - RNA, 17 nt, Homo sapiens
gcuucuguuagugacca

SEQ ID NO: 1571 - RNA, 17 nt, Homo sapiens
cuucuguuagugaccaa

SEQ ID NO: 1572 - RNA, 17 nt, Homo sapiens
cauggagucguguacau

SEQ ID NO: 1573 - RNA, 17 nt, Homo sapiens
agucguguacauuacug

SEQ ID NO: 1574 - RNA, 17 nt, Homo sapiens
guguacauuacugagaa

SEQ ID NO: 1575 - RNA, 17 nt, Homo sapiens
uguacauuacugagaac

SEQ ID NO: 1576 - RNA, 17 nt, Homo sapiens
guggugauuccaugucu

SEQ ID NO: 1577 - RNA, 17 nt, Homo sapiens
uggugauuccaugucuc

SEQ ID NO: 1578 - RNA, 17 nt, Homo sapiens
uuccaugucucgggucc

SEQ ID NO: 1579 - RNA, 17 nt, Homo sapiens
ccaugucucggguccau

SEQ ID NO: 1580 - RNA, 17 nt, Homo sapiens
ucucggguccauuucaa

SEQ ID NO: 1581 - RNA, 17 nt, Homo sapiens
ggguccauuucaaaucu

SEQ ID NO: 1582 - RNA, 17 nt, Homo sapiens
gguccauuucaaaucuc

SEQ ID NO: 1583 - RNA, 17 nt, Homo sapiens
guccauuucaaaucuca

SEQ ID NO: 1584 - RNA, 17 nt, Homo sapiens
uuucaaaucucaacgug

SEQ ID NO: 1585 - RNA, 17 nt, Homo sapiens
ucaaaucucaacguguc

SEQ ID NO: 1586 - RNA, 17 nt, Homo sapiens
caacgugucacuuugug

SEQ ID NO: 1587 - RNA, 17 nt, Homo sapiens
gugucacuuugugcaag

SEQ ID NO: 1588 - RNA, 17 nt, Homo sapiens
ugucacuuugugcaaga

SEQ ID NO: 1589 - RNA, 17 nt, Homo sapiens
ugcaagauacccagaaa

SEQ ID NO: 1590 - RNA, 17 nt, Homo sapiens
aaagagauuuguuccug

SEQ ID NO: 1591 - RNA, 17 nt, Homo sapiens
aagagauuuguuccuga

SEQ ID NO: 1592 - RNA, 17 nt, Homo sapiens
agauuuguuccugaugg

SEQ ID NO: 1593 - RNA, 17 nt, Homo sapiens
gauuuguuccugauggu

SEQ ID NO: 1594 - RNA, 17 nt, Homo sapiens
cugaugguaacagaauu

SEQ ID NO: 1595 - RNA, 17 nt, Homo sapiens
aacagaauuuccuggga

SEQ ID NO: 1596 - RNA, 17 nt, Homo sapiens
acagaauuuccugggac

SEQ ID NO: 1597 - RNA, 17 nt, Homo sapiens
cagaauuuccugggaca

SEQ ID NO: 1598 - RNA, 17 nt, Homo sapiens
gaagggcuuuacuauuc

SEQ ID NO: 1599 - RNA, 17 nt, Homo sapiens
aagggcuuuacuauucc

SEQ ID NO: 1600 - RNA, 17 nt, Homo sapiens
agggcuuuacuauuccc

SEQ ID NO: 1601 - RNA, 17 nt, Homo sapiens
gcuuuacuauucccagc

SEQ ID NO: 1602 - RNA, 17 nt, Homo sapiens
uuuacuauucccagcua

SEQ ID NO: 1603 - RNA, 17 nt, Homo sapiens
uuacuauucccagcuac

SEQ ID NO: 1604 - RNA, 17 nt, Homo sapiens
ucccagcuacaugauca

SEQ ID NO: 1605 - RNA, 17 nt, Homo sapiens
uacaugaucagcuaugc

SEQ ID NO: 1606 - RNA, 17 nt, Homo sapiens
gaucagcuaugcuggca

SEQ ID NO: 1607 - RNA, 17 nt, Homo sapiens
ggcauggucuucuguga

SEQ ID NO: 1608 - RNA, 17 nt, Homo sapiens
cauggucuucugugaag

SEQ ID NO: 1609 - RNA, 17 nt, Homo sapiens
auggucuucugugaagc

SEQ ID NO: 1610 - RNA, 17 nt, Homo sapiens
gcaaaaauuaaugauga

SEQ ID NO: 1611 - RNA, 17 nt, Homo sapiens
caaaaauuaaugaugaa

SEQ ID NO: 1612 - RNA, 17 nt, Homo sapiens
augaaaguuaccagucu

SEQ ID NO: 1613 - RNA, 17 nt, Homo sapiens
ugaaaguuaccagucua

SEQ ID NO: 1614 - RNA, 17 nt, Homo sapiens
uuaccagucuauuaugu

SEQ ID NO: 1615 - RNA, 17 nt, Homo sapiens
accagucuauuauguac

SEQ ID NO: 1616 - RNA, 17 nt, Homo sapiens
cagucuauuauguacau

SEQ ID NO: 1617 - RNA, 17 nt, Homo sapiens
agucuauuauguacaua

SEQ ID NO: 1618 - RNA, 17 nt, Homo sapiens
uauuauguacauaguug

SEQ ID NO: 1619 - RNA, 17 nt, Homo sapiens
auguacauaguugucgu

SEQ ID NO: 1620 - RNA, 17 nt, Homo sapiens
uacauaguugucguugu

SEQ ID NO: 1621 - RNA, 17 nt, Homo sapiens
auaguugucguuguagg

SEQ ID NO: 1622 - RNA, 17 nt, Homo sapiens
guugucguuguagggua

SEQ ID NO: 1623 - RNA, 17 nt, Homo sapiens
gucguuguaggguauag

SEQ ID NO: 1624 - RNA, 17 nt, Homo sapiens
uguaggguauaggauuu

SEQ ID NO: 1625 - RNA, 17 nt, Homo sapiens
uaggguauaggauuuau

SEQ ID NO: 1626 - RNA, 17 nt, Homo sapiens
uauaggauuuaugaugu

SEQ ID NO: 1627 - RNA, 17 nt, Homo sapiens
auaggauuuaugaugug

SEQ ID NO: 1628 - RNA, 17 nt, Homo sapiens
uaggauuuaugaugugg

SEQ ID NO: 1629 - RNA, 17 nt, Homo sapiens
gaugugguucugagucc

SEQ ID NO: 1630 - RNA, 17 nt, Homo sapiens
augugguucugaguccg

SEQ ID NO: 1631 - RNA, 17 nt, Homo sapiens
uucugaguccgucucau

SEQ ID NO: 1632 - RNA, 17 nt, Homo sapiens
gaguccgucucauggaa

SEQ ID NO: 1633 - RNA, 17 nt, Homo sapiens
guccgucucauggaauu

SEQ ID NO: 1634 - RNA, 17 nt, Homo sapiens
cauggaauugaacuauc

SEQ ID NO: 1635 - RNA, 17 nt, Homo sapiens
auugaacuaucuguugg

SEQ ID NO: 1636 - RNA, 17 nt, Homo sapiens
ugaacuaucuguuggag

SEQ ID NO: 1637 - RNA, 17 nt, Homo sapiens
cuaucuguuggagaaaa

SEQ ID NO: 1638 - RNA, 17 nt, Homo sapiens
gaaaagcuugucuuaaa

SEQ ID NO: 1639 - RNA, 17 nt, Homo sapiens
aagcuugucuuaaauug

SEQ ID NO: 1640 - RNA, 17 nt, Homo sapiens
gcuugucuuaaauugua

SEQ ID NO: 1641 - RNA, 17 nt, Homo sapiens
cuugucuuaaauuguac

SEQ ID NO: 1642 - RNA, 17 nt, Homo sapiens
ucuuaaauuguacagca

SEQ ID NO: 1643 - RNA, 17 nt, Homo sapiens
uaaauuguacagcaaga

SEQ ID NO: 1644 - RNA, 17 nt, Homo sapiens
acugaacuaaauguggg

SEQ ID NO: 1645 - RNA, 17 nt, Homo sapiens
guggggauugacuucaa

SEQ ID NO: 1646 - RNA, 17 nt, Homo sapiens
gauugacuucaacuggg

SEQ ID NO: 1647 - RNA, 17 nt, Homo sapiens
auugacuucaacuggga

SEQ ID NO: 1648 - RNA, 17 nt, Homo sapiens
cugggaauacccuucuu

SEQ ID NO: 1649 - RNA, 17 nt, Homo sapiens
aauacccuucuucgaag

SEQ ID NO: 1650 - RNA, 17 nt, Homo sapiens
auacccuucuucgaagc

SEQ ID NO: 1651 - RNA, 17 nt, Homo sapiens
acccuucuucgaagcau

SEQ ID NO: 1652 - RNA, 17 nt, Homo sapiens
cccuucuucgaagcauc

SEQ ID NO: 1653 - RNA, 17 nt, Homo sapiens
cgaagcaucagcauaag

SEQ ID NO: 1654 - RNA, 17 nt, Homo sapiens
aucagcauaagaaacuu

SEQ ID NO: 1655 - RNA, 17 nt, Homo sapiens
aagaaacuuguaaaccg

SEQ ID NO: 1656 - RNA, 17 nt, Homo sapiens
aaacuuguaaaccgaga

SEQ ID NO: 1657 - RNA, 17 nt, Homo sapiens
cgagaccuaaaaaccca

SEQ ID NO: 1658 - RNA, 17 nt, Homo sapiens
aacccagucugggagug

SEQ ID NO: 1659 - RNA, 17 nt, Homo sapiens
gaagaaauuuuugagca

SEQ ID NO: 1660 - RNA, 17 nt, Homo sapiens
aagaaauuuuugagcac

SEQ ID NO: 1661 - RNA, 17 nt, Homo sapiens
agaaauuuuugagcacc

SEQ ID NO: 1662 - RNA, 17 nt, Homo sapiens
gaaauuuuugagcaccu

SEQ ID NO: 1663 - RNA, 17 nt, Homo sapiens
gagcaccuuaacuauag

SEQ ID NO: 1664 - RNA, 17 nt, Homo sapiens
agcaccuuaacuauaga

SEQ ID NO: 1665 - RNA, 17 nt, Homo sapiens
ccuuaacuauagauggu

SEQ ID NO: 1666 - RNA, 17 nt, Homo sapiens
uuaacuauagauggugu

SEQ ID NO: 1667 - RNA, 17 nt, Homo sapiens
gaugguguaacccggag

SEQ ID NO: 1668 - RNA, 17 nt, Homo sapiens
ccaaggauuguacaccu

SEQ ID NO: 1669 - RNA, 17 nt, Homo sapiens
aggauuguacaccugug

SEQ ID NO: 1670 - RNA, 17 nt, Homo sapiens
ugcagcauccagugggc

SEQ ID NO: 1671 - RNA, 17 nt, Homo sapiens
cagcacauuugucaggg

SEQ ID NO: 1672 - RNA, 17 nt, Homo sapiens
agcacauuugucagggu

SEQ ID NO: 1673 - RNA, 17 nt, Homo sapiens
acauuugucagggucca

SEQ ID NO: 1674 - RNA, 17 nt, Homo sapiens
gucaggguccaugaaaa

SEQ ID NO: 1675 - RNA, 17 nt, Homo sapiens
aaaaaccuuuuguugcu

SEQ ID NO: 1676 - RNA, 17 nt, Homo sapiens
aaaaccuuuuguugcuu

SEQ ID NO: 1677 - RNA, 17 nt, Homo sapiens
aaaccuuuuguugcuuu

SEQ ID NO: 1678 - RNA, 17 nt, Homo sapiens
ccuuuuguugcuuuugg

SEQ ID NO: 1679 - RNA, 17 nt, Homo sapiens
uuguugcuuuuggaagu

SEQ ID NO: 1680 - RNA, 17 nt, Homo sapiens
uguugcuuuuggaagug

SEQ ID NO: 1681 - RNA, 17 nt, Homo sapiens
guugcuuuuggaagugg

SEQ ID NO: 1682 - RNA, 17 nt, Homo sapiens
cauggaaucucuggugg

SEQ ID NO: 1683 - RNA, 17 nt, Homo sapiens
uggaaucucugguggaa

SEQ ID NO: 1684 - RNA, 17 nt, Homo sapiens
gagcgugucagaauccc

SEQ ID NO: 1685 - RNA, 17 nt, Homo sapiens
gucagaaucccugcgaa

SEQ ID NO: 1686 - RNA, 17 nt, Homo sapiens
ugcgaaguaccuugguu

SEQ ID NO: 1687 - RNA, 17 nt, Homo sapiens
aaguaccuugguuaccc

SEQ ID NO: 1688 - RNA, 17 nt, Homo sapiens
accuugguuacccaccc

SEQ ID NO: 1689 - RNA, 17 nt, Homo sapiens
ccuugguuacccacccc

SEQ ID NO: 1690 - RNA, 17 nt, Homo sapiens
ccagaaauaaaauggua

SEQ ID NO: 1691 - RNA, 17 nt, Homo sapiens
aaaaugguauaaaaaug

SEQ ID NO: 1692 - RNA, 17 nt, Homo sapiens
aaugguauaaaaaugga

SEQ ID NO: 1693 - RNA, 17 nt, Homo sapiens
aauggaauaccccuuga

SEQ ID NO: 1694 - RNA, 17 nt, Homo sapiens
auaccccuugaguccaa

SEQ ID NO: 1695 - RNA, 17 nt, Homo sapiens
ccuugaguccaaucaca

SEQ ID NO: 1696 - RNA, 17 nt, Homo sapiens
aguccaaucacacaauu

SEQ ID NO: 1697 - RNA, 17 nt, Homo sapiens
cacacaauuaaagcggg

SEQ ID NO: 1698 - RNA, 17 nt, Homo sapiens
acacaauuaaagcgggg

SEQ ID NO: 1699 - RNA, 17 nt, Homo sapiens
gggcauguacugacgau

SEQ ID NO: 1700 - RNA, 17 nt, Homo sapiens
cugacgauuauggaagu

SEQ ID NO: 1701 - RNA, 17 nt, Homo sapiens
ugacgauuauggaagug

SEQ ID NO: 1702 - RNA, 17 nt, Homo sapiens
caggaaauuacacuguc

SEQ ID NO: 1703 - RNA, 17 nt, Homo sapiens
aggaaauuacacuguca

SEQ ID NO: 1704 - RNA, 17 nt, Homo sapiens
uacacugucauccuuac

SEQ ID NO: 1705 - RNA, 17 nt, Homo sapiens
acugucauccuuaccaa

SEQ ID NO: 1706 - RNA, 17 nt, Homo sapiens
gucauccuuaccaaucc

SEQ ID NO: 1707 - RNA, 17 nt, Homo sapiens
ucauccuuaccaauccc

SEQ ID NO: 1708 - RNA, 17 nt, Homo sapiens
uuaccaaucccauuuca

SEQ ID NO: 1709 - RNA, 17 nt, Homo sapiens
aaucccauuucaaagga

SEQ ID NO: 1710 - RNA, 17 nt, Homo sapiens
aucccauuucaaaggag

SEQ ID NO: 1711 - RNA, 17 nt, Homo sapiens
ucccauuucaaaggaga

SEQ ID NO: 1712 - RNA, 17 nt, Homo sapiens
cauguggucucucuggu

SEQ ID NO: 1713 - RNA, 17 nt, Homo sapiens
uguggucucucugguug

SEQ ID NO: 1714 - RNA, 17 nt, Homo sapiens
uggucucucugguugug

SEQ ID NO: 1715 - RNA, 17 nt, Homo sapiens
ucucugguuguguaugu

SEQ ID NO: 1716 - RNA, 17 nt, Homo sapiens
gguuguguaugucccac

SEQ ID NO: 1717 - RNA, 17 nt, Homo sapiens
guguaugucccacccca

SEQ ID NO: 1718 - RNA, 17 nt, Homo sapiens
ccccagauuggugagaa

SEQ ID NO: 1719 - RNA, 17 nt, Homo sapiens
ugagaaaucucuaaucu

SEQ ID NO: 1720 - RNA, 17 nt, Homo sapiens
agaaaucucuaaucucu

SEQ ID NO: 1721 - RNA, 17 nt, Homo sapiens
aaaucucuaaucucucc

SEQ ID NO: 1722 - RNA, 17 nt, Homo sapiens
ucucuaaucucuccugu

SEQ ID NO: 1723 - RNA, 17 nt, Homo sapiens
ucuaaucucuccugugg

SEQ ID NO: 1724 - RNA, 17 nt, Homo sapiens
uaaucucuccuguggau

SEQ ID NO: 1725 - RNA, 17 nt, Homo sapiens
cuguggauuccuaccag

SEQ ID NO: 1726 - RNA, 17 nt, Homo sapiens
uguggauuccuaccagu

SEQ ID NO: 1727 - RNA, 17 nt, Homo sapiens
ggauuccuaccaguacg

SEQ ID NO: 1728 - RNA, 17 nt, Homo sapiens
cuaccaguacggcacca

SEQ ID NO: 1729 - RNA, 17 nt, Homo sapiens
gcaccacucaaacgcug

SEQ ID NO: 1730 - RNA, 17 nt, Homo sapiens
ugacauguacggucuau

SEQ ID NO: 1731 - RNA, 17 nt, Homo sapiens
uguacggucuaugccau

SEQ ID NO: 1732 - RNA, 17 nt, Homo sapiens
uacggucuaugccauuc

SEQ ID NO: 1733 - RNA, 17 nt, Homo sapiens
uaugccauuccuccccc

SEQ ID NO: 1734 - RNA, 17 nt, Homo sapiens
augccauuccucccccg

SEQ ID NO: 1735 - RNA, 17 nt, Homo sapiens
ccauuccucccccgcau

SEQ ID NO: 1736 - RNA, 17 nt, Homo sapiens
ccccgcaucacauccac

SEQ ID NO: 1737 - RNA, 17 nt, Homo sapiens
caucacauccacuggua

SEQ ID NO: 1738 - RNA, 17 nt, Homo sapiens
ccacugguauuggcagu

SEQ ID NO: 1739 - RNA, 17 nt, Homo sapiens
acugguauuggcaguug

SEQ ID NO: 1740 - RNA, 17 nt, Homo sapiens
uuggcaguuggaggaag

SEQ ID NO: 1741 - RNA, 17 nt, Homo sapiens
caagcugucucagugac

SEQ ID NO: 1742 - RNA, 17 nt, Homo sapiens
agcugucucagugacaa

SEQ ID NO: 1743 - RNA, 17 nt, Homo sapiens
aaacccauacccuugug

SEQ ID NO: 1744 - RNA, 17 nt, Homo sapiens
cauacccuugugaagaa

SEQ ID NO: 1745 - RNA, 17 nt, Homo sapiens
ggaggacuuccagggag

SEQ ID NO: 1746 - RNA, 17 nt, Homo sapiens
gaggacuuccagggagg

SEQ ID NO: 1747 - RNA, 17 nt, Homo sapiens
gaggaaauaaaauugaa

SEQ ID NO: 1748 - RNA, 17 nt, Homo sapiens
aauaaaauugaaguuaa

SEQ ID NO: 1749 - RNA, 17 nt, Homo sapiens
auugaaguuaauaaaaa

SEQ ID NO: 1750 - RNA, 17 nt, Homo sapiens
uugaaguuaauaaaaau

SEQ ID NO: 1751 - RNA, 17 nt, Homo sapiens
aaguuaauaaaaaucaa

SEQ ID NO: 1752 - RNA, 17 nt, Homo sapiens
auaaaaaucaauuugcu

SEQ ID NO: 1753 - RNA, 17 nt, Homo sapiens
aaaucaauuugcucuaa

SEQ ID NO: 1754 - RNA, 17 nt, Homo sapiens
aaucaauuugcucuaau

SEQ ID NO: 1755 - RNA, 17 nt, Homo sapiens
aauuugcucuaauugaa

SEQ ID NO: 1756 - RNA, 17 nt, Homo sapiens
uuugcucuaauugaagg

SEQ ID NO: 1757 - RNA, 17 nt, Homo sapiens
gcucuaauugaaggaaa

SEQ ID NO: 1758 - RNA, 17 nt, Homo sapiens
aaaacuguaaguacccu

SEQ ID NO: 1759 - RNA, 17 nt, Homo sapiens
cuguaaguacccuuguu

SEQ ID NO: 1760 - RNA, 17 nt, Homo sapiens
aguacccuuguuaucca

SEQ ID NO: 1761 - RNA, 17 nt, Homo sapiens
acccuuguuauccaagc

SEQ ID NO: 1762 - RNA, 17 nt, Homo sapiens
cccuuguuauccaagcg

SEQ ID NO: 1763 - RNA, 17 nt, Homo sapiens
cuuguuauccaagcggc

SEQ ID NO: 1764 - RNA, 17 nt, Homo sapiens
aaaugugucagcuuugu

SEQ ID NO: 1765 - RNA, 17 nt, Homo sapiens
ugucagcuuuguacaaa

SEQ ID NO: 1766 - RNA, 17 nt, Homo sapiens
gucagcuuuguacaaau

SEQ ID NO: 1767 - RNA, 17 nt, Homo sapiens
agcuuuguacaaaugug

SEQ ID NO: 1768 - RNA, 17 nt, Homo sapiens
gaagcggucaacaaagu

SEQ ID NO: 1769 - RNA, 17 nt, Homo sapiens
aacaaagucgggagagg

SEQ ID NO: 1770 - RNA, 17 nt, Homo sapiens
agggugaucuccuucca

SEQ ID NO: 1771 - RNA, 17 nt, Homo sapiens
ggugaucuccuuccacg

SEQ ID NO: 1772 - RNA, 17 nt, Homo sapiens
gaucuccuuccacguga

SEQ ID NO: 1773 - RNA, 17 nt, Homo sapiens
aucuccuuccacgugac

SEQ ID NO: 1774 - RNA, 17 nt, Homo sapiens
ccagggguccugaaauu

SEQ ID NO: 1775 - RNA, 17 nt, Homo sapiens
ccugaaauuacuuugca

SEQ ID NO: 1776 - RNA, 17 nt, Homo sapiens
cugaaauuacuuugcaa

SEQ ID NO: 1777 - RNA, 17 nt, Homo sapiens
aaauuacuuugcaaccu

SEQ ID NO: 1778 - RNA, 17 nt, Homo sapiens
aauuacuuugcaaccug

SEQ ID NO: 1779 - RNA, 17 nt, Homo sapiens
gagcgugucuuuguggu

SEQ ID NO: 1780 - RNA, 17 nt, Homo sapiens
gcgugucuuuguggugc

SEQ ID NO: 1781 - RNA, 17 nt, Homo sapiens
cgugucuuuguggugca

SEQ ID NO: 1782 - RNA, 17 nt, Homo sapiens
agacagaucuacguuug

SEQ ID NO: 1783 - RNA, 17 nt, Homo sapiens
acagaucuacguuugag

SEQ ID NO: 1784 - RNA, 17 nt, Homo sapiens
aucuacguuugagaacc

SEQ ID NO: 1785 - RNA, 17 nt, Homo sapiens
ucuacguuugagaaccu

SEQ ID NO: 1786 - RNA, 17 nt, Homo sapiens
gagaaccucacauggua

SEQ ID NO: 1787 - RNA, 17 nt, Homo sapiens
cacaugguacaagcuug

SEQ ID NO: 1788 - RNA, 17 nt, Homo sapiens
uacaagcuuggcccaca

SEQ ID NO: 1789 - RNA, 17 nt, Homo sapiens
cacagccucugccaauc

SEQ ID NO: 1790 - RNA, 17 nt, Homo sapiens
cugccaauccauguggg

SEQ ID NO: 1791 - RNA, 17 nt, Homo sapiens
gggagaguugcccacac

SEQ ID NO: 1792 - RNA, 17 nt, Homo sapiens
acaccuguuugcaagaa

SEQ ID NO: 1793 - RNA, 17 nt, Homo sapiens
caccuguuugcaagaac

SEQ ID NO: 1794 - RNA, 17 nt, Homo sapiens
caagaacuuggauacuc

SEQ ID NO: 1795 - RNA, 17 nt, Homo sapiens
acuuggauacucuuugg

SEQ ID NO: 1796 - RNA, 17 nt, Homo sapiens
uggauacucuuuggaaa

SEQ ID NO: 1797 - RNA, 17 nt, Homo sapiens
gauacucuuuggaaauu

SEQ ID NO: 1798 - RNA, 17 nt, Homo sapiens
auacucuuuggaaauug

SEQ ID NO: 1799 - RNA, 17 nt, Homo sapiens
uuggaaauugaaugcca

SEQ ID NO: 1800 - RNA, 17 nt, Homo sapiens
caccauguucucuaaua

SEQ ID NO: 1801 - RNA, 17 nt, Homo sapiens
accauguucucuaauag

SEQ ID NO: 1802 - RNA, 17 nt, Homo sapiens
cauguucucuaauagca

SEQ ID NO: 1803 - RNA, 17 nt, Homo sapiens
uguucucuaauagcaca

SEQ ID NO: 1804 - RNA, 17 nt, Homo sapiens
ucucuaauagcacaaau

SEQ ID NO: 1805 - RNA, 17 nt, Homo sapiens
aaugacauuuugaucau

SEQ ID NO: 1806 - RNA, 17 nt, Homo sapiens
augacauuuugaucaug

SEQ ID NO: 1807 - RNA, 17 nt, Homo sapiens
ugacauuuugaucaugg

SEQ ID NO: 1808 - RNA, 17 nt, Homo sapiens
auuuugaucauggagcu

SEQ ID NO: 1809 - RNA, 17 nt, Homo sapiens
auggagcuuaagaaugc

SEQ ID NO: 1810 - RNA, 17 nt, Homo sapiens
uggagcuuaagaaugca

SEQ ID NO: 1811 - RNA, 17 nt, Homo sapiens
gaaugcauccuugcagg

SEQ ID NO: 1812 - RNA, 17 nt, Homo sapiens
ugcauccuugcaggacc

SEQ ID NO: 1813 - RNA, 17 nt, Homo sapiens
aggagacuaugucugcc

SEQ ID NO: 1814 - RNA, 17 nt, Homo sapiens
gacuaugucugccuugc

SEQ ID NO: 1815 - RNA, 17 nt, Homo sapiens
gucugccuugcucaaga

SEQ ID NO: 1816 - RNA, 17 nt, Homo sapiens
gccuugcucaagacagg

SEQ ID NO: 1817 - RNA, 17 nt, Homo sapiens
aaagacauugcgugguc

SEQ ID NO: 1818 - RNA, 17 nt, Homo sapiens
ugcguggucaggcagcu

SEQ ID NO: 1819 - RNA, 17 nt, Homo sapiens
aggcagcucacaguccu

SEQ ID NO: 1820 - RNA, 17 nt, Homo sapiens
cucacaguccuagagcg

SEQ ID NO: 1821 - RNA, 17 nt, Homo sapiens
acaguccuagagcgugu

SEQ ID NO: 1822 - RNA, 17 nt, Homo sapiens
cccacgaucacaggaaa

SEQ ID NO: 1823 - RNA, 17 nt, Homo sapiens
uggagaaucagacgaca

SEQ ID NO: 1824 - RNA, 17 nt, Homo sapiens
cgacaaguauuggggaa

SEQ ID NO: 1825 - RNA, 17 nt, Homo sapiens
acaaguauuggggaaag

SEQ ID NO: 1826 - RNA, 17 nt, Homo sapiens
gaaagcaucgaagucuc

SEQ ID NO: 1827 - RNA, 17 nt, Homo sapiens
aucgaagucucaugcac

SEQ ID NO: 1828 - RNA, 17 nt, Homo sapiens
cgaagucucaugcacgg

SEQ ID NO: 1829 - RNA, 17 nt, Homo sapiens
cacggcaucugggaauc

SEQ ID NO: 1830 - RNA, 17 nt, Homo sapiens
cugggaaucccccucca

SEQ ID NO: 1831 - RNA, 17 nt, Homo sapiens
aucccccuccacagauc

SEQ ID NO: 1832 - RNA, 17 nt, Homo sapiens
ccacagaucaugugguu

SEQ ID NO: 1833 - RNA, 17 nt, Homo sapiens
caugugguuuaaagaua

SEQ ID NO: 1834 - RNA, 17 nt, Homo sapiens
augugguuuaaagauaa

SEQ ID NO: 1835 - RNA, 17 nt, Homo sapiens
ugugguuuaaagauaau

SEQ ID NO: 1836 - RNA, 17 nt, Homo sapiens
uuaaagauaaugagacc

SEQ ID NO: 1837 - RNA, 17 nt, Homo sapiens
gagacccuuguagaaga

SEQ ID NO: 1838 - RNA, 17 nt, Homo sapiens
acccuuguagaagacuc

SEQ ID NO: 1839 - RNA, 17 nt, Homo sapiens
agaagacucaggcauug

SEQ ID NO: 1840 - RNA, 17 nt, Homo sapiens
ucaggcauuguauugaa

SEQ ID NO: 1841 - RNA, 17 nt, Homo sapiens
ggcauuguauugaagga

SEQ ID NO: 1842 - RNA, 17 nt, Homo sapiens
cauuguauugaaggaug

SEQ ID NO: 1843 - RNA, 17 nt, Homo sapiens
cggaaccucacuauccg

SEQ ID NO: 1844 - RNA, 17 nt, Homo sapiens
accucacuauccgcaga

SEQ ID NO: 1845 - RNA, 17 nt, Homo sapiens
cucacuauccgcagagu

SEQ ID NO: 1846 - RNA, 17 nt, Homo sapiens
gaaggccucuacaccug

SEQ ID NO: 1847 - RNA, 17 nt, Homo sapiens
aggccucuacaccugcc

SEQ ID NO: 1848 - RNA, 17 nt, Homo sapiens
ugcaguguucuuggcug

SEQ ID NO: 1849 - RNA, 17 nt, Homo sapiens
gcaguguucuuggcugu

SEQ ID NO: 1850 - RNA, 17 nt, Homo sapiens
aguguucuuggcugugc

SEQ ID NO: 1851 - RNA, 17 nt, Homo sapiens
ggaggcauuuuucauaa

SEQ ID NO: 1852 - RNA, 17 nt, Homo sapiens
gaggcauuuuucauaau

SEQ ID NO: 1853 - RNA, 17 nt, Homo sapiens
aggcauuuuucauaaua

SEQ ID NO: 1854 - RNA, 17 nt, Homo sapiens
ggcauuuuucauaauag

SEQ ID NO: 1855 - RNA, 17 nt, Homo sapiens
gcauuuuucauaauaga

SEQ ID NO: 1856 - RNA, 17 nt, Homo sapiens
uuuuucauaauagaagg

SEQ ID NO: 1857 - RNA, 17 nt, Homo sapiens
uucauaauagaaggugc

SEQ ID NO: 1858 - RNA, 17 nt, Homo sapiens
gacgaacuuggaaauca

SEQ ID NO: 1859 - RNA, 17 nt, Homo sapiens
uuggaaaucauuauucu

SEQ ID NO: 1860 - RNA, 17 nt, Homo sapiens
gaaaucauuauucuagu

SEQ ID NO: 1861 - RNA, 17 nt, Homo sapiens
aaaucauuauucuagua

SEQ ID NO: 1862 - RNA, 17 nt, Homo sapiens
aucauuauucuaguagg

SEQ ID NO: 1863 - RNA, 17 nt, Homo sapiens
ucauuauucuaguaggc

SEQ ID NO: 1864 - RNA, 17 nt, Homo sapiens
auuauucuaguaggcac

SEQ ID NO: 1865 - RNA, 17 nt, Homo sapiens
auucuaguaggcacgac

SEQ ID NO: 1866 - RNA, 17 nt, Homo sapiens
acggugauugccauguu

SEQ ID NO: 1867 - RNA, 17 nt, Homo sapiens
ugccauguucuucuggc

SEQ ID NO: 1868 - RNA, 17 nt, Homo sapiens
gccauguucuucuggcu

SEQ ID NO: 1869 - RNA, 17 nt, Homo sapiens
cauguucuucuggcuac

SEQ ID NO: 1870 - RNA, 17 nt, Homo sapiens
auguucuucuggcuacu

SEQ ID NO: 1871 - RNA, 17 nt, Homo sapiens
uucuggcuacuucuugu

SEQ ID NO: 1872 - RNA, 17 nt, Homo sapiens
uggcuacuucuugucau

SEQ ID NO: 1873 - RNA, 17 nt, Homo sapiens
ggcuacuucuugucauc

SEQ ID NO: 1874 - RNA, 17 nt, Homo sapiens
cuacuucuugucaucau

SEQ ID NO: 1875 - RNA, 17 nt, Homo sapiens
cuucuugucaucauccu

SEQ ID NO: 1876 - RNA, 17 nt, Homo sapiens
cuugucaucauccuagg

SEQ ID NO: 1877 - RNA, 17 nt, Homo sapiens
gucaucauccuagggac

SEQ ID NO: 1878 - RNA, 17 nt, Homo sapiens
aucauccuagggaccgu

SEQ ID NO: 1879 - RNA, 17 nt, Homo sapiens
gggaccguuaagcgggc

SEQ ID NO: 1880 - RNA, 17 nt, Homo sapiens
ggaccguuaagcgggcc

SEQ ID NO: 1881 - RNA, 17 nt, Homo sapiens
gacaggcuacuugucca

SEQ ID NO: 1882 - RNA, 17 nt, Homo sapiens
aggcuacuuguccaucg

SEQ ID NO: 1883 - RNA, 17 nt, Homo sapiens
cuacuuguccaucguca

SEQ ID NO: 1884 - RNA, 17 nt, Homo sapiens
uuguccaucgucaugga

SEQ ID NO: 1885 - RNA, 17 nt, Homo sapiens
uccaucgucauggaucc

SEQ ID NO: 1886 - RNA, 17 nt, Homo sapiens
ucauggauccagaugaa

SEQ ID NO: 1887 - RNA, 17 nt, Homo sapiens
gaugaacucccauugga

SEQ ID NO: 1888 - RNA, 17 nt, Homo sapiens
acucccauuggaugaac

SEQ ID NO: 1889 - RNA, 17 nt, Homo sapiens
augaacauugugaacga

SEQ ID NO: 1890 - RNA, 17 nt, Homo sapiens
gacugccuuaugaugcc

SEQ ID NO: 1891 - RNA, 17 nt, Homo sapiens
acugccuuaugaugcca

SEQ ID NO: 1892 - RNA, 17 nt, Homo sapiens
augggaauuccccagag

SEQ ID NO: 1893 - RNA, 17 nt, Homo sapiens
ugggaauuccccagaga

SEQ ID NO: 1894 - RNA, 17 nt, Homo sapiens
cugaaccuagguaagcc

SEQ ID NO: 1895 - RNA, 17 nt, Homo sapiens
accuagguaagccucuu

SEQ ID NO: 1896 - RNA, 17 nt, Homo sapiens
guaagccucuuggccgu

SEQ ID NO: 1897 - RNA, 17 nt, Homo sapiens
aagccucuuggccgugg

SEQ ID NO: 1898 - RNA, 17 nt, Homo sapiens
uggugccuuuggccaag

SEQ ID NO: 1899 - RNA, 17 nt, Homo sapiens
ggugccuuuggccaaga

SEQ ID NO: 1900 - RNA, 17 nt, Homo sapiens
caagagauugaagcaga

SEQ ID NO: 1901 - RNA, 17 nt, Homo sapiens
agaugccuuuggaauug

SEQ ID NO: 1902 - RNA, 17 nt, Homo sapiens
gaugccuuuggaauuga

SEQ ID NO: 1903 - RNA, 17 nt, Homo sapiens
uuuggaauugacaagac

SEQ ID NO: 1904 - RNA, 17 nt, Homo sapiens
cagcaacuugcaggaca

SEQ ID NO: 1905 - RNA, 17 nt, Homo sapiens
aggacaguagcagucaa

SEQ ID NO: 1906 - RNA, 17 nt, Homo sapiens
guagcagucaaaauguu

SEQ ID NO: 1907 - RNA, 17 nt, Homo sapiens
caaaauguugaaagaag

SEQ ID NO: 1908 - RNA, 17 nt, Homo sapiens
gugagcaucgagcucuc

SEQ ID NO: 1909 - RNA, 17 nt, Homo sapiens
aucgagcucucaugucu

SEQ ID NO: 1910 - RNA, 17 nt, Homo sapiens
cgagcucucaugucuga

SEQ ID NO: 1911 - RNA, 17 nt, Homo sapiens
ucucaugucugaacuca

SEQ ID NO: 1912 - RNA, 17 nt, Homo sapiens
ucugaacucaagauccu

SEQ ID NO: 1913 - RNA, 17 nt, Homo sapiens
cucaagauccucauuca

SEQ ID NO: 1914 - RNA, 17 nt, Homo sapiens
aagauccucauucauau

SEQ ID NO: 1915 - RNA, 17 nt, Homo sapiens
auccucauucauauugg

SEQ ID NO: 1916 - RNA, 17 nt, Homo sapiens
uccucauucauauuggu

SEQ ID NO: 1917 - RNA, 17 nt, Homo sapiens
ucauucauauuggucac

SEQ ID NO: 1918 - RNA, 17 nt, Homo sapiens
auucauauuggucacca

SEQ ID NO: 1919 - RNA, 17 nt, Homo sapiens
auauuggucaccaucuc

SEQ ID NO: 1920 - RNA, 17 nt, Homo sapiens
gucaccaucucaaugug

SEQ ID NO: 1921 - RNA, 17 nt, Homo sapiens
caccaucucaauguggu

SEQ ID NO: 1922 - RNA, 17 nt, Homo sapiens
aauguggucaaccuucu

SEQ ID NO: 1923 - RNA, 17 nt, Homo sapiens
gucaaccuucuaggugc

SEQ ID NO: 1924 - RNA, 17 nt, Homo sapiens
ucaaccuucuaggugcc

SEQ ID NO: 1925 - RNA, 17 nt, Homo sapiens
aaccuucuaggugccug

SEQ ID NO: 1926 - RNA, 17 nt, Homo sapiens
gugccuguaccaagcca

SEQ ID NO: 1927 - RNA, 17 nt, Homo sapiens
gggccacucauggugau

SEQ ID NO: 1928 - RNA, 17 nt, Homo sapiens
auggugauuguggaauu

SEQ ID NO: 1929 - RNA, 17 nt, Homo sapiens
uguggaauucugcaaau

SEQ ID NO: 1930 - RNA, 17 nt, Homo sapiens
guggaauucugcaaauu

SEQ ID NO: 1931 - RNA, 17 nt, Homo sapiens
cugcaaauuuggaaacc

SEQ ID NO: 1932 - RNA, 17 nt, Homo sapiens
ugcaaauuuggaaaccu

SEQ ID NO: 1933 - RNA, 17 nt, Homo sapiens
aaaccuguccacuuacc

SEQ ID NO: 1934 - RNA, 17 nt, Homo sapiens
uguccacuuaccugagg

SEQ ID NO: 1935 - RNA, 17 nt, Homo sapiens
guccacuuaccugagga

SEQ ID NO: 1936 - RNA, 17 nt, Homo sapiens
aaaugaauuuguccccu

SEQ ID NO: 1937 - RNA, 17 nt, Homo sapiens
aaugaauuuguccccua

SEQ ID NO: 1938 - RNA, 17 nt, Homo sapiens
gaauuuguccccuacaa

SEQ ID NO: 1939 - RNA, 17 nt, Homo sapiens
uguccccuacaagacca

SEQ ID NO: 1940 - RNA, 17 nt, Homo sapiens
ggcacgauuccgucaag

SEQ ID NO: 1941 - RNA, 17 nt, Homo sapiens
gcacgauuccgucaagg

SEQ ID NO: 1942 - RNA, 17 nt, Homo sapiens
gauuccgucaagggaaa

SEQ ID NO: 1943 - RNA, 17 nt, Homo sapiens
gaaagacuacguuggag

SEQ ID NO: 1944 - RNA, 17 nt, Homo sapiens
gacuacguuggagcaau

SEQ ID NO: 1945 - RNA, 17 nt, Homo sapiens
ggagcaaucccugugga

SEQ ID NO: 1946 - RNA, 17 nt, Homo sapiens
cuguggaucugaaacgg

SEQ ID NO: 1947 - RNA, 17 nt, Homo sapiens
acggcgcuuggacagca

SEQ ID NO: 1948 - RNA, 17 nt, Homo sapiens
gacagcaucaccaguag

SEQ ID NO: 1949 - RNA, 17 nt, Homo sapiens
ucaccaguagccagagc

SEQ ID NO: 1950 - RNA, 17 nt, Homo sapiens
ccagagcucagccagcu

SEQ ID NO: 1951 - RNA, 17 nt, Homo sapiens
agccagcucuggauuug

SEQ ID NO: 1952 - RNA, 17 nt, Homo sapiens
cucuggauuuguggagg

SEQ ID NO: 1953 - RNA, 17 nt, Homo sapiens
ucuggauuuguggagga

SEQ ID NO: 1954 - RNA, 17 nt, Homo sapiens
ggagaagucccucagug

SEQ ID NO: 1955 - RNA, 17 nt, Homo sapiens
aagucccucagugaugu

SEQ ID NO: 1956 - RNA, 17 nt, Homo sapiens
agugauguagaagaaga

SEQ ID NO: 1957 - RNA, 17 nt, Homo sapiens
aggaagcuccugaagau

SEQ ID NO: 1958 - RNA, 17 nt, Homo sapiens
cugaagaucuguauaag

SEQ ID NO: 1959 - RNA, 17 nt, Homo sapiens
agaucuguauaaggacu

SEQ ID NO: 1960 - RNA, 17 nt, Homo sapiens
aucuguauaaggacuuc

SEQ ID NO: 1961 - RNA, 17 nt, Homo sapiens
uaaggacuuccugaccu

SEQ ID NO: 1962 - RNA, 17 nt, Homo sapiens
aaggacuuccugaccuu

SEQ ID NO: 1963 - RNA, 17 nt, Homo sapiens
ccugaccuuggagcauc

SEQ ID NO: 1964 - RNA, 17 nt, Homo sapiens
uggagcaucucaucugu

SEQ ID NO: 1965 - RNA, 17 nt, Homo sapiens
gagcaucucaucuguua

SEQ ID NO: 1966 - RNA, 17 nt, Homo sapiens
caucucaucuguuacag

SEQ ID NO: 1967 - RNA, 17 nt, Homo sapiens
ucaucuguuacagcuuc

SEQ ID NO: 1968 - RNA, 17 nt, Homo sapiens
caucuguuacagcuucc

SEQ ID NO: 1969 - RNA, 17 nt, Homo sapiens
uuacagcuuccaagugg

SEQ ID NO: 1970 - RNA, 17 nt, Homo sapiens
uacagcuuccaaguggc

SEQ ID NO: 1971 - RNA, 17 nt, Homo sapiens
aaguggcuaagggcaug

SEQ ID NO: 1972 - RNA, 17 nt, Homo sapiens
cauggaguucuuggcau

SEQ ID NO: 1973 - RNA, 17 nt, Homo sapiens
auggaguucuuggcauc

SEQ ID NO: 1974 - RNA, 17 nt, Homo sapiens
ggaguucuuggcaucgc

SEQ ID NO: 1975 - RNA, 17 nt, Homo sapiens
cuuggcaucgcgaaagu

SEQ ID NO: 1976 - RNA, 17 nt, Homo sapiens
gaaaguguauccacagg

SEQ ID NO: 1977 - RNA, 17 nt, Homo sapiens
aaguguauccacaggga

SEQ ID NO: 1978 - RNA, 17 nt, Homo sapiens
cacgaaauauccucuua

SEQ ID NO: 1979 - RNA, 17 nt, Homo sapiens
cgaaauauccucuuauc

SEQ ID NO: 1980 - RNA, 17 nt, Homo sapiens
aauauccucuuaucgga

SEQ ID NO: 1981 - RNA, 17 nt, Homo sapiens
uauccucuuaucggaga

SEQ ID NO: 1982 - RNA, 17 nt, Homo sapiens
auccucuuaucggagaa

SEQ ID NO: 1983 - RNA, 17 nt, Homo sapiens
ccucuuaucggagaaga

SEQ ID NO: 1984 - RNA, 17 nt, Homo sapiens
aacgugguuaaaaucug

SEQ ID NO: 1985 - RNA, 17 nt, Homo sapiens
acgugguuaaaaucugu

SEQ ID NO: 1986 - RNA, 17 nt, Homo sapiens
guuaaaaucugugacuu

SEQ ID NO: 1987 - RNA, 17 nt, Homo sapiens
cugugacuuuggcuugg

SEQ ID NO: 1988 - RNA, 17 nt, Homo sapiens
ugugacuuuggcuuggc

SEQ ID NO: 1989 - RNA, 17 nt, Homo sapiens
cuuuggcuuggcccggg

SEQ ID NO: 1990 - RNA, 17 nt, Homo sapiens
cccgggauauuuauaaa

SEQ ID NO: 1991 - RNA, 17 nt, Homo sapiens
cgggauauuuauaaaga

SEQ ID NO: 1992 - RNA, 17 nt, Homo sapiens
gggauauuuauaaagau

SEQ ID NO: 1993 - RNA, 17 nt, Homo sapiens
ggauauuuauaaagauc

SEQ ID NO: 1994 - RNA, 17 nt, Homo sapiens
auauuuauaaagaucca

SEQ ID NO: 1995 - RNA, 17 nt, Homo sapiens
auaaagauccagauuau

SEQ ID NO: 1996 - RNA, 17 nt, Homo sapiens
auccagauuaugucaga

SEQ ID NO: 1997 - RNA, 17 nt, Homo sapiens
uccagauuaugucagaa

SEQ ID NO: 1998 - RNA, 17 nt, Homo sapiens
gauuaugucagaaaagg

SEQ ID NO: 1999 - RNA, 17 nt, Homo sapiens
gagaugcucgccucccu

SEQ ID NO: 2000 - RNA, 17 nt, Homo sapiens
gcucgccucccuuugaa

SEQ ID NO: 2001 - RNA, 17 nt, Homo sapiens
gccucccuuugaaaugg

SEQ ID NO: 2002 - RNA, 17 nt, Homo sapiens
ccucccuuugaaaugga

SEQ ID NO: 2003 - RNA, 17 nt, Homo sapiens
gaaacaauuuuugacag

SEQ ID NO: 2004 - RNA, 17 nt, Homo sapiens
aaacaauuuuugacaga

SEQ ID NO: 2005 - RNA, 17 nt, Homo sapiens
aacaauuuuugacagag

SEQ ID NO: 2006 - RNA, 17 nt, Homo sapiens
acaauuuuugacagagu

SEQ ID NO: 2007 - RNA, 17 nt, Homo sapiens
cagaguguacacaaucc

SEQ ID NO: 2008 - RNA, 17 nt, Homo sapiens
uacacaauccagaguga

SEQ ID NO: 2009 - RNA, 17 nt, Homo sapiens
agugacgucuggucuuu

SEQ ID NO: 2010 - RNA, 17 nt, Homo sapiens
cgucuggucuuuuggug

SEQ ID NO: 2011 - RNA, 17 nt, Homo sapiens
ucuggucuuuugguguu

SEQ ID NO: 2012 - RNA, 17 nt, Homo sapiens
cuggucuuuugguguuu

SEQ ID NO: 2013 - RNA, 17 nt, Homo sapiens
uggucuuuugguguuuu

SEQ ID NO: 2014 - RNA, 17 nt, Homo sapiens
uuugguguuuugcugug

SEQ ID NO: 2015 - RNA, 17 nt, Homo sapiens
uugguguuuugcugugg

SEQ ID NO: 2016 - RNA, 17 nt, Homo sapiens
ugguguuuugcuguggg

SEQ ID NO: 2017 - RNA, 17 nt, Homo sapiens
ugggaaauauuuuccuu

SEQ ID NO: 2018 - RNA, 17 nt, Homo sapiens
ggaaauauuuuccuuag

SEQ ID NO: 2019 - RNA, 17 nt, Homo sapiens
gaaauauuuuccuuagg

SEQ ID NO: 2020 - RNA, 17 nt, Homo sapiens
aaauauuuuccuuaggu

SEQ ID NO: 2021 - RNA, 17 nt, Homo sapiens
aauauuuuccuuaggug

SEQ ID NO: 2022 - RNA, 17 nt, Homo sapiens
auuuuccuuaggugcuu

SEQ ID NO: 2023 - RNA, 17 nt, Homo sapiens
uuuuccuuaggugcuuc

SEQ ID NO: 2024 - RNA, 17 nt, Homo sapiens
uaggugcuucuccauau

SEQ ID NO: 2025 - RNA, 17 nt, Homo sapiens
aggugcuucuccauauc

SEQ ID NO: 2026 - RNA, 17 nt, Homo sapiens
gugcuucuccauauccu

SEQ ID NO: 2027 - RNA, 17 nt, Homo sapiens
uucuccauauccugggg

SEQ ID NO: 2028 - RNA, 17 nt, Homo sapiens
cuccauauccuggggua

SEQ ID NO: 2029 - RNA, 17 nt, Homo sapiens
ccugggguaaagauuga

SEQ ID NO: 2030 - RNA, 17 nt, Homo sapiens
guaaagauugaugaaga

SEQ ID NO: 2031 - RNA, 17 nt, Homo sapiens
ugaagaauuuuguaggc

SEQ ID NO: 2032 - RNA, 17 nt, Homo sapiens
gaagaauuuuguaggcg

SEQ ID NO: 2033 - RNA, 17 nt, Homo sapiens
aagaauuuuguaggcga

SEQ ID NO: 2034 - RNA, 17 nt, Homo sapiens
aauuuuguaggcgauug

SEQ ID NO: 2035 - RNA, 17 nt, Homo sapiens
uaggcgauugaaagaag

SEQ ID NO: 2036 - RNA, 17 nt, Homo sapiens
aaggaacuagaaugagg

SEQ ID NO: 2037 - RNA, 17 nt, Homo sapiens
ccccugauuauacuaca

SEQ ID NO: 2038 - RNA, 17 nt, Homo sapiens
cccugauuauacuacac

SEQ ID NO: 2039 - RNA, 17 nt, Homo sapiens
cugauuauacuacacca

SEQ ID NO: 2040 - RNA, 17 nt, Homo sapiens
auuauacuacaccagaa

SEQ ID NO: 2041 - RNA, 17 nt, Homo sapiens
agaaauguaccagacca

SEQ ID NO: 2042 - RNA, 17 nt, Homo sapiens
agcccagucagagaccc

SEQ ID NO: 2043 - RNA, 17 nt, Homo sapiens
acccacguuuucagagu

SEQ ID NO: 2044 - RNA, 17 nt, Homo sapiens
cccacguuuucagaguu

SEQ ID NO: 2045 - RNA, 17 nt, Homo sapiens
ccacguuuucagaguug

SEQ ID NO: 2046 - RNA, 17 nt, Homo sapiens
cacguuuucagaguugg

SEQ ID NO: 2047 - RNA, 17 nt, Homo sapiens
uucagaguugguggaac

SEQ ID NO: 2048 - RNA, 17 nt, Homo sapiens
uggaacauuugggaaau

SEQ ID NO: 2049 - RNA, 17 nt, Homo sapiens
ggaacauuugggaaauc

SEQ ID NO: 2050 - RNA, 17 nt, Homo sapiens
ugggaaaucucuugcaa

SEQ ID NO: 2051 - RNA, 17 nt, Homo sapiens
ggaaaucucuugcaagc

SEQ ID NO: 2052 - RNA, 17 nt, Homo sapiens
aaaucucuugcaagcua

SEQ ID NO: 2053 - RNA, 17 nt, Homo sapiens
ugcaagcuaaugcucag

SEQ ID NO: 2054 - RNA, 17 nt, Homo sapiens
cuaaugcucagcaggau

SEQ ID NO: 2055 - RNA, 17 nt, Homo sapiens
caaagacuacauuguuc

SEQ ID NO: 2056 - RNA, 17 nt, Homo sapiens
gacuacauuguucuucc

SEQ ID NO: 2057 - RNA, 17 nt, Homo sapiens
uacauuguucuuccgau

SEQ ID NO: 2058 - RNA, 17 nt, Homo sapiens
acauuguucuuccgaua

SEQ ID NO: 2059 - RNA, 17 nt, Homo sapiens
auuguucuuccgauauc

SEQ ID NO: 2060 - RNA, 17 nt, Homo sapiens
uuguucuuccgauauca

SEQ ID NO: 2061 - RNA, 17 nt, Homo sapiens
cuuccgauaucagagac

SEQ ID NO: 2062 - RNA, 17 nt, Homo sapiens
uccgauaucagagacuu

SEQ ID NO: 2063 - RNA, 17 nt, Homo sapiens
cagagacuuugagcaug

SEQ ID NO: 2064 - RNA, 17 nt, Homo sapiens
agagacuuugagcaugg

SEQ ID NO: 2065 - RNA, 17 nt, Homo sapiens
aagaggauucuggacuc

SEQ ID NO: 2066 - RNA, 17 nt, Homo sapiens
agaggauucuggacucu

SEQ ID NO: 2067 - RNA, 17 nt, Homo sapiens
ucuggacucucucugcc

SEQ ID NO: 2068 - RNA, 17 nt, Homo sapiens
uggacucucucugccua

SEQ ID NO: 2069 - RNA, 17 nt, Homo sapiens
gacucucucugccuacc

SEQ ID NO: 2070 - RNA, 17 nt, Homo sapiens
cucugccuaccucaccu

SEQ ID NO: 2071 - RNA, 17 nt, Homo sapiens
gccuaccucaccuguuu

SEQ ID NO: 2072 - RNA, 17 nt, Homo sapiens
ucaccuguuuccuguau

SEQ ID NO: 2073 - RNA, 17 nt, Homo sapiens
caccuguuuccuguaug

SEQ ID NO: 2074 - RNA, 17 nt, Homo sapiens
accuguuuccuguaugg

SEQ ID NO: 2075 - RNA, 17 nt, Homo sapiens
uuuccuguauggaggag

SEQ ID NO: 2076 - RNA, 17 nt, Homo sapiens
gaggaaguaugugaccc

SEQ ID NO: 2077 - RNA, 17 nt, Homo sapiens
ccccaaauuccauuaug

SEQ ID NO: 2078 - RNA, 17 nt, Homo sapiens
cccaaauuccauuauga

SEQ ID NO: 2079 - RNA, 17 nt, Homo sapiens
aauuccauuaugacaac

SEQ ID NO: 2080 - RNA, 17 nt, Homo sapiens
auuccauuaugacaaca

SEQ ID NO: 2081 - RNA, 17 nt, Homo sapiens
gcaggaaucagucagua

SEQ ID NO: 2082 - RNA, 17 nt, Homo sapiens
gaaucagucaguaucug

SEQ ID NO: 2083 - RNA, 17 nt, Homo sapiens
cagucaguaucugcaga

SEQ ID NO: 2084 - RNA, 17 nt, Homo sapiens
gucaguaucugcagaac

SEQ ID NO: 2085 - RNA, 17 nt, Homo sapiens
agaacaguaagcgaaag

SEQ ID NO: 2086 - RNA, 17 nt, Homo sapiens
gugaguguaaaaacauu

SEQ ID NO: 2087 - RNA, 17 nt, Homo sapiens
aaaaacauuugaagaua

SEQ ID NO: 2088 - RNA, 17 nt, Homo sapiens
aaaacauuugaagauau

SEQ ID NO: 2089 - RNA, 17 nt, Homo sapiens
uugaagauaucccguua

SEQ ID NO: 2090 - RNA, 17 nt, Homo sapiens
gaagauaucccguuaga

SEQ ID NO: 2091 - RNA, 17 nt, Homo sapiens
uaucccguuagaagaac

SEQ ID NO: 2092 - RNA, 17 nt, Homo sapiens
aucccguuagaagaacc

SEQ ID NO: 2093 - RNA, 17 nt, Homo sapiens
ccagaaguaaaaguaau

SEQ ID NO: 2094 - RNA, 17 nt, Homo sapiens
guaaaaguaaucccaga

SEQ ID NO: 2095 - RNA, 17 nt, Homo sapiens
aaaguaaucccagauga

SEQ ID NO: 2096 - RNA, 17 nt, Homo sapiens
acagugguaugguucuu

SEQ ID NO: 2097 - RNA, 17 nt, Homo sapiens
gguaugguucuugccuc

SEQ ID NO: 2098 - RNA, 17 nt, Homo sapiens
guaugguucuugccuca

SEQ ID NO: 2099 - RNA, 17 nt, Homo sapiens
augguucuugccucaga

SEQ ID NO: 2100 - RNA, 17 nt, Homo sapiens
ucuugccucagaagagc

SEQ ID NO: 2101 - RNA, 17 nt, Homo sapiens
ugaaaacuuuggaagac

SEQ ID NO: 2102 - RNA, 17 nt, Homo sapiens
gaaaacuuuggaagaca

SEQ ID NO: 2103 - RNA, 17 nt, Homo sapiens
aaccaaauuaucuccau

SEQ ID NO: 2104 - RNA, 17 nt, Homo sapiens
accaaauuaucuccauc

SEQ ID NO: 2105 - RNA, 17 nt, Homo sapiens
caaauuaucuccaucuu

SEQ ID NO: 2106 - RNA, 17 nt, Homo sapiens
aauuaucuccaucuuuu

SEQ ID NO: 2107 - RNA, 17 nt, Homo sapiens
aucuccaucuuuuggug

SEQ ID NO: 2108 - RNA, 17 nt, Homo sapiens
cuccaucuuuuggugga

SEQ ID NO: 2109 - RNA, 17 nt, Homo sapiens
uccaucuuuugguggaa

SEQ ID NO: 2110 - RNA, 17 nt, Homo sapiens
ccaucuuuugguggaau

SEQ ID NO: 2111 - RNA, 17 nt, Homo sapiens
cagggagucuguggcau

SEQ ID NO: 2112 - RNA, 17 nt, Homo sapiens
uguggcaucugaaggcu

SEQ ID NO: 2113 - RNA, 17 nt, Homo sapiens
ugaaggcucaaaccaga

SEQ ID NO: 2114 - RNA, 17 nt, Homo sapiens
aagcggcuaccaguccg

SEQ ID NO: 2115 - RNA, 17 nt, Homo sapiens
cuaccaguccggauauc

SEQ ID NO: 2116 - RNA, 17 nt, Homo sapiens
guccggauaucacuccg

SEQ ID NO: 2117 - RNA, 17 nt, Homo sapiens
ccggauaucacuccgau

SEQ ID NO: 2118 - RNA, 17 nt, Homo sapiens
auaucacuccgaugaca

SEQ ID NO: 2119 - RNA, 17 nt, Homo sapiens
caccguguacuccagug

SEQ ID NO: 2120 - RNA, 17 nt, Homo sapiens
cguguacuccagugagg

SEQ ID NO: 2121 - RNA, 17 nt, Homo sapiens
gcagaacuuuuaaagcu

SEQ ID NO: 2122 - RNA, 17 nt, Homo sapiens
cagaacuuuuaaagcug

SEQ ID NO: 2123 - RNA, 17 nt, Homo sapiens
agaacuuuuaaagcuga

SEQ ID NO: 2124 - RNA, 17 nt, Homo sapiens
gaacuuuuaaagcugau

SEQ ID NO: 2125 - RNA, 17 nt, Homo sapiens
aagcugauagagauugg

SEQ ID NO: 2126 - RNA, 17 nt, Homo sapiens
auagagauuggagugca

SEQ ID NO: 2127 - RNA, 17 nt, Homo sapiens
aaaccgguagcacagcc

SEQ ID NO: 2128 - RNA, 17 nt, Homo sapiens
gcccagauucuccagcc

SEQ ID NO: 2129 - RNA, 17 nt, Homo sapiens
cccagauucuccagccu

SEQ ID NO: 2130 - RNA, 17 nt, Homo sapiens
cagauucuccagccuga

SEQ ID NO: 2131 - RNA, 17 nt, Homo sapiens
acugagcucuccuccug

SEQ ID NO: 2132 - RNA, 17 nt, Homo sapiens
ugagcucuccuccuguu

SEQ ID NO: 2133 - RNA, 17 nt, Homo sapiens
gcucuccuccuguuuaa

SEQ ID NO: 2134 - RNA, 17 nt, Homo sapiens
ccuccuguuuaaaagga

SEQ ID NO: 2135 - RNA, 17 nt, Homo sapiens
cuccuguuuaaaaggaa

SEQ ID NO: 2136 - RNA, 17 nt, Homo sapiens
uccuguuuaaaaggaag

SEQ ID NO: 2137 - RNA, 17 nt, Homo sapiens
ggaagcauccacacccc

SEQ ID NO: 2138 - RNA, 17 nt, Homo sapiens
ccccaacucccggacau

SEQ ID NO: 2139 - RNA, 17 nt, Homo sapiens
ccggacaucacaugaga

SEQ ID NO: 2140 - RNA, 17 nt, Homo sapiens
ugagaggucugcucaga

SEQ ID NO: 2141 - RNA, 17 nt, Homo sapiens
ggucugcucagauuuug

SEQ ID NO: 2142 - RNA, 17 nt, Homo sapiens
gcucagauuuugaagug

SEQ ID NO: 2143 - RNA, 17 nt, Homo sapiens
cucagauuuugaagugu

SEQ ID NO: 2144 - RNA, 17 nt, Homo sapiens
ucagauuuugaaguguu

SEQ ID NO: 2145 - RNA, 17 nt, Homo sapiens
ugaaguguuguucuuuc

SEQ ID NO: 2146 - RNA, 17 nt, Homo sapiens
aguguuguucuuuccac

SEQ ID NO: 2147 - RNA, 17 nt, Homo sapiens
guguuguucuuuccacc

SEQ ID NO: 2148 - RNA, 17 nt, Homo sapiens
guuguucuuuccaccag

SEQ ID NO: 2149 - RNA, 17 nt, Homo sapiens
uuguucuuuccaccagc

SEQ ID NO: 2150 - RNA, 17 nt, Homo sapiens
uguucuuuccaccagca

SEQ ID NO: 2151 - RNA, 17 nt, Homo sapiens
caggaaguagccgcauu

SEQ ID NO: 2152 - RNA, 17 nt, Homo sapiens
agccgcauuugauuuuc

SEQ ID NO: 2153 - RNA, 17 nt, Homo sapiens
gccgcauuugauuuuca

SEQ ID NO: 2154 - RNA, 17 nt, Homo sapiens
cauuugauuuucauuuc

SEQ ID NO: 2155 - RNA, 17 nt, Homo sapiens
auuugauuuucauuucg

SEQ ID NO: 2156 - RNA, 17 nt, Homo sapiens
uuugauuuucauuucga

SEQ ID NO: 2157 - RNA, 17 nt, Homo sapiens
uugauuuucauuucgac

SEQ ID NO: 2158 - RNA, 17 nt, Homo sapiens
auuuucauuucgacaac

SEQ ID NO: 2159 - RNA, 17 nt, Homo sapiens
uuuucauuucgacaaca

SEQ ID NO: 2160 - RNA, 17 nt, Homo sapiens
uuucauuucgacaacag

SEQ ID NO: 2161 - RNA, 17 nt, Homo sapiens
aaggaccucggacugca

SEQ ID NO: 2162 - RNA, 17 nt, Homo sapiens
agccagcucuucuaggc

SEQ ID NO: 2163 - RNA, 17 nt, Homo sapiens
ccagcucuucuaggcuu

SEQ ID NO: 2164 - RNA, 17 nt, Homo sapiens
cagcucuucuaggcuug

SEQ ID NO: 2165 - RNA, 17 nt, Homo sapiens
gcucuucuaggcuugug

SEQ ID NO: 2166 - RNA, 18 nt, Homo sapiens
aggugcugcuggccgucg

SEQ ID NO: 2167 - RNA, 18 nt, Homo sapiens
gcuggccgucgcccugug

SEQ ID NO: 2168 - RNA, 18 nt, Homo sapiens
ccgggccgccucuguggg

SEQ ID NO: 2169 - RNA, 18 nt, Homo sapiens
uugaucugcccaggcuca

SEQ ID NO: 2170 - RNA, 18 nt, Homo sapiens
ggaaacugacuuggccuc

SEQ ID NO: 2171 - RNA, 18 nt, Homo sapiens
gauuacagaucuccauuu

SEQ ID NO: 2172 - RNA, 18 nt, Homo sapiens
uguuccugaugguaacag

SEQ ID NO: 2173 - RNA, 18 nt, Homo sapiens
guuaccagucuauuaugu

SEQ ID NO: 2174 - RNA, 18 nt, Homo sapiens
ugaguccgucucauggaa

SEQ ID NO: 2175 - RNA, 18 nt, Homo sapiens
acuaucuguuggagaaaa

SEQ ID NO: 2176 - RNA, 18 nt, Homo sapiens
aaacccagucugggagug

SEQ ID NO: 2177 - RNA, 18 nt, Homo sapiens
gugggcugaugaccaaga

SEQ ID NO: 2178 - RNA, 18 nt, Homo sapiens
auguacugacgauuaugg

SEQ ID NO: 2179 - RNA, 18 nt, Homo sapiens
caccccagauuggugaga

SEQ ID NO: 2180 - RNA, 18 nt, Homo sapiens
auguacggucuaugccau

SEQ ID NO: 2181 - RNA, 18 nt, Homo sapiens
auuggcaguuggaggaag

SEQ ID NO: 2182 - RNA, 18 nt, Homo sapiens
ccaagcugucucagugac

SEQ ID NO: 2183 - RNA, 18 nt, Homo sapiens
ugugucagcuuuguacaa

SEQ ID NO: 2184 - RNA, 18 nt, Homo sapiens
acaugcagcccacugagc

SEQ ID NO: 2185 - RNA, 18 nt, Homo sapiens
gcagacagaucuacguuu

SEQ ID NO: 2186 - RNA, 18 nt, Homo sapiens
gcccacagccucugccaa

SEQ ID NO: 2187 - RNA, 18 nt, Homo sapiens
cacaccuguuugcaagaa

SEQ ID NO: 2188 - RNA, 18 nt, Homo sapiens
uaugucugccuugcucaa

SEQ ID NO: 2189 - RNA, 18 nt, Homo sapiens
ucaggcagcucacagucc

SEQ ID NO: 2190 - RNA, 18 nt, Homo sapiens
gcucacaguccuagagcg

SEQ ID NO: 2191 - RNA, 18 nt, Homo sapiens
agaaucagacgacaagua

SEQ ID NO: 2192 - RNA, 18 nt, Homo sapiens
cuccacagaucauguggu

SEQ ID NO: 2193 - RNA, 18 nt, Homo sapiens
ggauccagaugaacuccc

SEQ ID NO: 2194 - RNA, 18 nt, Homo sapiens
aacgacugccuuaugaug

SEQ ID NO: 2195 - RNA, 18 nt, Homo sapiens
gagaccggcugaaccuag

SEQ ID NO: 2196 - RNA, 18 nt, Homo sapiens
ugaagcagaugccuuugg

SEQ ID NO: 2197 - RNA, 18 nt, Homo sapiens
gaaaccuguccacuuacc

SEQ ID NO: 2198 - RNA, 18 nt, Homo sapiens
ucagccagcucuggauuu

SEQ ID NO: 2199 - RNA, 18 nt, Homo sapiens
acuuccugaccuuggagc

SEQ ID NO: 2200 - RNA, 18 nt, Homo sapiens
uguuacagcuuccaagug

SEQ ID NO: 2201 - RNA, 18 nt, Homo sapiens
agauccagauuaugucag

SEQ ID NO: 2202 - RNA, 18 nt, Homo sapiens
ggccccugauuauacuac

SEQ ID NO: 2203 - RNA, 18 nt, Homo sapiens
uguaccagaccaugcugg

SEQ ID NO: 2204 - RNA, 18 nt, Homo sapiens
cuggacugcuggcacggg

SEQ ID NO: 2205 - RNA, 18 nt, Homo sapiens
ucucucugccuaccucac

SEQ ID NO: 2206 - RNA, 18 nt, Homo sapiens
cucaccuguuuccuguau

SEQ ID NO: 2207 - RNA, 18 nt, Homo sapiens
agagccggccugugagug

SEQ ID NO: 2208 - RNA, 18 nt, Homo sapiens
aaucccagaugacaacca

SEQ ID NO: 2209 - RNA, 18 nt, Homo sapiens
acaaccagacggacagug

SEQ ID NO: 2210 - RNA, 18 nt, Homo sapiens
gcuaccaguccggauauc

SEQ ID NO: 2211 - RNA, 18 nt, Homo sapiens
ucacuccgaugacacaga

SEQ ID NO: 2212 - RNA, 18 nt, Homo sapiens
uagcacagcccagauucu

SEQ ID NO: 2213 - RNA, 18 nt, Homo sapiens
cagcccagauucuccagc

SEQ ID NO: 2214 - RNA, 18 nt, Homo sapiens
uucuccagccugacacgg

SEQ ID NO: 2215 - RNA, 18 nt, Homo sapiens
uccuccuguuuaaaagga

SEQ ID NO: 2216 - RNA, 18 nt, Homo sapiens
gaggucugcucagauuuu

SEQ ID NO: 2217 - RNA, 18 nt, Homo sapiens
cugcucagauuuugaagu

SEQ ID NO: 2218 - RNA, 18 nt, Homo sapiens
gaccucggacugcaggga

SEQ ID NO: 2219 - RNA, 18 nt, Homo sapiens
ggagccagcucuucuagg

SEQ ID NO: 2220 - RNA, 17 nt, Mus sp.
gggcgaauuggguacgg

SEQ ID NO: 2221 - RNA, 17 nt, Mus sp.
aauuggguacgggaccc

SEQ ID NO: 2222 - RNA, 17 nt, Mus sp.
accccccucgaggucga

SEQ ID NO: 2223 - RNA, 17 nt, Mus sp.
cucgaggucgacgguau

SEQ ID NO: 2224 - RNA, 17 nt, Mus sp.
ucgacgguaucgauaag

SEQ ID NO: 2225 - RNA, 17 nt, Mus sp.
gacgguaucgauaagcu

SEQ ID NO: 2226 - RNA, 17 nt, Mus sp.
guaucgauaagcuugau

SEQ ID NO: 2227 - RNA, 17 nt, Mus sp.
gauaagcuugauaucga

SEQ ID NO: 2228 - RNA, 17 nt, Mus sp.
agcuugauaucgaauuc

SEQ ID NO: 2229 - RNA, 17 nt, Mus sp.
cuugauaucgaauucgg

SEQ ID NO: 2230 - RNA, 17 nt, Mus sp.
uaucgaauucgggccca

SEQ ID NO: 2231 - RNA, 17 nt, Mus sp.
aucgaauucgggcccag

SEQ ID NO: 2232 - RNA, 17 nt, Mus sp.
gacugugucccgcagcc

SEQ ID NO: 2233 - RNA, 17 nt, Mus sp.
gccgggauaaccuggcu

SEQ ID NO: 2234 - RNA, 17 nt, Mus sp.
gacccgauuccgcggac

SEQ ID NO: 2235 - RNA, 17 nt, Mus sp.
acccgauuccgcggaca

SEQ ID NO: 2236 - RNA, 17 nt, Mus sp.
cccgcgcucuccccggu

SEQ ID NO: 2237 - RNA, 17 nt, Mus sp.
cgcgcucuccccggucu

SEQ ID NO: 2238 - RNA, 17 nt, Mus sp.
uccccggucuugcgcug

SEQ ID NO: 2239 - RNA, 17 nt, Mus sp.
cccggucuugcgcugcg

SEQ ID NO: 2240 - RNA, 17 nt, Mus sp.
ggggccauaccgccucu

SEQ ID NO: 2241 - RNA, 17 nt, Mus sp.
uaccgccucugugacuu

SEQ ID NO: 2242 - RNA, 17 nt, Mus sp.
cugugacuucuuugcgg

SEQ ID NO: 2243 - RNA, 17 nt, Mus sp.
ugugacuucuuugcggg

SEQ ID NO: 2244 - RNA, 17 nt, Mus sp.
ugacuucuuugcgggcc

SEQ ID NO: 2245 - RNA, 17 nt, Mus sp.
gacuucuuugcgggcca

SEQ ID NO: 2246 - RNA, 17 nt, Mus sp.
gaaggagucugugccug

SEQ ID NO: 2247 - RNA, 17 nt, Mus sp.
acugggcucugugccca

SEQ ID NO: 2248 - RNA, 17 nt, Mus sp.
gcgcugcuagcugucgc

SEQ ID NO: 2249 - RNA, 17 nt, Mus sp.
cuagcugucgcucugug

SEQ ID NO: 2250 - RNA, 17 nt, Mus sp.
cugucgcucugugguuc

SEQ ID NO: 2251 - RNA, 17 nt, Mus sp.
ucugugguucugcgugg

SEQ ID NO: 2252 - RNA, 17 nt, Mus sp.
cugugguucugcgugga

SEQ ID NO: 2253 - RNA, 17 nt, Mus sp.
agccgccucuguggguu

SEQ ID NO: 2254 - RNA, 17 nt, Mus sp.
cuguggguuugacuggc

SEQ ID NO: 2255 - RNA, 17 nt, Mus sp.
uguggguuugacuggcg

SEQ ID NO: 2256 - RNA, 17 nt, Mus sp.
cuggcgauuuucuccau

SEQ ID NO: 2257 - RNA, 17 nt, Mus sp.
uggcgauuuucuccauc

SEQ ID NO: 2258 - RNA, 17 nt, Mus sp.
ggcgauuuucuccaucc

SEQ ID NO: 2259 - RNA, 17 nt, Mus sp.
gcgauuuucuccauccc

SEQ ID NO: 2260 - RNA, 17 nt, Mus sp.
gauuuucuccauccccc

SEQ ID NO: 2261 - RNA, 17 nt, Mus sp.
uucuccauccccccaag

SEQ ID NO: 2262 - RNA, 17 nt, Mus sp.
cccaagcucagcacaca

SEQ ID NO: 2263 - RNA, 17 nt, Mus sp.
aaagacauacugacaau

SEQ ID NO: 2264 - RNA, 17 nt, Mus sp.
cugacaauuuuggcaaa

SEQ ID NO: 2265 - RNA, 17 nt, Mus sp.
ugacaauuuuggcaaau

SEQ ID NO: 2266 - RNA, 17 nt, Mus sp.
gacaauuuuggcaaaua

SEQ ID NO: 2267 - RNA, 17 nt, Mus sp.
uggcaaauacaacccuu

SEQ ID NO: 2268 - RNA, 17 nt, Mus sp.
acaacccuucagauuac

SEQ ID NO: 2269 - RNA, 17 nt, Mus sp.
caacccuucagauuacu

SEQ ID NO: 2270 - RNA, 17 nt, Mus sp.
cuucagauuacuugcag

SEQ ID NO: 2271 - RNA, 17 nt, Mus sp.
uucagauuacuugcagg

SEQ ID NO: 2272 - RNA, 17 nt, Mus sp.
agauuacuugcagggga

SEQ ID NO: 2273 - RNA, 17 nt, Mus sp.
ccaaugcucagcgugau

SEQ ID NO: 2274 - RNA, 17 nt, Mus sp.
agcgugauucugaggaa

SEQ ID NO: 2275 - RNA, 17 nt, Mus sp.
gcgugauucugaggaaa

SEQ ID NO: 2276 - RNA, 17 nt, Mus sp.
gaaaggguauuggugac

SEQ ID NO: 2277 - RNA, 17 nt, Mus sp.
aaggguauuggugacug

SEQ ID NO: 2278 - RNA, 17 nt, Mus sp.
gugacaguaucuucugc

SEQ ID NO: 2279 - RNA, 17 nt, Mus sp.
gacaguaucuucugcaa

SEQ ID NO: 2280 - RNA, 17 nt, Mus sp.
caguaucuucugcaaaa

SEQ ID NO: 2281 - RNA, 17 nt, Mus sp.
aguaucuucugcaaaac

SEQ ID NO: 2282 - RNA, 17 nt, Mus sp.
aaaacacucaccauucc

SEQ ID NO: 2283 - RNA, 17 nt, Mus sp.
cucaccauucccagggu

SEQ ID NO: 2284 - RNA, 17 nt, Mus sp.
ucaccauucccagggug

SEQ ID NO: 2285 - RNA, 17 nt, Mus sp.
agggugguuggaaauga

SEQ ID NO: 2286 - RNA, 17 nt, Mus sp.
gaaaugauacuggagcc

SEQ ID NO: 2287 - RNA, 17 nt, Mus sp.
caagugcucguaccggg

SEQ ID NO: 2288 - RNA, 17 nt, Mus sp.
gugcucguaccgggacg

SEQ ID NO: 2289 - RNA, 17 nt, Mus sp.
cgggacgucgacauagc

SEQ ID NO: 2290 - RNA, 17 nt, Mus sp.
gucgacauagccuccac

SEQ ID NO: 2291 - RNA, 17 nt, Mus sp.
cauagccuccacuguuu

SEQ ID NO: 2292 - RNA, 17 nt, Mus sp.
uccacuguuuaugucua

SEQ ID NO: 2293 - RNA, 17 nt, Mus sp.
ccacuguuuaugucuau

SEQ ID NO: 2294 - RNA, 17 nt, Mus sp.
cacuguuuaugucuaug

SEQ ID NO: 2295 - RNA, 17 nt, Mus sp.
guuuaugucuauguucg

SEQ ID NO: 2296 - RNA, 17 nt, Mus sp.
uuaugucuauguucgag

SEQ ID NO: 2297 - RNA, 17 nt, Mus sp.
gucuauguucgagauua

SEQ ID NO: 2298 - RNA, 17 nt, Mus sp.
ucuauguucgagauuac

SEQ ID NO: 2299 - RNA, 17 nt, Mus sp.
uucgagauuacagauca

SEQ ID NO: 2300 - RNA, 17 nt, Mus sp.
ucgagauuacagaucac

SEQ ID NO: 2301 - RNA, 17 nt, Mus sp.
uuacagaucaccauuca

SEQ ID NO: 2302 - RNA, 17 nt, Mus sp.
aucaccauucaucgccu

SEQ ID NO: 2303 - RNA, 17 nt, Mus sp.
ucaccauucaucgccuc

SEQ ID NO: 2304 - RNA, 17 nt, Mus sp.
ccauucaucgccucugu

SEQ ID NO: 2305 - RNA, 17 nt, Mus sp.
caucgccucugucagug

SEQ ID NO: 2306 - RNA, 17 nt, Mus sp.
gccucugucagugacca

SEQ ID NO: 2307 - RNA, 17 nt, Mus sp.
cauggcaucguguacau

SEQ ID NO: 2308 - RNA, 17 nt, Mus sp.
caucguguacaucaccg

SEQ ID NO: 2309 - RNA, 17 nt, Mus sp.
guguacaucaccgagaa

SEQ ID NO: 2310 - RNA, 17 nt, Mus sp.
guggugauccccugccg

SEQ ID NO: 2311 - RNA, 17 nt, Mus sp.
ccgagggucgauuucaa

SEQ ID NO: 2312 - RNA, 17 nt, Mus sp.
gggucgauuucaaaccu

SEQ ID NO: 2313 - RNA, 17 nt, Mus sp.
ggucgauuucaaaccuc

SEQ ID NO: 2314 - RNA, 17 nt, Mus sp.
gucgauuucaaaccuca

SEQ ID NO: 2315 - RNA, 17 nt, Mus sp.
ucaaaccucaauguguc

SEQ ID NO: 2316 - RNA, 17 nt, Mus sp.
caaugugucucuuugcg

SEQ ID NO: 2317 - RNA, 17 nt, Mus sp.
augugucucuuugcgcu

SEQ ID NO: 2318 - RNA, 17 nt, Mus sp.
gugucucuuugcgcuag

SEQ ID NO: 2319 - RNA, 17 nt, Mus sp.
ugucucuuugcgcuagg

SEQ ID NO: 2320 - RNA, 17 nt, Mus sp.
uuugcgcuagguaucca

SEQ ID NO: 2321 - RNA, 17 nt, Mus sp.
cgcuagguauccagaaa

SEQ ID NO: 2322 - RNA, 17 nt, Mus sp.
cuagguauccagaaaag

SEQ ID NO: 2323 - RNA, 17 nt, Mus sp.
aaagagauuuguuccgg

SEQ ID NO: 2324 - RNA, 17 nt, Mus sp.
aagagauuuguuccgga

SEQ ID NO: 2325 - RNA, 17 nt, Mus sp.
agauuuguuccggaugg

SEQ ID NO: 2326 - RNA, 17 nt, Mus sp.
gauuuguuccggaugga

SEQ ID NO: 2327 - RNA, 17 nt, Mus sp.
agcgagauaggcuuuac

SEQ ID NO: 2328 - RNA, 17 nt, Mus sp.
gauaggcuuuacucucc

SEQ ID NO: 2329 - RNA, 17 nt, Mus sp.
auaggcuuuacucuccc

SEQ ID NO: 2330 - RNA, 17 nt, Mus sp.
uaggcuuuacucucccc

SEQ ID NO: 2331 - RNA, 17 nt, Mus sp.
gcuuuacucuccccagu

SEQ ID NO: 2332 - RNA, 17 nt, Mus sp.
uuuacucuccccaguua

SEQ ID NO: 2333 - RNA, 17 nt, Mus sp.
uccccaguuacaugauc

SEQ ID NO: 2334 - RNA, 17 nt, Mus sp.
ccccaguuacaugauca

SEQ ID NO: 2335 - RNA, 17 nt, Mus sp.
gaucagcuaugccggca

SEQ ID NO: 2336 - RNA, 17 nt, Mus sp.
cauggucuucugugagg

SEQ ID NO: 2337 - RNA, 17 nt, Mus sp.
auggucuucugugaggc

SEQ ID NO: 2338 - RNA, 17 nt, Mus sp.
gcaaagaucaaugauga

SEQ ID NO: 2339 - RNA, 17 nt, Mus sp.
ugaaaccuaucagucua

SEQ ID NO: 2340 - RNA, 17 nt, Mus sp.
aaaccuaucagucuauc

SEQ ID NO: 2341 - RNA, 17 nt, Mus sp.
cuaucagucuaucaugu

SEQ ID NO: 2342 - RNA, 17 nt, Mus sp.
aucagucuaucauguac

SEQ ID NO: 2343 - RNA, 17 nt, Mus sp.
cagucuaucauguacau

SEQ ID NO: 2344 - RNA, 17 nt, Mus sp.
uaucauguacauaguug

SEQ ID NO: 2345 - RNA, 17 nt, Mus sp.
auguacauaguuguggu

SEQ ID NO: 2346 - RNA, 17 nt, Mus sp.
uacauaguugugguugu

SEQ ID NO: 2347 - RNA, 17 nt, Mus sp.
guugugguuguaggaua

SEQ ID NO: 2348 - RNA, 17 nt, Mus sp.
gugguuguaggauauag

SEQ ID NO: 2349 - RNA, 17 nt, Mus sp.
uguaggauauaggauuu

SEQ ID NO: 2350 - RNA, 17 nt, Mus sp.
uaggauauaggauuuau

SEQ ID NO: 2351 - RNA, 17 nt, Mus sp.
uaggauuuaugauguga

SEQ ID NO: 2352 - RNA, 17 nt, Mus sp.
gaugugauucugagccc

SEQ ID NO: 2353 - RNA, 17 nt, Mus sp.
augugauucugagcccc

SEQ ID NO: 2354 - RNA, 17 nt, Mus sp.
caugaaauugagcuauc

SEQ ID NO: 2355 - RNA, 17 nt, Mus sp.
auugagcuaucugccgg

SEQ ID NO: 2356 - RNA, 17 nt, Mus sp.
ugagcuaucugccggag

SEQ ID NO: 2357 - RNA, 17 nt, Mus sp.
gaaaaacuugucuuaaa

SEQ ID NO: 2358 - RNA, 17 nt, Mus sp.
aaacuugucuuaaauug

SEQ ID NO: 2359 - RNA, 17 nt, Mus sp.
acuugucuuaaauugua

SEQ ID NO: 2360 - RNA, 17 nt, Mus sp.
ucuuaaauuguacagcg

SEQ ID NO: 2361 - RNA, 17 nt, Mus sp.
uaaauuguacagcgaga

SEQ ID NO: 2362 - RNA, 17 nt, Mus sp.
acagagcucaauguggg

SEQ ID NO: 2363 - RNA, 17 nt, Mus sp.
guggggcuugauuucac

SEQ ID NO: 2364 - RNA, 17 nt, Mus sp.
ggcuugauuucaccugg

SEQ ID NO: 2365 - RNA, 17 nt, Mus sp.
gcuugauuucaccuggc

SEQ ID NO: 2366 - RNA, 17 nt, Mus sp.
cuugauuucaccuggca

SEQ ID NO: 2367 - RNA, 17 nt, Mus sp.
cuggcacucuccaccuu

SEQ ID NO: 2368 - RNA, 17 nt, Mus sp.
ggcacucuccaccuuca

SEQ ID NO: 2369 - RNA, 17 nt, Artificial Sequence
  Description of Artificial Sequence:  Nucleic Acid
cuccaccuucaaagucu

SEQ ID NO: 2370 - RNA, 17 nt, Mus sp.
uccaccuucaaagucuc

SEQ ID NO: 2371 - RNA, 17 nt, Mus sp.
uucaaagucucaucaua

SEQ ID NO: 2372 - RNA, 17 nt, Mus sp.
caaagucucaucauaag

SEQ ID NO: 2373 - RNA, 17 nt, Mus sp.
agucucaucauaagaag

SEQ ID NO: 2374 - RNA, 17 nt, Mus sp.
cucaucauaagaagauu

SEQ ID NO: 2375 - RNA, 17 nt, Mus sp.
aagaagauuguaaaccg

SEQ ID NO: 2376 - RNA, 17 nt, Mus sp.
aagauuguaaaccggga

SEQ ID NO: 2377 - RNA, 17 nt, Mus sp.
gaaacccuuuccuggga

SEQ ID NO: 2378 - RNA, 17 nt, Mus sp.
aaacccuuuccugggac

SEQ ID NO: 2379 - RNA, 17 nt, Mus sp.
aacccuuuccugggacu

SEQ ID NO: 2380 - RNA, 17 nt, Mus sp.
gaagauguuuuugagca

SEQ ID NO: 2381 - RNA, 17 nt, Mus sp.
aagauguuuuugagcac

SEQ ID NO: 2382 - RNA, 17 nt, Mus sp.
agauguuuuugagcacc

SEQ ID NO: 2383 - RNA, 17 nt, Mus sp.
gauguuuuugagcaccu

SEQ ID NO: 2384 - RNA, 17 nt, Mus sp.
gagcaccuugacaauag

SEQ ID NO: 2385 - RNA, 17 nt, Mus sp.
uugacaauagaaagugu

SEQ ID NO: 2386 - RNA, 17 nt, Mus sp.
aggggaauacaccugug

SEQ ID NO: 2387 - RNA, 17 nt, Mus sp.
accuguguagcguccag

SEQ ID NO: 2388 - RNA, 17 nt, Mus sp.
uguagcguccaguggac

SEQ ID NO: 2389 - RNA, 17 nt, Mus sp.
cggaugaucaagagaaa

SEQ ID NO: 2390 - RNA, 17 nt, Mus sp.
agagaaauagaacauuu

SEQ ID NO: 2391 - RNA, 17 nt, Mus sp.
uagaacauuuguccgag

SEQ ID NO: 2392 - RNA, 17 nt, Mus sp.
agaacauuuguccgagu

SEQ ID NO: 2393 - RNA, 17 nt, Mus sp.
acauuuguccgaguuca

SEQ ID NO: 2394 - RNA, 17 nt, Mus sp.
guccgaguucacacaaa

SEQ ID NO: 2395 - RNA, 17 nt, Mus sp.
uccgaguucacacaaag

SEQ ID NO: 2396 - RNA, 17 nt, Mus sp.
caaagccuuuuauugcu

SEQ ID NO: 2397 - RNA, 17 nt, Mus sp.
aaagccuuuuauugcuu

SEQ ID NO: 2398 - RNA, 17 nt, Mus sp.
aagccuuuuauugcuuu

SEQ ID NO: 2399 - RNA, 17 nt, Mus sp.
agccuuuuauugcuuuc

SEQ ID NO: 2400 - RNA, 17 nt, Mus sp.
ccuuuuauugcuuucgg

SEQ ID NO: 2401 - RNA, 17 nt, Mus sp.
uuauugcuuucgguagu

SEQ ID NO: 2402 - RNA, 17 nt, Mus sp.
uauugcuuucgguagug

SEQ ID NO: 2403 - RNA, 17 nt, Mus sp.
auugcuuucgguagugg

SEQ ID NO: 2404 - RNA, 17 nt, Mus sp.
cuuucgguagugggaug

SEQ ID NO: 2405 - RNA, 17 nt, Mus sp.
gaugaaaucuuuggugg

SEQ ID NO: 2406 - RNA, 17 nt, Mus sp.
ugaaaucuuugguggaa

SEQ ID NO: 2407 - RNA, 17 nt, Mus sp.
gaaaucuuugguggaag

SEQ ID NO: 2408 - RNA, 17 nt, Mus sp.
ugggcagucaaguccga

SEQ ID NO: 2409 - RNA, 17 nt, Mus sp.
agucaaguccgaauccc

SEQ ID NO: 2410 - RNA, 17 nt, Mus sp.
guccgaaucccugugaa

SEQ ID NO: 2411 - RNA, 17 nt, Mus sp.
ugugaaguaucucaguu

SEQ ID NO: 2412 - RNA, 17 nt, Mus sp.
ugaaguaucucaguuac

SEQ ID NO: 2413 - RNA, 17 nt, Mus sp.
aaguaucucaguuaccc

SEQ ID NO: 2414 - RNA, 17 nt, Mus sp.
aucucaguuacccagcu

SEQ ID NO: 2415 - RNA, 17 nt, Mus sp.
ucucaguuacccagcuc

SEQ ID NO: 2416 - RNA, 17 nt, Mus sp.
acccagcuccugauauc

SEQ ID NO: 2417 - RNA, 17 nt, Mus sp.
cuccugauaucaaaugg

SEQ ID NO: 2418 - RNA, 17 nt, Mus sp.
ccugauaucaaauggua

SEQ ID NO: 2419 - RNA, 17 nt, Mus sp.
caaaugguacagaaaug

SEQ ID NO: 2420 - RNA, 17 nt, Mus sp.
aggcccauugaguccaa

SEQ ID NO: 2421 - RNA, 17 nt, Mus sp.
cauugaguccaacuaca

SEQ ID NO: 2422 - RNA, 17 nt, Mus sp.
guccaacuacacaauga

SEQ ID NO: 2423 - RNA, 17 nt, Mus sp.
acaaugauuguuggcga

SEQ ID NO: 2424 - RNA, 17 nt, Mus sp.
augauuguuggcgauga

SEQ ID NO: 2425 - RNA, 17 nt, Mus sp.
gaugaacucaccaucau

SEQ ID NO: 2426 - RNA, 17 nt, Mus sp.
cucaccaucauggaagu

SEQ ID NO: 2427 - RNA, 17 nt, Mus sp.
aggaaacuacacgguca

SEQ ID NO: 2428 - RNA, 17 nt, Mus sp.
uacacggucauccucac

SEQ ID NO: 2429 - RNA, 17 nt, Mus sp.
acggucauccucaccaa

SEQ ID NO: 2430 - RNA, 17 nt, Mus sp.
gucauccucaccaaccc

SEQ ID NO: 2431 - RNA, 17 nt, Mus sp.
aaccccauuucaaugga

SEQ ID NO: 2432 - RNA, 17 nt, Mus sp.
accccauuucaauggag

SEQ ID NO: 2433 - RNA, 17 nt, Mus sp.
ccccauuucaauggaga

SEQ ID NO: 2434 - RNA, 17 nt, Mus sp.
cacauggucucucuggu

SEQ ID NO: 2435 - RNA, 17 nt, Mus sp.
cauggucucucugguug

SEQ ID NO: 2436 - RNA, 17 nt, Mus sp.
ucucugguugugaaugu

SEQ ID NO: 2437 - RNA, 17 nt, Mus sp.
gugaaugucccacccca

SEQ ID NO: 2438 - RNA, 17 nt, Mus sp.
ccccagaucggugagaa

SEQ ID NO: 2439 - RNA, 17 nt, Mus sp.
gaaagccuugaucucgc

SEQ ID NO: 2440 - RNA, 17 nt, Mus sp.
gccuugaucucgccuau

SEQ ID NO: 2441 - RNA, 17 nt, Mus sp.
cuugaucucgccuaugg

SEQ ID NO: 2442 - RNA, 17 nt, Mus sp.
ucucgccuauggauucc

SEQ ID NO: 2443 - RNA, 17 nt, Mus sp.
cuauggauuccuaccag

SEQ ID NO: 2444 - RNA, 17 nt, Mus sp.
uauggauuccuaccagu

SEQ ID NO: 2445 - RNA, 17 nt, Mus sp.
ggauuccuaccaguaug

SEQ ID NO: 2446 - RNA, 17 nt, Mus sp.
cuaccaguaugggacca

SEQ ID NO: 2447 - RNA, 17 nt, Mus sp.
gcagacauugacaugca

SEQ ID NO: 2448 - RNA, 17 nt, Mus sp.
ugcacagucuacgccaa

SEQ ID NO: 2449 - RNA, 17 nt, Mus sp.
cacagucuacgccaacc

SEQ ID NO: 2450 - RNA, 17 nt, Mus sp.
ccaacccuccccugcac

SEQ ID NO: 2451 - RNA, 17 nt, Mus sp.
caccacauccaguggua

SEQ ID NO: 2452 - RNA, 17 nt, Mus sp.
ccagugguacuggcagc

SEQ ID NO: 2453 - RNA, 17 nt, Mus sp.
uggcagcuagaagaagc

SEQ ID NO: 2454 - RNA, 17 nt, Mus sp.
agccugcuccuacagac

SEQ ID NO: 2455 - RNA, 17 nt, Mus sp.
cugcuccuacagacccg

SEQ ID NO: 2456 - RNA, 17 nt, Mus sp.
aagcccguaugcuugua

SEQ ID NO: 2457 - RNA, 17 nt, Mus sp.
cguaugcuuguaaagaa

SEQ ID NO: 2458 - RNA, 17 nt, Mus sp.
augcuuguaaagaaugg

SEQ ID NO: 2459 - RNA, 17 nt, Mus sp.
uggaggauuuccagggg

SEQ ID NO: 2460 - RNA, 17 nt, Mus sp.
ggaggauuuccaggggg

SEQ ID NO: 2461 - RNA, 17 nt, Mus sp.
gaggauuuccagggggg

SEQ ID NO: 2462 - RNA, 17 nt, Mus sp.
aacaagaucgaagucac

SEQ ID NO: 2463 - RNA, 17 nt, Mus sp.
aucgaagucaccaaaaa

SEQ ID NO: 2464 - RNA, 17 nt, Mus sp.
aaaccaauaugcccuga

SEQ ID NO: 2465 - RNA, 17 nt, Mus sp.
gcccugauugaaggaaa

SEQ ID NO: 2466 - RNA, 17 nt, Mus sp.
aaaacuguaaguacgcu

SEQ ID NO: 2467 - RNA, 17 nt, Mus sp.
cuguaaguacgcugguc

SEQ ID NO: 2468 - RNA, 17 nt, Mus sp.
acgcuggucauccaagc

SEQ ID NO: 2469 - RNA, 17 nt, Mus sp.
cuggucauccaagcugc

SEQ ID NO: 2470 - RNA, 17 nt, Mus sp.
caacgugucagcguugu

SEQ ID NO: 2471 - RNA, 17 nt, Mus sp.
gucagcguuguacaaau

SEQ ID NO: 2472 - RNA, 17 nt, Mus sp.
agcguuguacaaaugug

SEQ ID NO: 2473 - RNA, 17 nt, Mus sp.
gaagccaucaacaaagc

SEQ ID NO: 2474 - RNA, 17 nt, Mus sp.
gagagggucaucuccuu

SEQ ID NO: 2475 - RNA, 17 nt, Mus sp.
agggucaucuccuucca

SEQ ID NO: 2476 - RNA, 17 nt, Mus sp.
ggucaucuccuuccaug

SEQ ID NO: 2477 - RNA, 17 nt, Mus sp.
caucuccuuccauguga

SEQ ID NO: 2478 - RNA, 17 nt, Mus sp.
aucuccuuccaugugau

SEQ ID NO: 2479 - RNA, 17 nt, Mus sp.
caugugaucaggggucc

SEQ ID NO: 2480 - RNA, 17 nt, Mus sp.
ucagggguccugaaauu

SEQ ID NO: 2481 - RNA, 17 nt, Mus sp.
ccugaaauuacugugca

SEQ ID NO: 2482 - RNA, 17 nt, Mus sp.
cugaaauuacugugcaa

SEQ ID NO: 2483 - RNA, 17 nt, Mus sp.
gagugugucccuguugu

SEQ ID NO: 2484 - RNA, 17 nt, Mus sp.
gucccuguugugcacug

SEQ ID NO: 2485 - RNA, 17 nt, Mus sp.
acagaaauacguuugag

SEQ ID NO: 2486 - RNA, 17 nt, Mus sp.
aaauacguuugagaacc

SEQ ID NO: 2487 - RNA, 17 nt, Mus sp.
aauacguuugagaaccu

SEQ ID NO: 2488 - RNA, 17 nt, Mus sp.
gagaaccucacguggua

SEQ ID NO: 2489 - RNA, 17 nt, Mus sp.
cacgugguacaagcuug

SEQ ID NO: 2490 - RNA, 17 nt, Mus sp.
uacaagcuuggcucaca

SEQ ID NO: 2491 - RNA, 17 nt, Mus sp.
gcuuggcucacaggcaa

SEQ ID NO: 2492 - RNA, 17 nt, Mus sp.
ggcaacaucgguccaca

SEQ ID NO: 2493 - RNA, 17 nt, Mus sp.
acaucgguccacauggg

SEQ ID NO: 2494 - RNA, 17 nt, Mus sp.
gggcgaaucacucacac

SEQ ID NO: 2495 - RNA, 17 nt, Mus sp.
gaaucacucacaccagu

SEQ ID NO: 2496 - RNA, 17 nt, Mus sp.
acaccaguuugcaagaa

SEQ ID NO: 2497 - RNA, 17 nt, Mus sp.
caccaguuugcaagaac

SEQ ID NO: 2498 - RNA, 17 nt, Mus sp.
caagaacuuggaugcuc

SEQ ID NO: 2499 - RNA, 17 nt, Mus sp.
uggaugcucuuuggaaa

SEQ ID NO: 2500 - RNA, 17 nt, Mus sp.
gaugcucuuuggaaacu

SEQ ID NO: 2501 - RNA, 17 nt, Mus sp.
augcucuuuggaaacug

SEQ ID NO: 2502 - RNA, 17 nt, Mus sp.
caccauguuuucuaaca

SEQ ID NO: 2503 - RNA, 17 nt, Mus sp.
accauguuuucuaacag

SEQ ID NO: 2504 - RNA, 17 nt, Mus sp.
ccauguuuucuaacagc

SEQ ID NO: 2505 - RNA, 17 nt, Mus sp.
cauguuuucuaacagca

SEQ ID NO: 2506 - RNA, 17 nt, Mus sp.
uguuuucuaacagcaca

SEQ ID NO: 2507 - RNA, 17 nt, Mus sp.
aaugacaucuugauugu

SEQ ID NO: 2508 - RNA, 17 nt, Mus sp.
ugacaucuugauugugg

SEQ ID NO: 2509 - RNA, 17 nt, Mus sp.
aucuugauuguggcauu

SEQ ID NO: 2510 - RNA, 17 nt, Mus sp.
uguggcauuucagaaug

SEQ ID NO: 2511 - RNA, 17 nt, Mus sp.
guggcauuucagaaugc

SEQ ID NO: 2512 - RNA, 17 nt, Mus sp.
uggcauuucagaaugcc

SEQ ID NO: 2513 - RNA, 17 nt, Mus sp.
gaaugccucucugcagg

SEQ ID NO: 2514 - RNA, 17 nt, Mus sp.
augccucucugcaggac

SEQ ID NO: 2515 - RNA, 17 nt, Mus sp.
aggcgacuauguuugcu

SEQ ID NO: 2516 - RNA, 17 nt, Mus sp.
gacuauguuugcucugc

SEQ ID NO: 2517 - RNA, 17 nt, Mus sp.
acuauguuugcucugcu

SEQ ID NO: 2518 - RNA, 17 nt, Mus sp.
uguuugcucugcucaag

SEQ ID NO: 2519 - RNA, 17 nt, Mus sp.
gcucugcucaagauaag

SEQ ID NO: 2520 - RNA, 17 nt, Mus sp.
cucaagauaagaagacc

SEQ ID NO: 2521 - RNA, 17 nt, Mus sp.
aaagacauugccugguc

SEQ ID NO: 2522 - RNA, 17 nt, Mus sp.
ugccuggucaaacagcu

SEQ ID NO: 2523 - RNA, 17 nt, Mus sp.
aaacagcucaucauccu

SEQ ID NO: 2524 - RNA, 17 nt, Mus sp.
cagcucaucauccuaga

SEQ ID NO: 2525 - RNA, 17 nt, Mus sp.
cucaucauccuagagcg

SEQ ID NO: 2526 - RNA, 17 nt, Mus sp.
aucauccuagagcgcau

SEQ ID NO: 2527 - RNA, 17 nt, Mus sp.
cccaugaucaccggaaa

SEQ ID NO: 2528 - RNA, 17 nt, Mus sp.
ccggaaaucuggagaau

SEQ ID NO: 2529 - RNA, 17 nt, Mus sp.
uggagaaucagacaaca

SEQ ID NO: 2530 - RNA, 17 nt, Mus sp.
acaaccauuggcgagac

SEQ ID NO: 2531 - RNA, 17 nt, Mus sp.
gagaccauugaagugac

SEQ ID NO: 2532 - RNA, 17 nt, Mus sp.
aagugacuugcccagca

SEQ ID NO: 2533 - RNA, 17 nt, Mus sp.
cccagcaucuggaaauc

SEQ ID NO: 2534 - RNA, 17 nt, Mus sp.
cuggaaauccuacccca

SEQ ID NO: 2535 - RNA, 17 nt, Mus sp.
gaaauccuaccccacac

SEQ ID NO: 2536 - RNA, 17 nt, Mus sp.
ccacacauuacaugguu

SEQ ID NO: 2537 - RNA, 17 nt, Mus sp.
cacacauuacaugguuc

SEQ ID NO: 2538 - RNA, 17 nt, Mus sp.
uacaugguucaaagaca

SEQ ID NO: 2539 - RNA, 17 nt, Mus sp.
acaugguucaaagacaa

SEQ ID NO: 2540 - RNA, 17 nt, Mus sp.
acccugguagaagauuc

SEQ ID NO: 2541 - RNA, 17 nt, Mus sp.
uagaagauucaggcauu

SEQ ID NO: 2542 - RNA, 17 nt, Mus sp.
agaagauucaggcauug

SEQ ID NO: 2543 - RNA, 17 nt, Mus sp.
ucaggcauuguacugag

SEQ ID NO: 2544 - RNA, 17 nt, Mus sp.
ggcauuguacugagaga

SEQ ID NO: 2545 - RNA, 17 nt, Mus sp.
accugacuauccgcagg

SEQ ID NO: 2546 - RNA, 17 nt, Mus sp.
cugacuauccgcagggu

SEQ ID NO: 2547 - RNA, 17 nt, Mus sp.
ggaggccucuacaccug

SEQ ID NO: 2548 - RNA, 17 nt, Mus sp.
ugcaauguccuuggcug

SEQ ID NO: 2549 - RNA, 17 nt, Mus sp.
aauguccuuggcugugc

SEQ ID NO: 2550 - RNA, 17 nt, Mus sp.
gagacgcucuucauaau

SEQ ID NO: 2551 - RNA, 17 nt, Mus sp.
gacgcucuucauaauag

SEQ ID NO: 2552 - RNA, 17 nt, Mus sp.
acgcucuucauaauaga

SEQ ID NO: 2553 - RNA, 17 nt, Mus sp.
cucuucauaauagaagg

SEQ ID NO: 2554 - RNA, 17 nt, Mus sp.
gaccaacuuggaaguca

SEQ ID NO: 2555 - RNA, 17 nt, Mus sp.
uuggaagucauuauccu

SEQ ID NO: 2556 - RNA, 17 nt, Mus sp.
gaagucauuauccucgu

SEQ ID NO: 2557 - RNA, 17 nt, Mus sp.
aagucauuauccucguc

SEQ ID NO: 2558 - RNA, 17 nt, Mus sp.
gucauuauccucgucgg

SEQ ID NO: 2559 - RNA, 17 nt, Mus sp.
auuauccucgucggcac

SEQ ID NO: 2560 - RNA, 17 nt, Mus sp.
auccucgucggcacugc

SEQ ID NO: 2561 - RNA, 17 nt, Mus sp.
gcagugauugccauguu

SEQ ID NO: 2562 - RNA, 17 nt, Mus sp.
cauguucuucuggcucc

SEQ ID NO: 2563 - RNA, 17 nt, Mus sp.
auguucuucuggcuccu

SEQ ID NO: 2564 - RNA, 17 nt, Mus sp.
uucuggcuccuucuugu

SEQ ID NO: 2565 - RNA, 17 nt, Mus sp.
uggcuccuucuugucau

SEQ ID NO: 2566 - RNA, 17 nt, Mus sp.
ggcuccuucuugucauu

SEQ ID NO: 2567 - RNA, 17 nt, Mus sp.
cuccuucuugucauugu

SEQ ID NO: 2568 - RNA, 17 nt, Mus sp.
cuucuugucauuguccu

SEQ ID NO: 2569 - RNA, 17 nt, Mus sp.
cuugucauuguccuacg

SEQ ID NO: 2570 - RNA, 17 nt, Mus sp.
gucauuguccuacggac

SEQ ID NO: 2571 - RNA, 17 nt, Mus sp.
auuguccuacggaccgu

SEQ ID NO: 2572 - RNA, 17 nt, Mus sp.
cggaccguuaagcgggc

SEQ ID NO: 2573 - RNA, 17 nt, Mus sp.
gacaggcuacuugucua

SEQ ID NO: 2574 - RNA, 17 nt, Mus sp.
aggcuacuugucuauug

SEQ ID NO: 2575 - RNA, 17 nt, Mus sp.
cuacuugucuauuguca

SEQ ID NO: 2576 - RNA, 17 nt, Mus sp.
acuugucuauugucaug

SEQ ID NO: 2577 - RNA, 17 nt, Mus sp.
uugucuauugucaugga

SEQ ID NO: 2578 - RNA, 17 nt, Mus sp.
ucuauugucauggaucc

SEQ ID NO: 2579 - RNA, 17 nt, Mus sp.
agaugaauugcccuugg

SEQ ID NO: 2580 - RNA, 17 nt, Mus sp.
auugcccuuggaugagc

SEQ ID NO: 2581 - RNA, 17 nt, Mus sp.
ugaacgcuugccuuaug

SEQ ID NO: 2582 - RNA, 17 nt, Mus sp.
gcuugccuuaugaugcc

SEQ ID NO: 2583 - RNA, 17 nt, Mus sp.
cuugccuuaugaugcca

SEQ ID NO: 2584 - RNA, 17 nt, Mus sp.
gugggaauuccccaggg

SEQ ID NO: 2585 - RNA, 17 nt, Mus sp.
ugggaauuccccaggga

SEQ ID NO: 2586 - RNA, 17 nt, Mus sp.
cugaaacuaggaaaacc

SEQ ID NO: 2587 - RNA, 17 nt, Mus sp.
gaaaaccucuuggccgc

SEQ ID NO: 2588 - RNA, 17 nt, Mus sp.
aaaccucuuggccgcgg

SEQ ID NO: 2589 - RNA, 17 nt, Mus sp.
cggugccuucggccaag

SEQ ID NO: 2590 - RNA, 17 nt, Mus sp.
ggugccuucggccaagu

SEQ ID NO: 2591 - RNA, 17 nt, Mus sp.
caagugauugaggcaga

SEQ ID NO: 2592 - RNA, 17 nt, Mus sp.
cagacgcuuuuggaauu

SEQ ID NO: 2593 - RNA, 17 nt, Mus sp.
agacgcuuuuggaauug

SEQ ID NO: 2594 - RNA, 17 nt, Mus sp.
gacgcuuuuggaauuga

SEQ ID NO: 2595 - RNA, 17 nt, Mus sp.
cagcgacuugcaaaaca

SEQ ID NO: 2596 - RNA, 17 nt, Mus sp.
aaaacaguagccgucaa

SEQ ID NO: 2597 - RNA, 17 nt, Mus sp.
guagccgucaagauguu

SEQ ID NO: 2598 - RNA, 17 nt, Mus sp.
caagauguugaaagaag

SEQ ID NO: 2599 - RNA, 17 nt, Mus sp.
gcgagcaucgagcccuc

SEQ ID NO: 2600 - RNA, 17 nt, Mus sp.
cgagcccucaugucuga

SEQ ID NO: 2601 - RNA, 17 nt, Mus sp.
ccucaugucugaacuca

SEQ ID NO: 2602 - RNA, 17 nt, Mus sp.
cucaagauccucaucca

SEQ ID NO: 2603 - RNA, 17 nt, Mus sp.
aagauccucauccacau

SEQ ID NO: 2604 - RNA, 17 nt, Mus sp.
auccucauccacauugg

SEQ ID NO: 2605 - RNA, 17 nt, Mus sp.
auccacauuggucacca

SEQ ID NO: 2606 - RNA, 17 nt, Mus sp.
acauuggucaccaucuc

SEQ ID NO: 2607 - RNA, 17 nt, Mus sp.
gugaaccuccuaggcgc

SEQ ID NO: 2608 - RNA, 17 nt, Mus sp.
aaccuccuaggcgccug

SEQ ID NO: 2609 - RNA, 17 nt, Mus sp.
gagggccucucauggug

SEQ ID NO: 2610 - RNA, 17 nt, Mus sp.
gggccucucauggugau

SEQ ID NO: 2611 - RNA, 17 nt, Mus sp.
uguggaauucugcaagu

SEQ ID NO: 2612 - RNA, 17 nt, Mus sp.
guggaauucugcaaguu

SEQ ID NO: 2613 - RNA, 17 nt, Mus sp.
cugcaaguuuggaaacc

SEQ ID NO: 2614 - RNA, 17 nt, Mus sp.
ugcaaguuuggaaaccu

SEQ ID NO: 2615 - RNA, 17 nt, Mus sp.
ggaaaccuaucaacuua

SEQ ID NO: 2616 - RNA, 17 nt, Mus sp.
aaaccuaucaacuuacu

SEQ ID NO: 2617 - RNA, 17 nt, Mus sp.
uaucaacuuacuuacgg

SEQ ID NO: 2618 - RNA, 17 nt, Mus sp.
aucaacuuacuuacggg

SEQ ID NO: 2619 - RNA, 17 nt, Mus sp.
aacuuacuuacggggca

SEQ ID NO: 2620 - RNA, 17 nt, Mus sp.
acuuacuuacggggcaa

SEQ ID NO: 2621 - RNA, 17 nt, Mus sp.
aaaugaauuuguucccu

SEQ ID NO: 2622 - RNA, 17 nt, Mus sp.
aaugaauuuguucccua

SEQ ID NO: 2623 - RNA, 17 nt, Mus sp.
gaauuuguucccuauaa

SEQ ID NO: 2624 - RNA, 17 nt, Mus sp.
aauuuguucccuauaag

SEQ ID NO: 2625 - RNA, 17 nt, Mus sp.
uguucccuauaagagca

SEQ ID NO: 2626 - RNA, 17 nt, Mus sp.
uucccuauaagagcaaa

SEQ ID NO: 2627 - RNA, 17 nt, Mus sp.
ggcacgcuuccgccagg

SEQ ID NO: 2628 - RNA, 17 nt, Mus sp.
gcacgcuuccgccaggg

SEQ ID NO: 2629 - RNA, 17 nt, Mus sp.
caaggacuacguugggg

SEQ ID NO: 2630 - RNA, 17 nt, Mus sp.
gacuacguuggggagcu

SEQ ID NO: 2631 - RNA, 17 nt, Mus sp.
ggggagcucuccgugga

SEQ ID NO: 2632 - RNA, 17 nt, Mus sp.
ggagcucuccguggauc

SEQ ID NO: 2633 - RNA, 17 nt, Mus sp.
ccguggaucugaaaaga

SEQ ID NO: 2634 - RNA, 17 nt, Mus sp.
aagacgcuuggacagca

SEQ ID NO: 2635 - RNA, 17 nt, Mus sp.
gacagcaucaccagcag

SEQ ID NO: 2636 - RNA, 17 nt, Mus sp.
ccagagcucugccagcu

SEQ ID NO: 2637 - RNA, 17 nt, Mus sp.
ugccagcucaggcuuug

SEQ ID NO: 2638 - RNA, 17 nt, Mus sp.
cucaggcuuuguugagg

SEQ ID NO: 2639 - RNA, 17 nt, Mus sp.
ucaggcuuuguugagga

SEQ ID NO: 2640 - RNA, 17 nt, Mus sp.
ggcuuuguugaggagaa

SEQ ID NO: 2641 - RNA, 17 nt, Mus sp.
ggagaaaucgcucagug

SEQ ID NO: 2642 - RNA, 17 nt, Mus sp.
aaaucgcucagugaugu

SEQ ID NO: 2643 - RNA, 17 nt, Mus sp.
agugauguagaggaaga

SEQ ID NO: 2644 - RNA, 17 nt, Mus sp.
aagaagcuucugaagaa

SEQ ID NO: 2645 - RNA, 17 nt, Mus sp.
agaagcuucugaagaac

SEQ ID NO: 2646 - RNA, 17 nt, Mus sp.
agaacuguacaaggacu

SEQ ID NO: 2647 - RNA, 17 nt, Mus sp.
caaggacuuccugaccu

SEQ ID NO: 2648 - RNA, 17 nt, Mus sp.
ggaguucuuggcaucaa

SEQ ID NO: 2649 - RNA, 17 nt, Mus sp.
cuuggcaucaaggaagu

SEQ ID NO: 2650 - RNA, 17 nt, Mus sp.
ggaaguguauccacagg

SEQ ID NO: 2651 - RNA, 17 nt, Mus sp.
cgaaacauucuccuauc

SEQ ID NO: 2652 - RNA, 17 nt, Mus sp.
gaaacauucuccuaucg

SEQ ID NO: 2653 - RNA, 17 nt, Mus sp.
aacauucuccuaucgga

SEQ ID NO: 2654 - RNA, 17 nt, Mus sp.
auucuccuaucggagaa

SEQ ID NO: 2655 - RNA, 17 nt, Mus sp.
ucuccuaucggagaaga

SEQ ID NO: 2656 - RNA, 17 nt, Mus sp.
aaugugguuaagaucug

SEQ ID NO: 2657 - RNA, 17 nt, Mus sp.
augugguuaagaucugu

SEQ ID NO: 2658 - RNA, 17 nt, Mus sp.
guuaagaucugugacuu

SEQ ID NO: 2659 - RNA, 17 nt, Mus sp.
cugugacuucggcuugg

SEQ ID NO: 2660 - RNA, 17 nt, Mus sp.
ugugacuucggcuuggc

SEQ ID NO: 2661 - RNA, 17 nt, Mus sp.
cuucggcuuggcccggg

SEQ ID NO: 2662 - RNA, 17 nt, Mus sp.
cgggacauuuauaaaga

SEQ ID NO: 2663 - RNA, 17 nt, Mus sp.
gggacauuuauaaagac

SEQ ID NO: 2664 - RNA, 17 nt, Mus sp.
ggacauuuauaaagacc

SEQ ID NO: 2665 - RNA, 17 nt, Mus sp.
acauuuauaaagacccg

SEQ ID NO: 2666 - RNA, 17 nt, Mus sp.
acccggauuaugucaga

SEQ ID NO: 2667 - RNA, 17 nt, Mus sp.
cccggauuaugucagaa

SEQ ID NO: 2668 - RNA, 17 nt, Mus sp.
gcccgacucccuuugaa

SEQ ID NO: 2669 - RNA, 17 nt, Mus sp.
gacucccuuugaagugg

SEQ ID NO: 2670 - RNA, 17 nt, Mus sp.
acucccuuugaagugga

SEQ ID NO: 2671 - RNA, 17 nt, Mus sp.
gaaaccauuuuugacag

SEQ ID NO: 2672 - RNA, 17 nt, Mus sp.
aaaccauuuuugacaga

SEQ ID NO: 2673 - RNA, 17 nt, Mus sp.
aaccauuuuugacagag

SEQ ID NO: 2674 - RNA, 17 nt, Mus sp.
accauuuuugacagagu

SEQ ID NO: 2675 - RNA, 17 nt, Mus sp.
gacagaguauacacaau

SEQ ID NO: 2676 - RNA, 17 nt, Mus sp.
cagaguauacacaauuc

SEQ ID NO: 2677 - RNA, 17 nt, Mus sp.
uacacaauucagagcga

SEQ ID NO: 2678 - RNA, 17 nt, Mus sp.
acacaauucagagcgau

SEQ ID NO: 2679 - RNA, 17 nt, Mus sp.
uguguggucuuucggug

SEQ ID NO: 2680 - RNA, 17 nt, Mus sp.
uguggucuuucggugug

SEQ ID NO: 2681 - RNA, 17 nt, Mus sp.
guggucuuucggugugu

SEQ ID NO: 2682 - RNA, 17 nt, Mus sp.
uggucuuucgguguguu

SEQ ID NO: 2683 - RNA, 17 nt, Mus sp.
cgguguguugcucuggg

SEQ ID NO: 2684 - RNA, 17 nt, Mus sp.
guguugcucugggaaau

SEQ ID NO: 2685 - RNA, 17 nt, Mus sp.
auuuuccuuaggugccu

SEQ ID NO: 2686 - RNA, 17 nt, Mus sp.
uuuuccuuaggugccuc

SEQ ID NO: 2687 - RNA, 17 nt, Mus sp.
aggugccuccccauacc

SEQ ID NO: 2688 - RNA, 17 nt, Mus sp.
cuccccauacccugggg

SEQ ID NO: 2689 - RNA, 17 nt, Mus sp.
ccuggggucaagauuga

SEQ ID NO: 2690 - RNA, 17 nt, Mus sp.
gucaagauugaugaaga

SEQ ID NO: 2691 - RNA, 17 nt, Mus sp.
ugaagaauuuuguagga

SEQ ID NO: 2692 - RNA, 17 nt, Mus sp.
gaagaauuuuguaggag

SEQ ID NO: 2693 - RNA, 17 nt, Mus sp.
aagaauuuuguaggaga

SEQ ID NO: 2694 - RNA, 17 nt, Mus sp.
aauuuuguaggagauug

SEQ ID NO: 2695 - RNA, 17 nt, Mus sp.
uaggagauugaaagaag

SEQ ID NO: 2696 - RNA, 17 nt, Mus sp.
aaggaacuagaaugcgg

SEQ ID NO: 2697 - RNA, 17 nt, Mus sp.
ugcgggcuccugacuac

SEQ ID NO: 2698 - RNA, 17 nt, Mus sp.
uccugacuacacuaccc

SEQ ID NO: 2699 - RNA, 17 nt, Mus sp.
acuacacuaccccagaa

SEQ ID NO: 2700 - RNA, 17 nt, Mus sp.
gagacccucguuuucag

SEQ ID NO: 2701 - RNA, 17 nt, Mus sp.
acccucguuuucagagu

SEQ ID NO: 2702 - RNA, 17 nt, Mus sp.
cccucguuuucagaguu

SEQ ID NO: 2703 - RNA, 17 nt, Mus sp.
ccucguuuucagaguug

SEQ ID NO: 2704 - RNA, 17 nt, Mus sp.
cucguuuucagaguugg

SEQ ID NO: 2705 - RNA, 17 nt, Mus sp.
uucagaguugguggagc

SEQ ID NO: 2706 - RNA, 17 nt, Mus sp.
uggagcauuugggaaac

SEQ ID NO: 2707 - RNA, 17 nt, Mus sp.
ggagcauuugggaaacc

SEQ ID NO: 2708 - RNA, 17 nt, Mus sp.
ggaaaccuccugcaagc

SEQ ID NO: 2709 - RNA, 17 nt, Mus sp.
caaagacuauauuguuc

SEQ ID NO: 2710 - RNA, 17 nt, Mus sp.
aagacuauauuguucuu

SEQ ID NO: 2711 - RNA, 17 nt, Mus sp.
gacuauauuguucuucc

SEQ ID NO: 2712 - RNA, 17 nt, Mus sp.
uauauuguucuuccaau

SEQ ID NO: 2713 - RNA, 17 nt, Mus sp.
auauuguucuuccaaug

SEQ ID NO: 2714 - RNA, 17 nt, Mus sp.
auuguucuuccaauguc

SEQ ID NO: 2715 - RNA, 17 nt, Mus sp.
uuguucuuccaauguca

SEQ ID NO: 2716 - RNA, 17 nt, Mus sp.
uccaaugucagagacac

SEQ ID NO: 2717 - RNA, 17 nt, Mus sp.
ucuggacucucccugcc

SEQ ID NO: 2718 - RNA, 17 nt, Mus sp.
uggacucucccugccua

SEQ ID NO: 2719 - RNA, 17 nt, Mus sp.
cccugccuaccucaccu

SEQ ID NO: 2720 - RNA, 17 nt, Mus sp.
uuuccuguauggaggaa

SEQ ID NO: 2721 - RNA, 17 nt, Mus sp.
gcaggaaucagucauua

SEQ ID NO: 2722 - RNA, 17 nt, Mus sp.
gaaucagucauuaucuc

SEQ ID NO: 2723 - RNA, 17 nt, Mus sp.
ucagucauuaucuccag

SEQ ID NO: 2724 - RNA, 17 nt, Mus sp.
cagucauuaucuccaga

SEQ ID NO: 2725 - RNA, 17 nt, Mus sp.
gucauuaucuccagaac

SEQ ID NO: 2726 - RNA, 17 nt, Mus sp.
cauuaucuccagaacag

SEQ ID NO: 2727 - RNA, 17 nt, Mus sp.
uugaagauaucccauug

SEQ ID NO: 2728 - RNA, 17 nt, Mus sp.
gaagauaucccauugga

SEQ ID NO: 2729 - RNA, 17 nt, Mus sp.
uaucccauuggaggaac

SEQ ID NO: 2730 - RNA, 17 nt, Mus sp.
ccagaaguaaaagugau

SEQ ID NO: 2731 - RNA, 17 nt, Mus sp.
aaagugaucccagauga

SEQ ID NO: 2732 - RNA, 17 nt, Mus sp.
gggaugguccuugcauc

SEQ ID NO: 2733 - RNA, 17 nt, Mus sp.
augguccuugcaucaga

SEQ ID NO: 2734 - RNA, 17 nt, Mus sp.
ccuugcaucagaagagc

SEQ ID NO: 2735 - RNA, 17 nt, Mus sp.
ugaaaacucuggaagac

SEQ ID NO: 2736 - RNA, 17 nt, Mus sp.
gaacaaauuaucuccau

SEQ ID NO: 2737 - RNA, 17 nt, Mus sp.
aacaaauuaucuccauc

SEQ ID NO: 2738 - RNA, 17 nt, Mus sp.
ugcccaguaaaagcagg

SEQ ID NO: 2739 - RNA, 17 nt, Mus sp.
cagggagucuguggccu

SEQ ID NO: 2740 - RNA, 17 nt, Mus sp.
uguggccucggaaggcu

SEQ ID NO: 2741 - RNA, 17 nt, Mus sp.
ggaaggcuccaaccaga

SEQ ID NO: 2742 - RNA, 17 nt, Mus sp.
caguggcuaccagucug

SEQ ID NO: 2743 - RNA, 17 nt, Mus sp.
cuaccagucuggguauc

SEQ ID NO: 2744 - RNA, 17 nt, Mus sp.
gucuggguaucacucag

SEQ ID NO: 2745 - RNA, 17 nt, Mus sp.
cuggguaucacucagau

SEQ ID NO: 2746 - RNA, 17 nt, Mus sp.
guaucacucagaugaca

SEQ ID NO: 2747 - RNA, 17 nt, Mus sp.
caccguguacuccagcg

SEQ ID NO: 2748 - RNA, 17 nt, Artificial Sequence
  Description of Artificial Sequence:  Nucleic Acid
cguguacuccagcgacg

SEQ ID NO: 2749 - RNA, 17 nt, Mus sp.
gcaggacuuuuaaagau

SEQ ID NO: 2750 - RNA, 17 nt, Mus sp.
caggacuuuuaaagaug

SEQ ID NO: 2751 - RNA, 17 nt, Mus sp.
aggacuuuuaaagaugg

SEQ ID NO: 2752 - RNA, 17 nt, Mus sp.
ggacuuuuaaagauggu

SEQ ID NO: 2753 - RNA, 17 nt, Mus sp.
gcugcaguucacgcuga

SEQ ID NO: 2754 - RNA, 17 nt, Mus sp.
cugcaguucacgcugac

SEQ ID NO: 2755 - RNA, 17 nt, Mus sp.
cgcugacucagggacca

SEQ ID NO: 2756 - RNA, 17 nt, Mus sp.
cugcagcucaccuccug

SEQ ID NO: 2757 - RNA, 17 nt, Mus sp.
gcucaccuccuguuuaa

SEQ ID NO: 2758 - RNA, 17 nt, Mus sp.
ccuccuguuuaaaugga

SEQ ID NO: 2759 - RNA, 17 nt, Mus sp.
cuccuguuuaaauggaa

SEQ ID NO: 2760 - RNA, 17 nt, Mus sp.
uccuguuuaaauggaag

SEQ ID NO: 2761 - RNA, 17 nt, Mus sp.
gaagugguccugucccg

SEQ ID NO: 2762 - RNA, 17 nt, Mus sp.
gguccugucccggcucc

SEQ ID NO: 2763 - RNA, 17 nt, Mus sp.
ucccggcuccgccccca

SEQ ID NO: 2764 - RNA, 17 nt, Mus sp.
ccccaacuccuggaaau

SEQ ID NO: 2765 - RNA, 17 nt, Mus sp.
cuggaaaucacgagaga

SEQ ID NO: 2766 - RNA, 17 nt, Mus sp.
gugcugcuuagauuuuc

SEQ ID NO: 2767 - RNA, 17 nt, Mus sp.
ugcugcuuagauuuuca

SEQ ID NO: 2768 - RNA, 17 nt, Mus sp.
gcuuagauuuucaagug

SEQ ID NO: 2769 - RNA, 17 nt, Mus sp.
cuuagauuuucaagugu

SEQ ID NO: 2770 - RNA, 17 nt, Mus sp.
uuagauuuucaaguguu

SEQ ID NO: 2771 - RNA, 17 nt, Mus sp.
uagauuuucaaguguug

SEQ ID NO: 2772 - RNA, 17 nt, Mus sp.
ucaaguguuguucuuuc

SEQ ID NO: 2773 - RNA, 17 nt, Mus sp.
guuguucuuuccaccac

SEQ ID NO: 2774 - RNA, 17 nt, Mus sp.
uuguucuuuccaccacc

SEQ ID NO: 2775 - RNA, 17 nt, Mus sp.
uguucuuuccaccaccc

SEQ ID NO: 2776 - RNA, 17 nt, Mus sp.
ccggaaguagccacauu

SEQ ID NO: 2777 - RNA, 17 nt, Mus sp.
agccacauuugauuuuc

SEQ ID NO: 2778 - RNA, 17 nt, Mus sp.
gccacauuugauuuuca

SEQ ID NO: 2779 - RNA, 17 nt, Mus sp.
cauuugauuuucauuuu

SEQ ID NO: 2780 - RNA, 17 nt, Mus sp.
auuugauuuucauuuuu

SEQ ID NO: 2781 - RNA, 17 nt, Mus sp.
uuugauuuucauuuuug

SEQ ID NO: 2782 - RNA, 17 nt, Mus sp.
uugauuuucauuuuugg

SEQ ID NO: 2783 - RNA, 17 nt, Mus sp.
auuuucauuuuuggagg

SEQ ID NO: 2784 - RNA, 17 nt, Mus sp.
uuuucauuuuuggagga

SEQ ID NO: 2785 - RNA, 17 nt, Mus sp.
uuucauuuuuggaggag

SEQ ID NO: 2786 - RNA, 17 nt, Mus sp.
uucauuuuuggaggagg

SEQ ID NO: 2787 - RNA, 17 nt, Mus sp.
agggaccucagacugca

SEQ ID NO: 2788 - RNA, 17 nt, Mus sp.
aaggagcuuguccucag

SEQ ID NO: 2789 - RNA, 17 nt, Mus sp.
gagcuuguccucagggc

SEQ ID NO: 2790 - RNA, 17 nt, Mus sp.
cuuguccucagggcauu

SEQ ID NO: 2791 - RNA, 17 nt, Mus sp.
cagggcauuuccagaga

SEQ ID NO: 2792 - RNA, 17 nt, Mus sp.
agggcauuuccagagaa

SEQ ID NO: 2793 - RNA, 17 nt, Mus sp.
gggcauuuccagagaag

SEQ ID NO: 2794 - RNA, 17 nt, Mus sp.
gaauguguugacucuac

SEQ ID NO: 2795 - RNA, 17 nt, Mus sp.
uguugacucuacucucu

SEQ ID NO: 2796 - RNA, 17 nt, Mus sp.
uugacucuacucucuuu

SEQ ID NO: 2797 - RNA, 17 nt, Mus sp.
acucuacucucuuuucc

SEQ ID NO: 2798 - RNA, 17 nt, Mus sp.
ucuacucucuuuuccau

SEQ ID NO: 2799 - RNA, 17 nt, Mus sp.
uacucucuuuuccauuc

SEQ ID NO: 2800 - RNA, 17 nt, Mus sp.
acucucuuuuccauuca

SEQ ID NO: 2801 - RNA, 17 nt, Mus sp.
cucucuuuuccauucau

SEQ ID NO: 2802 - RNA, 17 nt, Mus sp.
ucucuuuuccauucauu

SEQ ID NO: 2803 - RNA, 17 nt, Mus sp.
uuuuccauucauuuaaa

SEQ ID NO: 2804 - RNA, 17 nt, Mus sp.
uuuccauucauuuaaaa

SEQ ID NO: 2805 - RNA, 17 nt, Mus sp.
ccauucauuuaaaaguc

SEQ ID NO: 2806 - RNA, 17 nt, Mus sp.
cauucauuuaaaagucc

SEQ ID NO: 2807 - RNA, 17 nt, Mus sp.
auucauuuaaaaguccu

SEQ ID NO: 2808 - RNA, 17 nt, Mus sp.
uuaaaaguccuauauaa

SEQ ID NO: 2809 - RNA, 17 nt, Mus sp.
aaaguccuauauaaugu

SEQ ID NO: 2810 - RNA, 17 nt, Mus sp.
aguccuauauaaugugc

SEQ ID NO: 2811 - RNA, 17 nt, Mus sp.
uccuauauaaugugccc

SEQ ID NO: 2812 - RNA, 17 nt, Mus sp.
gcuguggucucacuacc

SEQ ID NO: 2813 - RNA, 17 nt, Mus sp.
uguggucucacuaccag

SEQ ID NO: 2814 - RNA, 17 nt, Mus sp.
gucucacuaccaguuaa

SEQ ID NO: 2815 - RNA, 17 nt, Mus sp.
cuaccaguuaaagcaaa

SEQ ID NO: 2816 - RNA, 17 nt, Mus sp.
uaccaguuaaagcaaaa

SEQ ID NO: 2817 - RNA, 17 nt, Mus sp.
aaaagacuuucaaacac

SEQ ID NO: 2818 - RNA, 17 nt, Mus sp.
aaagacuuucaaacacg

SEQ ID NO: 2819 - RNA, 17 nt, Mus sp.
aagacuuucaaacacgu

SEQ ID NO: 2820 - RNA, 17 nt, Mus sp.
cguggacucuguccucc

SEQ ID NO: 2821 - RNA, 17 nt, Mus sp.
gacucuguccuccaaga

SEQ ID NO: 2822 - RNA, 17 nt, Mus sp.
ucuguccuccaagaagu

SEQ ID NO: 2823 - RNA, 17 nt, Mus sp.
cggcaccucugugaaac

SEQ ID NO: 2824 - RNA, 17 nt, Mus sp.
aacuggaucgaaugggc

SEQ ID NO: 2825 - RNA, 17 nt, Mus sp.
gcaaugcuuuguguguu

SEQ ID NO: 2826 - RNA, 17 nt, Mus sp.
caaugcuuuguguguug

SEQ ID NO: 2827 - RNA, 17 nt, Mus sp.
uuguguguugaggaugg

SEQ ID NO: 2828 - RNA, 17 nt, Mus sp.
ugagaugucccagggcc

SEQ ID NO: 2829 - RNA, 17 nt, Mus sp.
ggccgagucugucuacc

SEQ ID NO: 2830 - RNA, 17 nt, Mus sp.
gagucugucuaccuugg

SEQ ID NO: 2831 - RNA, 17 nt, Mus sp.
gucugucuaccuuggag

SEQ ID NO: 2832 - RNA, 17 nt, Mus sp.
gucuaccuuggaggcuu

SEQ ID NO: 2833 - RNA, 17 nt, Mus sp.
uggaggcuuuguggagg

SEQ ID NO: 2834 - RNA, 17 nt, Mus sp.
ggaggcuuuguggagga

SEQ ID NO: 2835 - RNA, 17 nt, Mus sp.
ugcgggcuaugagccaa

SEQ ID NO: 2836 - RNA, 17 nt, Mus sp.
ccaaguguuaagugugg

SEQ ID NO: 2837 - RNA, 17 nt, Mus sp.
caaguguuaaguguggg

SEQ ID NO: 2838 - RNA, 17 nt, Mus sp.
gcgcaagucgcucggag

SEQ ID NO: 2839 - RNA, 17 nt, Mus sp.
aagucgcucggagagcg

SEQ ID NO: 2840 - RNA, 17 nt, Mus sp.
agagcgguuggagccug

SEQ ID NO: 2841 - RNA, 17 nt, Mus sp.
agaugcauugugcuggc

SEQ ID NO: 2842 - RNA, 17 nt, Mus sp.
ugcuggcucugguggag

SEQ ID NO: 2843 - RNA, 17 nt, Mus sp.
ggugggcuuguggccug

SEQ ID NO: 2844 - RNA, 17 nt, Mus sp.
uggccugucaggaaacg

SEQ ID NO: 2845 - RNA, 17 nt, Mus sp.
ggcaggguuugguuuug

SEQ ID NO: 2846 - RNA, 17 nt, Mus sp.
gcaggguuugguuuugg

SEQ ID NO: 2847 - RNA, 17 nt, Mus sp.
gguuugguuuuggaagg

SEQ ID NO: 2848 - RNA, 17 nt, Mus sp.
guuugguuuuggaaggu

SEQ ID NO: 2849 - RNA, 17 nt, Mus sp.
uuugguuuuggaagguu

SEQ ID NO: 2850 - RNA, 17 nt, Mus sp.
uggaagguuugcgugcu

SEQ ID NO: 2851 - RNA, 17 nt, Mus sp.
ggaagguuugcgugcuc

SEQ ID NO: 2852 - RNA, 17 nt, Mus sp.
ugcgugcucuucacagu

SEQ ID NO: 2853 - RNA, 17 nt, Mus sp.
cgugcucuucacagucg

SEQ ID NO: 2854 - RNA, 17 nt, Mus sp.
gugcucuucacagucgg

SEQ ID NO: 2855 - RNA, 17 nt, Mus sp.
uucacagucggguuaca

SEQ ID NO: 2856 - RNA, 17 nt, Mus sp.
agucggguuacaggcga

SEQ ID NO: 2857 - RNA, 17 nt, Mus sp.
gucggguuacaggcgag

SEQ ID NO: 2858 - RNA, 17 nt, Mus sp.
aggcgaguucccugugg

SEQ ID NO: 2859 - RNA, 17 nt, Mus sp.
ggcgaguucccuguggc

SEQ ID NO: 2860 - RNA, 17 nt, Mus sp.
uguggcguuuccuacuc

SEQ ID NO: 2861 - RNA, 17 nt, Mus sp.
guggcguuuccuacucc

SEQ ID NO: 2862 - RNA, 17 nt, Mus sp.
uggcguuuccuacuccu

SEQ ID NO: 2863 - RNA, 17 nt, Mus sp.
cguuuccuacuccuaau

SEQ ID NO: 2864 - RNA, 17 nt, Mus sp.
uuccuacuccuaaugag

SEQ ID NO: 2865 - RNA, 17 nt, Mus sp.
cuacuccuaaugagagu

SEQ ID NO: 2866 - RNA, 17 nt, Mus sp.
augagaguuccuuccgg

SEQ ID NO: 2867 - RNA, 17 nt, Mus sp.
ugagaguuccuuccgga

SEQ ID NO: 2868 - RNA, 17 nt, Mus sp.
gaguuccuuccggacuc

SEQ ID NO: 2869 - RNA, 17 nt, Mus sp.
aguuccuuccggacucu

SEQ ID NO: 2870 - RNA, 17 nt, Mus sp.
uccggacucuuacgugu

SEQ ID NO: 2871 - RNA, 17 nt, Mus sp.
cggacucuuacgugucu

SEQ ID NO: 2872 - RNA, 17 nt, Mus sp.
ggacucuuacgugucuc

SEQ ID NO: 2873 - RNA, 17 nt, Mus sp.
uuacgugucuccuggcc

SEQ ID NO: 2874 - RNA, 17 nt, Mus sp.
acgugucuccuggccug

SEQ ID NO: 2875 - RNA, 17 nt, Mus sp.
augcagcuugcuccuuc

SEQ ID NO: 2876 - RNA, 17 nt, Mus sp.
agcuugcuccuuccuca

SEQ ID NO: 2877 - RNA, 17 nt, Mus sp.
uugcuccuuccucaucu

SEQ ID NO: 2878 - RNA, 17 nt, Mus sp.
ugcuccuuccucaucuc

SEQ ID NO: 2879 - RNA, 17 nt, Mus sp.
uccuuccucaucucuca

SEQ ID NO: 2880 - RNA, 17 nt, Mus sp.
uuccucaucucucaggc

SEQ ID NO: 2881 - RNA, 17 nt, Mus sp.
ccucaucucucaggcug

SEQ ID NO: 2882 - RNA, 17 nt, Mus sp.
ucaucucucaggcugug

SEQ ID NO: 2883 - RNA, 17 nt, Mus sp.
cugugccuuaauucaga

SEQ ID NO: 2884 - RNA, 17 nt, Mus sp.
ugugccuuaauucagaa

SEQ ID NO: 2885 - RNA, 17 nt, Mus sp.
gccuuaauucagaacac

SEQ ID NO: 2886 - RNA, 17 nt, Mus sp.
ccuuaauucagaacacc

SEQ ID NO: 2887 - RNA, 17 nt, Mus sp.
aggaacgucggcagagg

SEQ ID NO: 2888 - RNA, 17 nt, Mus sp.
cagaggcuccugacggg

SEQ ID NO: 2889 - RNA, 17 nt, Mus sp.
cgaagaauugugagaac

SEQ ID NO: 2890 - RNA, 17 nt, Mus sp.
cagaaacucaggguuuc

SEQ ID NO: 2891 - RNA, 17 nt, Mus sp.
cucaggguuucugcugg

SEQ ID NO: 2892 - RNA, 17 nt, Mus sp.
ucaggguuucugcuggg

SEQ ID NO: 2893 - RNA, 17 nt, Mus sp.
caggguuucugcugggu

SEQ ID NO: 2894 - RNA, 17 nt, Mus sp.
uggcaggucugaggguu

SEQ ID NO: 2895 - RNA, 17 nt, Mus sp.
cugaggguucucuguca

SEQ ID NO: 2896 - RNA, 17 nt, Mus sp.
ugaggguucucugucaa

SEQ ID NO: 2897 - RNA, 17 nt, Mus sp.
aggguucucugucaagu

SEQ ID NO: 2898 - RNA, 17 nt, Mus sp.
uucucugucaaguggcg

SEQ ID NO: 2899 - RNA, 17 nt, Mus sp.
guggcgguaaaggcuca

SEQ ID NO: 2900 - RNA, 17 nt, Mus sp.
uaaaggcucaggcuggu

SEQ ID NO: 2901 - RNA, 17 nt, Mus sp.
gcugguguucuuccucu

SEQ ID NO: 2902 - RNA, 17 nt, Mus sp.
cugguguucuuccucua

SEQ ID NO: 2903 - RNA, 17 nt, Mus sp.
gguguucuuccucuauc

SEQ ID NO: 2904 - RNA, 17 nt, Mus sp.
guguucuuccucuaucu

SEQ ID NO: 2905 - RNA, 17 nt, Mus sp.
uucuuccucuaucucca

SEQ ID NO: 2906 - RNA, 17 nt, Mus sp.
cuuccucuaucuccacu

SEQ ID NO: 2907 - RNA, 17 nt, Mus sp.
uccucuaucuccacucc

SEQ ID NO: 2908 - RNA, 17 nt, Mus sp.
cucuaucuccacuccug

SEQ ID NO: 2909 - RNA, 17 nt, Mus sp.
ucuccacuccugucagg

SEQ ID NO: 2910 - RNA, 17 nt, Mus sp.
acuccugucaggccccc

SEQ ID NO: 2911 - RNA, 17 nt, Mus sp.
ccccaaguccucaguau

SEQ ID NO: 2912 - RNA, 17 nt, Mus sp.
caaguccucaguauuuu

SEQ ID NO: 2913 - RNA, 17 nt, Mus sp.
uccucaguauuuuagcu

SEQ ID NO: 2914 - RNA, 17 nt, Mus sp.
cucaguauuuuagcuuu

SEQ ID NO: 2915 - RNA, 17 nt, Mus sp.
ucaguauuuuagcuuug

SEQ ID NO: 2916 - RNA, 17 nt, Mus sp.
caguauuuuagcuuugu

SEQ ID NO: 2917 - RNA, 17 nt, Mus sp.
aguauuuuagcuuugug

SEQ ID NO: 2918 - RNA, 17 nt, Mus sp.
uuuuagcuuuguggcuu

SEQ ID NO: 2919 - RNA, 17 nt, Mus sp.
uuuagcuuuguggcuuc

SEQ ID NO: 2920 - RNA, 17 nt, Mus sp.
uuguggcuuccugaugg

SEQ ID NO: 2921 - RNA, 17 nt, Mus sp.
uguggcuuccugauggc

SEQ ID NO: 2922 - RNA, 17 nt, Mus sp.
agaaaaaucuuaauugg

SEQ ID NO: 2923 - RNA, 17 nt, Mus sp.
aaaaaucuuaauugguu

SEQ ID NO: 2924 - RNA, 17 nt, Mus sp.
aaaaucuuaauugguug

SEQ ID NO: 2925 - RNA, 17 nt, Mus sp.
aucuuaauugguugguu

SEQ ID NO: 2926 - RNA, 17 nt, Mus sp.
uaauugguugguuugcu

SEQ ID NO: 2927 - RNA, 17 nt, Mus sp.
ugguugguuugcucucc

SEQ ID NO: 2928 - RNA, 17 nt, Mus sp.
gguugguuugcucucca

SEQ ID NO: 2929 - RNA, 17 nt, Mus sp.
gguuugcucuccagaua

SEQ ID NO: 2930 - RNA, 17 nt, Mus sp.
uuugcucuccagauaau

SEQ ID NO: 2931 - RNA, 17 nt, Mus sp.
cuccagauaaucacuag

SEQ ID NO: 2932 - RNA, 17 nt, Mus sp.
cagauaaucacuagcca

SEQ ID NO: 2933 - RNA, 17 nt, Mus sp.
uaaucacuagccagauu

SEQ ID NO: 2934 - RNA, 17 nt, Mus sp.
agccagauuucgaaauu

SEQ ID NO: 2935 - RNA, 17 nt, Mus sp.
gccagauuucgaaauua

SEQ ID NO: 2936 - RNA, 17 nt, Mus sp.
ccagauuucgaaauuac

SEQ ID NO: 2937 - RNA, 17 nt, Mus sp.
uucgaaauuacuuuuua

SEQ ID NO: 2938 - RNA, 17 nt, Mus sp.
ucgaaauuacuuuuuag

SEQ ID NO: 2939 - RNA, 17 nt, Mus sp.
aaauuacuuuuuagccg

SEQ ID NO: 2940 - RNA, 17 nt, Mus sp.
aauuacuuuuuagccga

SEQ ID NO: 2941 - RNA, 17 nt, Mus sp.
auuacuuuuuagccgag

SEQ ID NO: 2942 - RNA, 17 nt, Mus sp.
uuacuuuuuagccgagg

SEQ ID NO: 2943 - RNA, 17 nt, Mus sp.
uacuuuuuagccgaggu

SEQ ID NO: 2944 - RNA, 17 nt, Mus sp.
gccgagguuaugauaac

SEQ ID NO: 2945 - RNA, 17 nt, Mus sp.
ccgagguuaugauaaca

SEQ ID NO: 2946 - RNA, 17 nt, Mus sp.
guuaugauaacaucuac

SEQ ID NO: 2947 - RNA, 17 nt, Mus sp.
gauaacaucuacuguau

SEQ ID NO: 2948 - RNA, 17 nt, Mus sp.
uaacaucuacuguaucc

SEQ ID NO: 2949 - RNA, 17 nt, Mus sp.
ucuacuguauccuuuag

SEQ ID NO: 2950 - RNA, 17 nt, Mus sp.
uacuguauccuuuagaa

SEQ ID NO: 2951 - RNA, 17 nt, Mus sp.
uguauccuuuagaauuu

SEQ ID NO: 2952 - RNA, 17 nt, Mus sp.
guauccuuuagaauuuu

SEQ ID NO: 2953 - RNA, 17 nt, Mus sp.
uauccuuuagaauuuua

SEQ ID NO: 2954 - RNA, 17 nt, Mus sp.
uuuagaauuuuaaccua

SEQ ID NO: 2955 - RNA, 17 nt, Mus sp.
uuagaauuuuaaccuau

SEQ ID NO: 2956 - RNA, 17 nt, Mus sp.
uagaauuuuaaccuaua

SEQ ID NO: 2957 - RNA, 17 nt, Mus sp.
agaauuuuaaccuauaa

SEQ ID NO: 2958 - RNA, 17 nt, Mus sp.
uuuaaccuauaaaacua

SEQ ID NO: 2959 - RNA, 17 nt, Mus sp.
uaaccuauaaaacuaug

SEQ ID NO: 2960 - RNA, 17 nt, Mus sp.
auaaaacuaugucuacu

SEQ ID NO: 2961 - RNA, 17 nt, Mus sp.
aacuaugucuacugguu

SEQ ID NO: 2962 - RNA, 17 nt, Mus sp.
cuaugucuacugguuuc

SEQ ID NO: 2963 - RNA, 17 nt, Mus sp.
cuacugguuucugccug

SEQ ID NO: 2964 - RNA, 17 nt, Mus sp.
uacugguuucugccugu

SEQ ID NO: 2965 - RNA, 17 nt, Mus sp.
acugguuucugccugug

SEQ ID NO: 2966 - RNA, 18 nt, Mus sp.
gggcccagacuguguccc

SEQ ID NO: 2967 - RNA, 18 nt, Mus sp.
ucccgcagccgggauaac

SEQ ID NO: 2968 - RNA, 18 nt, Mus sp.
ccuggcugacccgauucc

SEQ ID NO: 2969 - RNA, 18 nt, Mus sp.
cugacccgauuccgcgga

SEQ ID NO: 2970 - RNA, 18 nt, Mus sp.
ggacaccgcugacagccg

SEQ ID NO: 2971 - RNA, 18 nt, Mus sp.
gcugacagccgcggcugg

SEQ ID NO: 2972 - RNA, 18 nt, Mus sp.
agccgcggcuggagccag

SEQ ID NO: 2973 - RNA, 18 nt, Mus sp.
cuccccggucuugcgcug

SEQ ID NO: 2974 - RNA, 18 nt, Mus sp.
ccauaccgccucugugac

SEQ ID NO: 2975 - RNA, 18 nt, Mus sp.
gcuagcugucgcucugug

SEQ ID NO: 2976 - RNA, 18 nt, Mus sp.
ccgagccgccucuguggg

SEQ ID NO: 2977 - RNA, 18 nt, Mus sp.
cccuucagauuacuugca

SEQ ID NO: 2978 - RNA, 18 nt, Mus sp.
cuccacuguuuaugucua

SEQ ID NO: 2979 - RNA, 18 nt, Mus sp.
gauuacagaucaccauuc

SEQ ID NO: 2980 - RNA, 18 nt, Mus sp.
auccccugccgagggucg

SEQ ID NO: 2981 - RNA, 18 nt, Mus sp.
uguuccggauggaaacag

SEQ ID NO: 2982 - RNA, 18 nt, Mus sp.
ccuaucagucuaucaugu

SEQ ID NO: 2983 - RNA, 18 nt, Mus sp.
gcuaucugccggagaaaa

SEQ ID NO: 2984 - RNA, 18 nt, Mus sp.
guggacggaugaucaaga

SEQ ID NO: 2985 - RNA, 18 nt, Mus sp.
uuacccagcuccugauau

SEQ ID NO: 2986 - RNA, 18 nt, Mus sp.
caccccagaucggugaga

SEQ ID NO: 2987 - RNA, 18 nt, Mus sp.
augcacagucuacgccaa

SEQ ID NO: 2988 - RNA, 18 nt, Mus sp.
gaagccugcuccuacaga

SEQ ID NO: 2989 - RNA, 18 nt, Mus sp.
uccuacagacccggccaa

SEQ ID NO: 2990 - RNA, 18 nt, Mus sp.
augcccugauugaaggaa

SEQ ID NO: 2991 - RNA, 18 nt, Mus sp.
gcaaccugcugcccagcc

SEQ ID NO: 2992 - RNA, 18 nt, Mus sp.
accugcugcccagccaac

SEQ ID NO: 2993 - RNA, 18 nt, Mus sp.
ugucccuguugugcacug

SEQ ID NO: 2994 - RNA, 18 nt, Mus sp.
aacaucgguccacauggg

SEQ ID NO: 2995 - RNA, 18 nt, Mus sp.
cacaccaguuugcaagaa

SEQ ID NO: 2996 - RNA, 18 nt, Mus sp.
uugcucugcucaagauaa

SEQ ID NO: 2997 - RNA, 18 nt, Mus sp.
ucaaacagcucaucaucc

SEQ ID NO: 2998 - RNA, 18 nt, Mus sp.
ggaaccugacuauccgca

SEQ ID NO: 2999 - RNA, 18 nt, Mus sp.
uccuacggaccguuaagc

SEQ ID NO: 3000 - RNA, 18 nt, Mus sp.
ggauccagaugaauugcc

SEQ ID NO: 3001 - RNA, 18 nt, Mus sp.
gggaccggcugaaacuag

SEQ ID NO: 3002 - RNA, 18 nt, Mus sp.
ugaggcagacgcuuuugg

SEQ ID NO: 3003 - RNA, 18 nt, Mus sp.
ucugccagcucaggcuuu

SEQ ID NO: 3004 - RNA, 18 nt, Mus sp.
gacuucggcuuggcccgg

SEQ ID NO: 3005 - RNA, 18 nt, Mus sp.
agacccggauuaugucag

SEQ ID NO: 3006 - RNA, 18 nt, Mus sp.
gaugcccgacucccuuug

SEQ ID NO: 3007 - RNA, 18 nt, Mus sp.
ggcuccugacuacacuac

SEQ ID NO: 3008 - RNA, 18 nt, Mus sp.
cuggacugcuggcaugag

SEQ ID NO: 3009 - RNA, 18 nt, Mus sp.
ucucccugccuaccucac

SEQ ID NO: 3010 - RNA, 18 nt, Mus sp.
gaucccagaugacagcca

SEQ ID NO: 3011 - RNA, 18 nt, Mus sp.
ccaaccagaccaguggcu

SEQ ID NO: 3012 - RNA, 18 nt, Mus sp.
gcuaccagucuggguauc

SEQ ID NO: 3013 - RNA, 18 nt, Mus sp.
ucacucagaugacacaga

SEQ ID NO: 3014 - RNA, 18 nt, Mus sp.
ugcugcaguucacgcuga

SEQ ID NO: 3015 - RNA, 18 nt, Mus sp.
ucacgcugacucagggac

SEQ ID NO: 3016 - RNA, 18 nt, Mus sp.
cacugcagcucaccuccu

SEQ ID NO: 3017 - RNA, 18 nt, Mus sp.
accuccuguuuaaaugga

SEQ ID NO: 3018 - RNA, 18 nt, Mus sp.
ugguccugucccggcucc

SEQ ID NO: 3019 - RNA, 18 nt, Mus sp.
ugucccggcuccgccccc

SEQ ID NO: 3020 - RNA, 18 nt, Mus sp.
cggcuccgcccccaacuc

SEQ ID NO: 3021 - RNA, 18 nt, Mus sp.
aggugcugcuuagauuuu

SEQ ID NO: 3022 - RNA, 18 nt, Mus sp.
gaccucagacugcaagga

SEQ ID NO: 3023 - RNA, 18 nt, Mus sp.
gugcccugcuguggucuc

SEQ ID NO: 3024 - RNA, 18 nt, Mus sp.
ggacucuguccuccaaga

SEQ ID NO: 3025 - RNA, 18 nt, Mus sp.
cgagucugucuaccuugg

SEQ ID NO: 3026 - RNA, 18 nt, Mus sp.
gagagcgguuggagccug

SEQ ID NO: 3027 - RNA, 18 nt, Mus sp.
gccugcagaugcauugug

SEQ ID NO: 3028 - RNA, 18 nt, Mus sp.
aaaggcggccggcagggu

SEQ ID NO: 3029 - RNA, 18 nt, Mus sp.
cuucacagucggguuaca

SEQ ID NO: 3030 - RNA, 18 nt, Mus sp.
ccuuccggacucuuacgu

SEQ ID NO: 3031 - RNA, 18 nt, Mus sp.
ugaugcagcuugcuccuu

SEQ ID NO: 3032 - RNA, 18 nt, Mus sp.
ggcuccugacggggccga

SEQ ID NO: 3033 - RNA, 18 nt, Mus sp.
gguuucugcuggguggag

SEQ ID NO: 3034 - RNA, 18 nt, Mus sp.
gcuuccugauggcagaaa

SEQ ID NO: 3035 - RNA, 18 nt, Mus sp.
cuagccagauuucgaaau

SEQ ID NO: 3036 - RNA, 18 nt, Mus sp.
gguuucugccugugugcu

SEQ ID NO: 3037 - RNA, 17 nt, Mus sp.
ggccgcgucuugcucac

SEQ ID NO: 3038 - RNA, 17 nt, Mus sp.
ccgcgucuugcucacca

SEQ ID NO: 3039 - RNA, 17 nt, Mus sp.
gucuugcucaccauggu

SEQ ID NO: 3040 - RNA, 17 nt, Mus sp.
accauggucagcugcug

SEQ ID NO: 3041 - RNA, 17 nt, Mus sp.
accgcggucuugccuua

SEQ ID NO: 3042 - RNA, 17 nt, Mus sp.
cgcggucuugccuuacg

SEQ ID NO: 3043 - RNA, 17 nt, Mus sp.
ucuugccuuacgcgcug

SEQ ID NO: 3044 - RNA, 17 nt, Mus sp.
cuugccuuacgcgcugc

SEQ ID NO: 3045 - RNA, 17 nt, Mus sp.
gcgcugcucgggugucu

SEQ ID NO: 3046 - RNA, 17 nt, Mus sp.
ucgggugucugcuucuc

SEQ ID NO: 3047 - RNA, 17 nt, Mus sp.
cugcuucucacaggaua

SEQ ID NO: 3048 - RNA, 17 nt, Mus sp.
cacaggauauggcucag

SEQ ID NO: 3049 - RNA, 17 nt, Mus sp.
auauggcucagggucga

SEQ ID NO: 3050 - RNA, 17 nt, Mus sp.
cucagggucgaaguuaa

SEQ ID NO: 3051 - RNA, 17 nt, Mus sp.
gucgaaguuaaaagugc

SEQ ID NO: 3052 - RNA, 17 nt, Mus sp.
ucgaaguuaaaagugcc

SEQ ID NO: 3053 - RNA, 17 nt, Mus sp.
cagcaugucaugcaagc

SEQ ID NO: 3054 - RNA, 17 nt, Mus sp.
gccagacucucuuucuc

SEQ ID NO: 3055 - RNA, 17 nt, Mus sp.
cagacucucuuucucaa

SEQ ID NO: 3056 - RNA, 17 nt, Mus sp.
gacucucuuucucaagu

SEQ ID NO: 3057 - RNA, 17 nt, Mus sp.
acucucuuucucaagug

SEQ ID NO: 3058 - RNA, 17 nt, Mus sp.
cucucuuucucaagugc

SEQ ID NO: 3059 - RNA, 17 nt, Mus sp.
cucuuucucaagugcag

SEQ ID NO: 3060 - RNA, 17 nt, Mus sp.
agcccacucauggucuc

SEQ ID NO: 3061 - RNA, 17 nt, Mus sp.
cucauggucucugccca

SEQ ID NO: 3062 - RNA, 17 nt, Mus sp.
cauggucucugcccacg

SEQ ID NO: 3063 - RNA, 17 nt, Mus sp.
cugagcaucacuccccc

SEQ ID NO: 3064 - RNA, 17 nt, Mus sp.
gcaucacucccccaucg

SEQ ID NO: 3065 - RNA, 17 nt, Mus sp.
ucccccaucggccugug

SEQ ID NO: 3066 - RNA, 17 nt, Mus sp.
ggagggauaacaggcaa

SEQ ID NO: 3067 - RNA, 17 nt, Mus sp.
caggcaauucugcagca

SEQ ID NO: 3068 - RNA, 17 nt, Mus sp.
aggcaauucugcagcac

SEQ ID NO: 3069 - RNA, 17 nt, Mus sp.
cagcaccuugaccuugg

SEQ ID NO: 3070 - RNA, 17 nt, Mus sp.
cuugaccuuggacacgg

SEQ ID NO: 3071 - RNA, 17 nt, Mus sp.
acgggccucuacaccug

SEQ ID NO: 3072 - RNA, 17 nt, Mus sp.
gggccucuacaccugua

SEQ ID NO: 3073 - RNA, 17 nt, Mus sp.
acaccuguagauaccuc

SEQ ID NO: 3074 - RNA, 17 nt, Mus sp.
cuguagauaccucccua

SEQ ID NO: 3075 - RNA, 17 nt, Mus sp.
agauaccucccuacauc

SEQ ID NO: 3076 - RNA, 17 nt, Mus sp.
accucccuacaucuacu

SEQ ID NO: 3077 - RNA, 17 nt, Mus sp.
cccuacaucuacuucga

SEQ ID NO: 3078 - RNA, 17 nt, Mus sp.
cuacaucuacuucgaag

SEQ ID NO: 3079 - RNA, 17 nt, Mus sp.
caucuacuucgaagaaa

SEQ ID NO: 3080 - RNA, 17 nt, Mus sp.
aucuacuucgaagaaaa

SEQ ID NO: 3081 - RNA, 17 nt, Mus sp.
agcggaaucuucaaucu

SEQ ID NO: 3082 - RNA, 17 nt, Mus sp.
cggaaucuucaaucuac

SEQ ID NO: 3083 - RNA, 17 nt, Mus sp.
ggaaucuucaaucuaca

SEQ ID NO: 3084 - RNA, 17 nt, Mus sp.
ucuucaaucuacauauu

SEQ ID NO: 3085 - RNA, 17 nt, Mus sp.
uucaaucuacauauuug

SEQ ID NO: 3086 - RNA, 17 nt, Mus sp.
aucuacauauuuguuag

SEQ ID NO: 3087 - RNA, 17 nt, Mus sp.
cuacauauuuguuagug

SEQ ID NO: 3088 - RNA, 17 nt, Mus sp.
uacauauuuguuaguga

SEQ ID NO: 3089 - RNA, 17 nt, Mus sp.
auauuuguuagugaugc

SEQ ID NO: 3090 - RNA, 17 nt, Mus sp.
uauuuguuagugaugca

SEQ ID NO: 3091 - RNA, 17 nt, Mus sp.
cagggaguccuuucaua

SEQ ID NO: 3092 - RNA, 17 nt, Mus sp.
ggaguccuuucauagag

SEQ ID NO: 3093 - RNA, 17 nt, Mus sp.
gaguccuuucauagaga

SEQ ID NO: 3094 - RNA, 17 nt, Mus sp.
aguccuuucauagagau

SEQ ID NO: 3095 - RNA, 17 nt, Mus sp.
ccuuucauagagaugca

SEQ ID NO: 3096 - RNA, 17 nt, Mus sp.
acugacauacccaaacu

SEQ ID NO: 3097 - RNA, 17 nt, Mus sp.
cccaaacuugugcacau

SEQ ID NO: 3098 - RNA, 17 nt, Mus sp.
agacagcucaucauccc

SEQ ID NO: 3099 - RNA, 17 nt, Mus sp.
cagcucaucauccccug

SEQ ID NO: 3100 - RNA, 17 nt, Mus sp.
cucaucauccccugccg

SEQ ID NO: 3101 - RNA, 17 nt, Mus sp.
ggugacgucacccaacg

SEQ ID NO: 3102 - RNA, 17 nt, Mus sp.
cccaacgucacagucac

SEQ ID NO: 3103 - RNA, 17 nt, Mus sp.
gucacagucacccuaaa

SEQ ID NO: 3104 - RNA, 17 nt, Mus sp.
gucacccuaaaaaaguu

SEQ ID NO: 3105 - RNA, 17 nt, Mus sp.
aaaaaaguuuccauuug

SEQ ID NO: 3106 - RNA, 17 nt, Mus sp.
aaaaaguuuccauuuga

SEQ ID NO: 3107 - RNA, 17 nt, Mus sp.
aaaaguuuccauuugau

SEQ ID NO: 3108 - RNA, 17 nt, Mus sp.
guuuccauuugauacuc

SEQ ID NO: 3109 - RNA, 17 nt, Mus sp.
uuuccauuugauacucu

SEQ ID NO: 3110 - RNA, 17 nt, Mus sp.
cauuugauacucuuacc

SEQ ID NO: 3111 - RNA, 17 nt, Mus sp.
uugauacucuuaccccu

SEQ ID NO: 3112 - RNA, 17 nt, Mus sp.
gauacucuuaccccuga

SEQ ID NO: 3113 - RNA, 17 nt, Mus sp.
auacucuuaccccugau

SEQ ID NO: 3114 - RNA, 17 nt, Mus sp.
caaagaauaacauggga

SEQ ID NO: 3115 - RNA, 17 nt, Mus sp.
gggacaguaggagaggc

SEQ ID NO: 3116 - RNA, 17 nt, Mus sp.
gagaggcuuuauaauag

SEQ ID NO: 3117 - RNA, 17 nt, Mus sp.
agaggcuuuauaauagc

SEQ ID NO: 3118 - RNA, 17 nt, Mus sp.
gaggcuuuauaauagca

SEQ ID NO: 3119 - RNA, 17 nt, Mus sp.
ggcuuuauaauagcaaa

SEQ ID NO: 3120 - RNA, 17 nt, Mus sp.
uuuauaauagcaaaugc

SEQ ID NO: 3121 - RNA, 17 nt, Mus sp.
ugcaacguacaaagaga

SEQ ID NO: 3122 - RNA, 17 nt, Mus sp.
aaagagauaggacugcu

SEQ ID NO: 3123 - RNA, 17 nt, Mus sp.
gccaccgucaacgggca

SEQ ID NO: 3124 - RNA, 17 nt, Mus sp.
gcaccuguaccagacaa

SEQ ID NO: 3125 - RNA, 17 nt, Mus sp.
gacaaacuaucugaccc

SEQ ID NO: 3126 - RNA, 17 nt, Mus sp.
caaacuaucugacccau

SEQ ID NO: 3127 - RNA, 17 nt, Mus sp.
ugacccaucggcagacc

SEQ ID NO: 3128 - RNA, 17 nt, Mus sp.
agaccaauacaauccua

SEQ ID NO: 3129 - RNA, 17 nt, Mus sp.
aauacaauccuagaugu

SEQ ID NO: 3130 - RNA, 17 nt, Mus sp.
acaauccuagaugucca

SEQ ID NO: 3131 - RNA, 17 nt, Mus sp.
cuagauguccaaauacg

SEQ ID NO: 3132 - RNA, 17 nt, Mus sp.
guccaaauacgcccgcc

SEQ ID NO: 3133 - RNA, 17 nt, Mus sp.
agacugcuccacgggca

SEQ ID NO: 3134 - RNA, 17 nt, Mus sp.
ggcagacucuuguccuc

SEQ ID NO: 3135 - RNA, 17 nt, Mus sp.
cagacucuuguccucaa

SEQ ID NO: 3136 - RNA, 17 nt, Mus sp.
acucuuguccucaacug

SEQ ID NO: 3137 - RNA, 17 nt, Mus sp.
cuuguccucaacugcac

SEQ ID NO: 3138 - RNA, 17 nt, Mus sp.
acggagcucaauacgag

SEQ ID NO: 3139 - RNA, 17 nt, Mus sp.
agcucaauacgagggug

SEQ ID NO: 3140 - RNA, 17 nt, Mus sp.
gcuggaauuacccuggu

SEQ ID NO: 3141 - RNA, 17 nt, Mus sp.
cuggaauuacccuggua

SEQ ID NO: 3142 - RNA, 17 nt, Mus sp.
acccugguaaagcaacu

SEQ ID NO: 3143 - RNA, 17 nt, Mus sp.
aagcaacuaagagagca

SEQ ID NO: 3144 - RNA, 17 nt, Mus sp.
gagagcaucuauaaggc

SEQ ID NO: 3145 - RNA, 17 nt, Mus sp.
gagcaucuauaaggcag

SEQ ID NO: 3146 - RNA, 17 nt, Mus sp.
gcaucuauaaggcagcg

SEQ ID NO: 3147 - RNA, 17 nt, Mus sp.
cagcggauugaccggag

SEQ ID NO: 3148 - RNA, 17 nt, Mus sp.
ggagccauucccacaac

SEQ ID NO: 3149 - RNA, 17 nt, Mus sp.
gagccauucccacaaca

SEQ ID NO: 3150 - RNA, 17 nt, Mus sp.
caauguguuccacagug

SEQ ID NO: 3151 - RNA, 17 nt, Mus sp.
aauguguuccacagugu

SEQ ID NO: 3152 - RNA, 17 nt, Mus sp.
cacaguguucuuaagau

SEQ ID NO: 3153 - RNA, 17 nt, Mus sp.
acaguguucuuaagauc

SEQ ID NO: 3154 - RNA, 17 nt, Mus sp.
aguguucuuaagaucaa

SEQ ID NO: 3155 - RNA, 17 nt, Mus sp.
guguucuuaagaucaac

SEQ ID NO: 3156 - RNA, 17 nt, Mus sp.
cuuaagaucaacaaugu

SEQ ID NO: 3157 - RNA, 17 nt, Mus sp.
aaggggcucuacaccug

SEQ ID NO: 3158 - RNA, 17 nt, Mus sp.
ggggcucuacaccuguc

SEQ ID NO: 3159 - RNA, 17 nt, Mus sp.
acaccugucgcgugaag

SEQ ID NO: 3160 - RNA, 17 nt, Mus sp.
gaguggguccucguucc

SEQ ID NO: 3161 - RNA, 17 nt, Mus sp.
uggguccucguuccagu

SEQ ID NO: 3162 - RNA, 17 nt, Mus sp.
guccucguuccagucuu

SEQ ID NO: 3163 - RNA, 17 nt, Mus sp.
uccucguuccagucuuu

SEQ ID NO: 3164 - RNA, 17 nt, Mus sp.
guuccagucuuucaaca

SEQ ID NO: 3165 - RNA, 17 nt, Mus sp.
uccagucuuucaacacc

SEQ ID NO: 3166 - RNA, 17 nt, Mus sp.
ccagucuuucaacaccu

SEQ ID NO: 3167 - RNA, 17 nt, Mus sp.
cagucuuucaacaccuc

SEQ ID NO: 3168 - RNA, 17 nt, Mus sp.
caacaccuccgugcaug

SEQ ID NO: 3169 - RNA, 17 nt, Mus sp.
gcauguguaugaaaaag

SEQ ID NO: 3170 - RNA, 17 nt, Mus sp.
aaaaggauucaucagug

SEQ ID NO: 3171 - RNA, 17 nt, Mus sp.
aaaggauucaucagugu

SEQ ID NO: 3172 - RNA, 17 nt, Mus sp.
ggauucaucagugugaa

SEQ ID NO: 3173 - RNA, 17 nt, Mus sp.
ugaaacaucggaagcag

SEQ ID NO: 3174 - RNA, 17 nt, Mus sp.
aagacgguccuaucggc

SEQ ID NO: 3175 - RNA, 17 nt, Mus sp.
acgguccuaucggcugu

SEQ ID NO: 3176 - RNA, 17 nt, Mus sp.
gguccuaucggcugucc

SEQ ID NO: 3177 - RNA, 17 nt, Mus sp.
ucggcuguccaugaaag

SEQ ID NO: 3178 - RNA, 17 nt, Mus sp.
gaaggccuuccccuccc

SEQ ID NO: 3179 - RNA, 17 nt, Mus sp.
aaggccuuccccucccc

SEQ ID NO: 3180 - RNA, 17 nt, Mus sp.
cuuccccuccccagaaa

SEQ ID NO: 3181 - RNA, 17 nt, Mus sp.
ccagaaaucguaugguu

SEQ ID NO: 3182 - RNA, 17 nt, Mus sp.
gaaaucguaugguuaaa

SEQ ID NO: 3183 - RNA, 17 nt, Mus sp.
cguaugguuaaaagaug

SEQ ID NO: 3184 - RNA, 17 nt, Mus sp.
agauggcucgccugcaa

SEQ ID NO: 3185 - RNA, 17 nt, Mus sp.
ugcaacauugaagucug

SEQ ID NO: 3186 - RNA, 17 nt, Mus sp.
auugaagucugcucgcu

SEQ ID NO: 3187 - RNA, 17 nt, Mus sp.
agucugcucgcuauuug

SEQ ID NO: 3188 - RNA, 17 nt, Mus sp.
ugcucgcuauuugguac

SEQ ID NO: 3189 - RNA, 17 nt, Mus sp.
cucgcuauuugguacau

SEQ ID NO: 3190 - RNA, 17 nt, Mus sp.
ucgcuauuugguacaug

SEQ ID NO: 3191 - RNA, 17 nt, Mus sp.
uauuugguacauggcua

SEQ ID NO: 3192 - RNA, 17 nt, Mus sp.
acauggcuacucauuaa

SEQ ID NO: 3193 - RNA, 17 nt, Mus sp.
uggcuacucauuaauua

SEQ ID NO: 3194 - RNA, 17 nt, Mus sp.
cuacucauuaauuauca

SEQ ID NO: 3195 - RNA, 17 nt, Mus sp.
uacucauuaauuaucaa

SEQ ID NO: 3196 - RNA, 17 nt, Mus sp.
ucauuaauuaucaaaga

SEQ ID NO: 3197 - RNA, 17 nt, Mus sp.
cauuaauuaucaaagau

SEQ ID NO: 3198 - RNA, 17 nt, Mus sp.
uuaauuaucaaagaugu

SEQ ID NO: 3199 - RNA, 17 nt, Mus sp.
aggggacuauacgaucu

SEQ ID NO: 3200 - RNA, 17 nt, Mus sp.
gggacuauacgaucuug

SEQ ID NO: 3201 - RNA, 17 nt, Mus sp.
uauacgaucuugcuggg

SEQ ID NO: 3202 - RNA, 17 nt, Mus sp.
uacgaucuugcugggca

SEQ ID NO: 3203 - RNA, 17 nt, Mus sp.
cugggcauaaagcaguc

SEQ ID NO: 3204 - RNA, 17 nt, Mus sp.
aaagcagucaaggcuau

SEQ ID NO: 3205 - RNA, 17 nt, Mus sp.
ucaaggcuauuuaaaaa

SEQ ID NO: 3206 - RNA, 17 nt, Mus sp.
aaggcuauuuaaaaacc

SEQ ID NO: 3207 - RNA, 17 nt, Mus sp.
aggcuauuuaaaaaccu

SEQ ID NO: 3208 - RNA, 17 nt, Mus sp.
ggcuauuuaaaaaccuc

SEQ ID NO: 3209 - RNA, 17 nt, Mus sp.
cugccacucucauugua

SEQ ID NO: 3210 - RNA, 17 nt, Mus sp.
gccacucucauuguaaa

SEQ ID NO: 3211 - RNA, 17 nt, Mus sp.
acucucauuguaaacgu

SEQ ID NO: 3212 - RNA, 17 nt, Mus sp.
cucauuguaaacgugaa

SEQ ID NO: 3213 - RNA, 17 nt, Mus sp.
ugaaaccucagaucuac

SEQ ID NO: 3214 - RNA, 17 nt, Mus sp.
ccucagaucuacgaaaa

SEQ ID NO: 3215 - RNA, 17 nt, Mus sp.
ucagaucuacgaaaagu

SEQ ID NO: 3216 - RNA, 17 nt, Mus sp.
cgaaaaguccguguccu

SEQ ID NO: 3217 - RNA, 17 nt, Mus sp.
guccguguccucgcuuc

SEQ ID NO: 3218 - RNA, 17 nt, Mus sp.
cguguccucgcuuccaa

SEQ ID NO: 3219 - RNA, 17 nt, Mus sp.
uccucgcuuccaagccc

SEQ ID NO: 3220 - RNA, 17 nt, Mus sp.
ccucgcuuccaagccca

SEQ ID NO: 3221 - RNA, 17 nt, Mus sp.
gcccaccucucuauccg

SEQ ID NO: 3222 - RNA, 17 nt, Mus sp.
ccaccucucuauccgcu

SEQ ID NO: 3223 - RNA, 17 nt, Mus sp.
accucucuauccgcugg

SEQ ID NO: 3224 - RNA, 17 nt, Mus sp.
cucucuauccgcugggc

SEQ ID NO: 3225 - RNA, 17 nt, Mus sp.
agacaaguccucacuug

SEQ ID NO: 3226 - RNA, 17 nt, Mus sp.
caaguccucacuugcac

SEQ ID NO: 3227 - RNA, 17 nt, Mus sp.
uccucacuugcaccgug

SEQ ID NO: 3228 - RNA, 17 nt, Mus sp.
caccguguauggcaucc

SEQ ID NO: 3229 - RNA, 17 nt, Mus sp.
uauggcaucccucggcc

SEQ ID NO: 3230 - RNA, 17 nt, Mus sp.
gcaucccucggccaaca

SEQ ID NO: 3231 - RNA, 17 nt, Mus sp.
ccaacaaucacguggcu

SEQ ID NO: 3232 - RNA, 17 nt, Mus sp.
acguggcucuggcaccc

SEQ ID NO: 3233 - RNA, 17 nt, Mus sp.
accccugucaccacaau

SEQ ID NO: 3234 - RNA, 17 nt, Mus sp.
accacaaucacuccaaa

SEQ ID NO: 3235 - RNA, 17 nt, Mus sp.
caaucacuccaaagaaa

SEQ ID NO: 3236 - RNA, 17 nt, Mus sp.
agaaagguaugacuucu

SEQ ID NO: 3237 - RNA, 17 nt, Mus sp.
guaugacuucugcacug

SEQ ID NO: 3238 - RNA, 17 nt, Mus sp.
uaugacuucugcacuga

SEQ ID NO: 3239 - RNA, 17 nt, Mus sp.
ugaagaauccuuuaucc

SEQ ID NO: 3240 - RNA, 17 nt, Mus sp.
agaauccuuuauccugg

SEQ ID NO: 3241 - RNA, 17 nt, Mus sp.
gaauccuuuauccugga

SEQ ID NO: 3242 - RNA, 17 nt, Mus sp.
aauccuuuauccuggau

SEQ ID NO: 3243 - RNA, 17 nt, Mus sp.
uccuuuauccuggaucc

SEQ ID NO: 3244 - RNA, 17 nt, Mus sp.
uccuggaucccagcagc

SEQ ID NO: 3245 - RNA, 17 nt, Mus sp.
cagcaacuuaggaaaca

SEQ ID NO: 3246 - RNA, 17 nt, Mus sp.
agcaacuuaggaaacag

SEQ ID NO: 3247 - RNA, 17 nt, Mus sp.
gagagcaucucucagcg

SEQ ID NO: 3248 - RNA, 17 nt, Mus sp.
gagcaucucucagcgca

SEQ ID NO: 3249 - RNA, 17 nt, Mus sp.
gcaucucucagcgcaug

SEQ ID NO: 3250 - RNA, 17 nt, Mus sp.
augacggucauagaagg

SEQ ID NO: 3251 - RNA, 17 nt, Mus sp.
acggucauagaaggaac

SEQ ID NO: 3252 - RNA, 17 nt, Mus sp.
gaacaaauaagacgguu

SEQ ID NO: 3253 - RNA, 17 nt, Mus sp.
aagacgguuagcacauu

SEQ ID NO: 3254 - RNA, 17 nt, Mus sp.
agacgguuagcacauug

SEQ ID NO: 3255 - RNA, 17 nt, Mus sp.
uagcacauugguggugg

SEQ ID NO: 3256 - RNA, 17 nt, Mus sp.
ggcugacucucagaccc

SEQ ID NO: 3257 - RNA, 17 nt, Mus sp.
cugacucucagaccccu

SEQ ID NO: 3258 - RNA, 17 nt, Mus sp.
ccuggaaucuacagcug

SEQ ID NO: 3259 - RNA, 17 nt, Mus sp.
uggaaucuacagcugcc

SEQ ID NO: 3260 - RNA, 17 nt, Mus sp.
ccgggccuucaauaaaa

SEQ ID NO: 3261 - RNA, 17 nt, Mus sp.
cgggccuucaauaaaau

SEQ ID NO: 3262 - RNA, 17 nt, Mus sp.
ccuucaauaaaauaggg

SEQ ID NO: 3263 - RNA, 17 nt, Mus sp.
aauaaaauagggacugu

SEQ ID NO: 3264 - RNA, 17 nt, Mus sp.
agaaacauaaaauuuua

SEQ ID NO: 3265 - RNA, 17 nt, Mus sp.
cauaaaauuuuauguca

SEQ ID NO: 3266 - RNA, 17 nt, Mus sp.
auaaaauuuuaugucac

SEQ ID NO: 3267 - RNA, 17 nt, Mus sp.
uaaaauuuuaugucaca

SEQ ID NO: 3268 - RNA, 17 nt, Mus sp.
aaaauuuuaugucacag

SEQ ID NO: 3269 - RNA, 17 nt, Mus sp.
uuuuaugucacagaugu

SEQ ID NO: 3270 - RNA, 17 nt, Mus sp.
gaauggcuuucacguuu

SEQ ID NO: 3271 - RNA, 17 nt, Mus sp.
aauggcuuucacguuuc

SEQ ID NO: 3272 - RNA, 17 nt, Mus sp.
auggcuuucacguuucc

SEQ ID NO: 3273 - RNA, 17 nt, Mus sp.
uuucacguuuccuugga

SEQ ID NO: 3274 - RNA, 17 nt, Mus sp.
uucacguuuccuuggaa

SEQ ID NO: 3275 - RNA, 17 nt, Mus sp.
ucacguuuccuuggaaa

SEQ ID NO: 3276 - RNA, 17 nt, Mus sp.
cguuuccuuggaaaaga

SEQ ID NO: 3277 - RNA, 17 nt, Mus sp.
gaaacuguccugugugg

SEQ ID NO: 3278 - RNA, 17 nt, Mus sp.
uguguggucaauaaauu

SEQ ID NO: 3279 - RNA, 17 nt, Mus sp.
uggucaauaaauuccug

SEQ ID NO: 3280 - RNA, 17 nt, Mus sp.
caauaaauuccuguaca

SEQ ID NO: 3281 - RNA, 17 nt, Mus sp.
aauaaauuccuguacag

SEQ ID NO: 3282 - RNA, 17 nt, Mus sp.
auuccuguacagagaca

SEQ ID NO: 3283 - RNA, 17 nt, Mus sp.
agagacauuaccuggau

SEQ ID NO: 3284 - RNA, 17 nt, Mus sp.
gagacauuaccuggauu

SEQ ID NO: 3285 - RNA, 17 nt, Mus sp.
accuggauucugcuacg

SEQ ID NO: 3286 - RNA, 17 nt, Mus sp.
ccuggauucugcuacgg

SEQ ID NO: 3287 - RNA, 17 nt, Mus sp.
auucugcuacggacagu

SEQ ID NO: 3288 - RNA, 17 nt, Mus sp.
cggacaguuaacaacag

SEQ ID NO: 3289 - RNA, 17 nt, Mus sp.
ggacaguuaacaacaga

SEQ ID NO: 3290 - RNA, 17 nt, Mus sp.
ugcaccauaguaucagc

SEQ ID NO: 3291 - RNA, 17 nt, Mus sp.
accauaguaucagcaag

SEQ ID NO: 3292 - RNA, 17 nt, Mus sp.
cauaguaucagcaagca

SEQ ID NO: 3293 - RNA, 17 nt, Mus sp.
ccaccacucaagauuac

SEQ ID NO: 3294 - RNA, 17 nt, Mus sp.
cucaagauuacuccauc

SEQ ID NO: 3295 - RNA, 17 nt, Mus sp.
ucaagauuacuccauca

SEQ ID NO: 3296 - RNA, 17 nt, Mus sp.
agauuacuccaucacuc

SEQ ID NO: 3297 - RNA, 17 nt, Mus sp.
uacuccaucacucugaa

SEQ ID NO: 3298 - RNA, 17 nt, Mus sp.
ccaucacucugaaccuu

SEQ ID NO: 3299 - RNA, 17 nt, Mus sp.
cugaaccuugucaucaa

SEQ ID NO: 3300 - RNA, 17 nt, Mus sp.
aaccuugucaucaagaa

SEQ ID NO: 3301 - RNA, 17 nt, Mus sp.
cuugucaucaagaacgu

SEQ ID NO: 3302 - RNA, 17 nt, Mus sp.
gaacgugucucuagaag

SEQ ID NO: 3303 - RNA, 17 nt, Mus sp.
acgugucucuagaagac

SEQ ID NO: 3304 - RNA, 17 nt, Mus sp.
gugucucuagaagacuc

SEQ ID NO: 3305 - RNA, 17 nt, Mus sp.
agaagacucgggcaccu

SEQ ID NO: 3306 - RNA, 17 nt, Mus sp.
gggcaccuaugcgugca

SEQ ID NO: 3307 - RNA, 17 nt, Mus sp.
aggaacauauacacagg

SEQ ID NO: 3308 - RNA, 17 nt, Mus sp.
gaacauauacacagggg

SEQ ID NO: 3309 - RNA, 17 nt, Mus sp.
gaagacauccuucggaa

SEQ ID NO: 3310 - RNA, 17 nt, Mus sp.
gacauccuucggaagac

SEQ ID NO: 3311 - RNA, 17 nt, Mus sp.
acauccuucggaagaca

SEQ ID NO: 3312 - RNA, 17 nt, Mus sp.
acagaaguucucguuag

SEQ ID NO: 3313 - RNA, 17 nt, Mus sp.
cagaaguucucguuaga

SEQ ID NO: 3314 - RNA, 17 nt, Mus sp.
gaaguucucguuagaga

SEQ ID NO: 3315 - RNA, 17 nt, Mus sp.
guucucguuagagauuc

SEQ ID NO: 3316 - RNA, 17 nt, Mus sp.
uucucguuagagauucg

SEQ ID NO: 3317 - RNA, 17 nt, Mus sp.
uuagagauucggaagcg

SEQ ID NO: 3318 - RNA, 17 nt, Mus sp.
uagagauucggaagcgc

SEQ ID NO: 3319 - RNA, 17 nt, Mus sp.
caccugcuucaaaaccu

SEQ ID NO: 3320 - RNA, 17 nt, Mus sp.
accugcuucaaaaccuc

SEQ ID NO: 3321 - RNA, 17 nt, Mus sp.
caaaaccucagugacua

SEQ ID NO: 3322 - RNA, 17 nt, Mus sp.
cagugacuacgaggucu

SEQ ID NO: 3323 - RNA, 17 nt, Mus sp.
uacgaggucuccaucag

SEQ ID NO: 3324 - RNA, 17 nt, Mus sp.
cgaggucuccaucagug

SEQ ID NO: 3325 - RNA, 17 nt, Mus sp.
gucuccaucaguggcuc

SEQ ID NO: 3326 - RNA, 17 nt, Mus sp.
caguggcucuacgaccu

SEQ ID NO: 3327 - RNA, 17 nt, Mus sp.
guggcucuacgaccuua

SEQ ID NO: 3328 - RNA, 17 nt, Mus sp.
uacgaccuuagacuguc

SEQ ID NO: 3329 - RNA, 17 nt, Mus sp.
acgaccuuagacuguca

SEQ ID NO: 3330 - RNA, 17 nt, Mus sp.
uagacugucaagcuaga

SEQ ID NO: 3331 - RNA, 17 nt, Mus sp.
gucaagcuagagguguc

SEQ ID NO: 3332 - RNA, 17 nt, Mus sp.
agagguguccccgcgcc

SEQ ID NO: 3333 - RNA, 17 nt, Mus sp.
ccgcgccucagaucacu

SEQ ID NO: 3334 - RNA, 17 nt, Mus sp.
agaucacuugguucaaa

SEQ ID NO: 3335 - RNA, 17 nt, Mus sp.
cacuugguucaaaaaca

SEQ ID NO: 3336 - RNA, 17 nt, Mus sp.
acuugguucaaaaacaa

SEQ ID NO: 3337 - RNA, 17 nt, Mus sp.
ccgggaauuauuuuagg

SEQ ID NO: 3338 - RNA, 17 nt, Mus sp.
cgggaauuauuuuagga

SEQ ID NO: 3339 - RNA, 17 nt, Mus sp.
gaaagagucacagagga

SEQ ID NO: 3340 - RNA, 17 nt, Mus sp.
gagggugucuauaggug

SEQ ID NO: 3341 - RNA, 17 nt, Mus sp.
gggugucuauaggugcc

SEQ ID NO: 3342 - RNA, 17 nt, Mus sp.
gugucuauaggugccga

SEQ ID NO: 3343 - RNA, 17 nt, Mus sp.
cgcagccuaccucaccg

SEQ ID NO: 3344 - RNA, 17 nt, Mus sp.
gccuaccucaccgugca

SEQ ID NO: 3345 - RNA, 17 nt, Mus sp.
aggaaccucagacaagu

SEQ ID NO: 3346 - RNA, 17 nt, Mus sp.
agacaagucaaaccugg

SEQ ID NO: 3347 - RNA, 17 nt, Mus sp.
gagcugaucacgcucac

SEQ ID NO: 3348 - RNA, 17 nt, Mus sp.
aucacgcucacgugcac

SEQ ID NO: 3349 - RNA, 17 nt, Mus sp.
gcgacccucuuuuggcu

SEQ ID NO: 3350 - RNA, 17 nt, Mus sp.
gacccucuuuuggcucc

SEQ ID NO: 3351 - RNA, 17 nt, Mus sp.
acccucuuuuggcuccu

SEQ ID NO: 3352 - RNA, 17 nt, Mus sp.
cccucuuuuggcuccuu

SEQ ID NO: 3353 - RNA, 17 nt, Mus sp.
uuuuggcuccuucuaac

SEQ ID NO: 3354 - RNA, 17 nt, Mus sp.
uggcuccuucuaacucu

SEQ ID NO: 3355 - RNA, 17 nt, Mus sp.
ggcuccuucuaacucuc

SEQ ID NO: 3356 - RNA, 17 nt, Mus sp.
cuccuucuaacucucuu

SEQ ID NO: 3357 - RNA, 17 nt, Mus sp.
uucuaacucucuucauc

SEQ ID NO: 3358 - RNA, 17 nt, Mus sp.
cuaacucucuucaucag

SEQ ID NO: 3359 - RNA, 17 nt, Mus sp.
aacucucuucaucagaa

SEQ ID NO: 3360 - RNA, 17 nt, Mus sp.
acucucuucaucagaaa

SEQ ID NO: 3361 - RNA, 17 nt, Mus sp.
cucuucaucagaaaacu

SEQ ID NO: 3362 - RNA, 17 nt, Mus sp.
gaagcggucuucuuccg

SEQ ID NO: 3363 - RNA, 17 nt, Mus sp.
agcggucuucuuccgaa

SEQ ID NO: 3364 - RNA, 17 nt, Mus sp.
gcggucuucuuccgaag

SEQ ID NO: 3365 - RNA, 17 nt, Mus sp.
ggucuucuuccgaagua

SEQ ID NO: 3366 - RNA, 17 nt, Mus sp.
gucuucuuccgaaguaa

SEQ ID NO: 3367 - RNA, 17 nt, Mus sp.
uccgaaguaaagacaga

SEQ ID NO: 3368 - RNA, 17 nt, Mus sp.
gacagacuaccugucaa

SEQ ID NO: 3369 - RNA, 17 nt, Mus sp.
cuaccugucaaucauua

SEQ ID NO: 3370 - RNA, 17 nt, Mus sp.
cugucaaucauuaugga

SEQ ID NO: 3371 - RNA, 17 nt, Mus sp.
ucaaucauuauggaccc

SEQ ID NO: 3372 - RNA, 17 nt, Mus sp.
caaucauuauggaccca

SEQ ID NO: 3373 - RNA, 17 nt, Mus sp.
gaugaaguuccccugga

SEQ ID NO: 3374 - RNA, 17 nt, Mus sp.
augaaguuccccuggau

SEQ ID NO: 3375 - RNA, 17 nt, Mus sp.
gcugcccuaugaugcca

SEQ ID NO: 3376 - RNA, 17 nt, Mus sp.
gugggaguuugcacggg

SEQ ID NO: 3377 - RNA, 17 nt, Mus sp.
ugggaguuugcacggga

SEQ ID NO: 3378 - RNA, 17 nt, Mus sp.
cugaaacuaggcaaauc

SEQ ID NO: 3379 - RNA, 17 nt, Mus sp.
aggcaaaucgcucggaa

SEQ ID NO: 3380 - RNA, 17 nt, Mus sp.
aaaucgcucggaagagg

SEQ ID NO: 3381 - RNA, 17 nt, Mus sp.
gaggggcuuuugggaaa

SEQ ID NO: 3382 - RNA, 17 nt, Mus sp.
aggggcuuuugggaaag

SEQ ID NO: 3383 - RNA, 17 nt, Mus sp.
ggggcuuuugggaaagu

SEQ ID NO: 3384 - RNA, 17 nt, Mus sp.
gggaaagucguucaagc

SEQ ID NO: 3385 - RNA, 17 nt, Mus sp.
aaagucguucaagccuc

SEQ ID NO: 3386 - RNA, 17 nt, Mus sp.
aagucguucaagccucu

SEQ ID NO: 3387 - RNA, 17 nt, Mus sp.
ucaagccucugcauuug

SEQ ID NO: 3388 - RNA, 17 nt, Mus sp.
cucugcauuuggcauua

SEQ ID NO: 3389 - RNA, 17 nt, Mus sp.
ucugcauuuggcauuaa

SEQ ID NO: 3390 - RNA, 17 nt, Mus sp.
uaagaaaucacccaccu

SEQ ID NO: 3391 - RNA, 17 nt, Mus sp.
gaagauguugaaagagg

SEQ ID NO: 3392 - RNA, 17 nt, Mus sp.
cagugaguacaaagcuc

SEQ ID NO: 3393 - RNA, 17 nt, Mus sp.
acaaagcucugaugacc

SEQ ID NO: 3394 - RNA, 17 nt, Mus sp.
accgaacucaagaucuu

SEQ ID NO: 3395 - RNA, 17 nt, Mus sp.
cucaagaucuugaccca

SEQ ID NO: 3396 - RNA, 17 nt, Mus sp.
caagaucuugacccaca

SEQ ID NO: 3397 - RNA, 17 nt, Mus sp.
acccacaucggccauca

SEQ ID NO: 3398 - RNA, 17 nt, Mus sp.
ucggccaucaucugaau

SEQ ID NO: 3399 - RNA, 17 nt, Mus sp.
gccaucaucugaaugug

SEQ ID NO: 3400 - RNA, 17 nt, Mus sp.
aaugugguuaaccuccu

SEQ ID NO: 3401 - RNA, 17 nt, Mus sp.
augugguuaaccuccug

SEQ ID NO: 3402 - RNA, 17 nt, Mus sp.
guuaaccuccugggagc

SEQ ID NO: 3403 - RNA, 17 nt, Mus sp.
auggugaucguggaaua

SEQ ID NO: 3404 - RNA, 17 nt, Mus sp.
cguggaauacugcaaau

SEQ ID NO: 3405 - RNA, 17 nt, Mus sp.
cugcaaauacggaaacc

SEQ ID NO: 3406 - RNA, 17 nt, Mus sp.
aaaccuguccaacuacc

SEQ ID NO: 3407 - RNA, 17 nt, Mus sp.
guccaacuaccucaaga

SEQ ID NO: 3408 - RNA, 17 nt, Mus sp.
acgugacuuauucuguc

SEQ ID NO: 3409 - RNA, 17 nt, Mus sp.
cgugacuuauucugucu

SEQ ID NO: 3410 - RNA, 17 nt, Mus sp.
ugacuuauucugucuca

SEQ ID NO: 3411 - RNA, 17 nt, Mus sp.
gacuuauucugucucaa

SEQ ID NO: 3412 - RNA, 17 nt, Mus sp.
uauucugucucaacaag

SEQ ID NO: 3413 - RNA, 17 nt, Mus sp.
uucugucucaacaagga

SEQ ID NO: 3414 - RNA, 17 nt, Mus sp.
cgcagccuugcauaugg

SEQ ID NO: 3415 - RNA, 17 nt, Mus sp.
ccuugcauauggagcuc

SEQ ID NO: 3416 - RNA, 17 nt, Mus sp.
auggagcucaagaaaga

SEQ ID NO: 3417 - RNA, 17 nt, Mus sp.
ccccgccuagacagugu

SEQ ID NO: 3418 - RNA, 17 nt, Mus sp.
gacagugucagcagcuc

SEQ ID NO: 3419 - RNA, 17 nt, Mus sp.
cagcagcucaaguguca

SEQ ID NO: 3420 - RNA, 17 nt, Mus sp.
ucaagugucaccagcuc

SEQ ID NO: 3421 - RNA, 17 nt, Mus sp.
caccagcuccagcuucc

SEQ ID NO: 3422 - RNA, 17 nt, Mus sp.
cuccagcuucccugaag

SEQ ID NO: 3423 - RNA, 17 nt, Mus sp.
uccagcuucccugaaga

SEQ ID NO: 3424 - RNA, 17 nt, Mus sp.
acgaggauuacagugag

SEQ ID NO: 3425 - RNA, 17 nt, Mus sp.
cgaggauuacagugaga

SEQ ID NO: 3426 - RNA, 17 nt, Mus sp.
agugagaucuccaagca

SEQ ID NO: 3427 - RNA, 17 nt, Mus sp.
ugagaucuccaagcagc

SEQ ID NO: 3428 - RNA, 17 nt, Mus sp.
cagccccucaccaugga

SEQ ID NO: 3429 - RNA, 17 nt, Mus sp.
gaccugauuuccuacag

SEQ ID NO: 3430 - RNA, 17 nt, Mus sp.
accugauuuccuacagu

SEQ ID NO: 3431 - RNA, 17 nt, Mus sp.
ccugauuuccuacaguu

SEQ ID NO: 3432 - RNA, 17 nt, Mus sp.
gauuuccuacaguuucc

SEQ ID NO: 3433 - RNA, 17 nt, Mus sp.
ccuacaguuuccaagug

SEQ ID NO: 3434 - RNA, 17 nt, Mus sp.
cuacaguuuccaagugg

SEQ ID NO: 3435 - RNA, 17 nt, Mus sp.
uacaguuuccaaguggc

SEQ ID NO: 3436 - RNA, 17 nt, Mus sp.
cauggaguuucuguccu

SEQ ID NO: 3437 - RNA, 17 nt, Mus sp.
auggaguuucuguccuc

SEQ ID NO: 3438 - RNA, 17 nt, Mus sp.
uggaguuucuguccucc

SEQ ID NO: 3439 - RNA, 17 nt, Mus sp.
guuucuguccuccagaa

SEQ ID NO: 3440 - RNA, 17 nt, Mus sp.
ucuguccuccagaaagu

SEQ ID NO: 3441 - RNA, 17 nt, Mus sp.
agaaacauccuuuuauc

SEQ ID NO: 3442 - RNA, 17 nt, Mus sp.
aacauccuuuuaucuga

SEQ ID NO: 3443 - RNA, 17 nt, Mus sp.
acauccuuuuaucugag

SEQ ID NO: 3444 - RNA, 17 nt, Mus sp.
cauccuuuuaucugaga

SEQ ID NO: 3445 - RNA, 17 nt, Mus sp.
auccuuuuaucugagaa

SEQ ID NO: 3446 - RNA, 17 nt, Mus sp.
ccuuuuaucugagaaca

SEQ ID NO: 3447 - RNA, 17 nt, Mus sp.
gugaagauuugcgacuu

SEQ ID NO: 3448 - RNA, 17 nt, Mus sp.
ugaagauuugcgacuuu

SEQ ID NO: 3449 - RNA, 17 nt, Mus sp.
uugcgacuuuggccugg

SEQ ID NO: 3450 - RNA, 17 nt, Mus sp.
ugcgacuuuggccuggc

SEQ ID NO: 3451 - RNA, 17 nt, Mus sp.
auauuuauaagaacccu

SEQ ID NO: 3452 - RNA, 17 nt, Mus sp.
acccugauuaugugagg

SEQ ID NO: 3453 - RNA, 17 nt, Mus sp.
cccugauuaugugagga

SEQ ID NO: 3454 - RNA, 17 nt, Mus sp.
gaggagauacucgacuu

SEQ ID NO: 3455 - RNA, 17 nt, Mus sp.
gagauacucgacuuccc

SEQ ID NO: 3456 - RNA, 17 nt, Mus sp.
acucgacuuccccuaaa

SEQ ID NO: 3457 - RNA, 17 nt, Mus sp.
cucgacuuccccuaaaa

SEQ ID NO: 3458 - RNA, 17 nt, Mus sp.
cuuccccuaaaauggau

SEQ ID NO: 3459 - RNA, 17 nt, Mus sp.
ggauggcuccugaaucc

SEQ ID NO: 3460 - RNA, 17 nt, Mus sp.
uccugaauccaucuuug

SEQ ID NO: 3461 - RNA, 17 nt, Mus sp.
gaauccaucuuugacaa

SEQ ID NO: 3462 - RNA, 17 nt, Mus sp.
auccaucuuugacaagg

SEQ ID NO: 3463 - RNA, 17 nt, Mus sp.
uccaucuuugacaaggu

SEQ ID NO: 3464 - RNA, 17 nt, Mus sp.
gacaaggucuacagcac

SEQ ID NO: 3465 - RNA, 17 nt, Mus sp.
caaggucuacagcacca

SEQ ID NO: 3466 - RNA, 17 nt, Mus sp.
ugugugguccuauggcg

SEQ ID NO: 3467 - RNA, 17 nt, Mus sp.
gugguccuauggcgugu

SEQ ID NO: 3468 - RNA, 17 nt, Mus sp.
uggcguguugcuguggg

SEQ ID NO: 3469 - RNA, 17 nt, Mus sp.
ugggagaucuucuccuu

SEQ ID NO: 3470 - RNA, 17 nt, Mus sp.
ggagaucuucuccuuag

SEQ ID NO: 3471 - RNA, 17 nt, Mus sp.
gagaucuucuccuuagg

SEQ ID NO: 3472 - RNA, 17 nt, Mus sp.
gaucuucuccuuagggg

SEQ ID NO: 3473 - RNA, 17 nt, Mus sp.
cuucuccuuaggggguu

SEQ ID NO: 3474 - RNA, 17 nt, Mus sp.
uucuccuuaggggguuc

SEQ ID NO: 3475 - RNA, 17 nt, Mus sp.
uaggggguucuccauac

SEQ ID NO: 3476 - RNA, 17 nt, Mus sp.
aggggguucuccauacc

SEQ ID NO: 3477 - RNA, 17 nt, Mus sp.
gggguucuccauaccca

SEQ ID NO: 3478 - RNA, 17 nt, Mus sp.
uucuccauacccaggag

SEQ ID NO: 3479 - RNA, 17 nt, Mus sp.
ugaagacuucugcagcc

SEQ ID NO: 3480 - RNA, 17 nt, Mus sp.
gaagacuucugcagccg

SEQ ID NO: 3481 - RNA, 17 nt, Mus sp.
cccggaguaugccacac

SEQ ID NO: 3482 - RNA, 17 nt, Mus sp.
ccugaaaucuaccaaau

SEQ ID NO: 3483 - RNA, 17 nt, Mus sp.
ugaaaucuaccaaauca

SEQ ID NO: 3484 - RNA, 17 nt, Mus sp.
uaccaaaucauguugga

SEQ ID NO: 3485 - RNA, 17 nt, Mus sp.
aaucauguuggauugcu

SEQ ID NO: 3486 - RNA, 17 nt, Mus sp.
uguuggauugcuggcac

SEQ ID NO: 3487 - RNA, 17 nt, Mus sp.
gccccgguuugcugaac

SEQ ID NO: 3488 - RNA, 17 nt, Mus sp.
ccccgguuugcugaacu

SEQ ID NO: 3489 - RNA, 17 nt, Mus sp.
gcugaacuuguggagaa

SEQ ID NO: 3490 - RNA, 17 nt, Mus sp.
gagaaacuuggugaccu

SEQ ID NO: 3491 - RNA, 17 nt, Mus sp.
gaccugcuucaagccaa

SEQ ID NO: 3492 - RNA, 17 nt, Mus sp.
accugcuucaagccaac

SEQ ID NO: 3493 - RNA, 17 nt, Mus sp.
gccaacguccaacagga

SEQ ID NO: 3494 - RNA, 17 nt, Mus sp.
ggaaagauuacaucccc

SEQ ID NO: 3495 - RNA, 17 nt, Mus sp.
gaaagauuacauccccc

SEQ ID NO: 3496 - RNA, 17 nt, Mus sp.
gauuacaucccccucaa

SEQ ID NO: 3497 - RNA, 17 nt, Mus sp.
aucccccucaaugccau

SEQ ID NO: 3498 - RNA, 17 nt, Mus sp.
aaugccauacugacuag

SEQ ID NO: 3499 - RNA, 17 nt, Mus sp.
uacugacuagaaacagu

SEQ ID NO: 3500 - RNA, 17 nt, Mus sp.
gaaacaguagcuucaca

SEQ ID NO: 3501 - RNA, 17 nt, Mus sp.
caguagcuucacauacu

SEQ ID NO: 3502 - RNA, 17 nt, Mus sp.
aguagcuucacauacuc

SEQ ID NO: 3503 - RNA, 17 nt, Mus sp.
cuucacauacucgaccc

SEQ ID NO: 3504 - RNA, 17 nt, Mus sp.
cacauacucgaccccca

SEQ ID NO: 3505 - RNA, 17 nt, Mus sp.
ccccaccuucucugagg

SEQ ID NO: 3506 - RNA, 17 nt, Mus sp.
cccaccuucucugagga

SEQ ID NO: 3507 - RNA, 17 nt, Mus sp.
caccuucucugaggacc

SEQ ID NO: 3508 - RNA, 17 nt, Mus sp.
gaggaccuuuucaagga

SEQ ID NO: 3509 - RNA, 17 nt, Mus sp.
aggaccuuuucaaggac

SEQ ID NO: 3510 - RNA, 17 nt, Mus sp.
ggaccuuuucaaggacg

SEQ ID NO: 3511 - RNA, 17 nt, Mus sp.
gaccuuuucaaggacgg

SEQ ID NO: 3512 - RNA, 17 nt, Mus sp.
ggacggcuuugcagauc

SEQ ID NO: 3513 - RNA, 17 nt, Mus sp.
gacggcuuugcagaucc

SEQ ID NO: 3514 - RNA, 17 nt, Mus sp.
uugcagauccacauuuu

SEQ ID NO: 3515 - RNA, 17 nt, Mus sp.
auccacauuuucauucc

SEQ ID NO: 3516 - RNA, 17 nt, Mus sp.
uccacauuuucauuccg

SEQ ID NO: 3517 - RNA, 17 nt, Mus sp.
ccacauuuucauuccgg

SEQ ID NO: 3518 - RNA, 17 nt, Mus sp.
cacauuuucauuccgga

SEQ ID NO: 3519 - RNA, 17 nt, Mus sp.
auuuucauuccggaagc

SEQ ID NO: 3520 - RNA, 17 nt, Mus sp.
uuuucauuccggaagcu

SEQ ID NO: 3521 - RNA, 17 nt, Mus sp.
cggaagcucugaugaug

SEQ ID NO: 3522 - RNA, 17 nt, Mus sp.
ugugagauauguaaacg

SEQ ID NO: 3523 - RNA, 17 nt, Mus sp.
agauauguaaacgcuuu

SEQ ID NO: 3524 - RNA, 17 nt, Mus sp.
uaaacgcuuucaaauuc

SEQ ID NO: 3525 - RNA, 17 nt, Mus sp.
aaacgcuuucaaauuca

SEQ ID NO: 3526 - RNA, 17 nt, Mus sp.
aacgcuuucaaauucau

SEQ ID NO: 3527 - RNA, 17 nt, Mus sp.
uuucaaauucaugagcc

SEQ ID NO: 3528 - RNA, 17 nt, Mus sp.
uucaaauucaugagccu

SEQ ID NO: 3529 - RNA, 17 nt, Mus sp.
caaaaccuuugaggagc

SEQ ID NO: 3530 - RNA, 17 nt, Mus sp.
aaaaccuuugaggagcu

SEQ ID NO: 3531 - RNA, 17 nt, Mus sp.
gaggagcuuucaccgaa

SEQ ID NO: 3532 - RNA, 17 nt, Mus sp.
aggagcuuucaccgaac

SEQ ID NO: 3533 - RNA, 17 nt, Mus sp.
ggagcuuucaccgaacu

SEQ ID NO: 3534 - RNA, 17 nt, Mus sp.
accgaacuccaccucca

SEQ ID NO: 3535 - RNA, 17 nt, Mus sp.
cuccaccuccauguuug

SEQ ID NO: 3536 - RNA, 17 nt, Mus sp.
cuccauguuugaggacu

SEQ ID NO: 3537 - RNA, 17 nt, Mus sp.
uccauguuugaggacua

SEQ ID NO: 3538 - RNA, 17 nt, Mus sp.
ugaggacuaucagcugg

SEQ ID NO: 3539 - RNA, 17 nt, Mus sp.
aggacuaucagcuggac

SEQ ID NO: 3540 - RNA, 17 nt, Mus sp.
uggacacuagcacucug

SEQ ID NO: 3541 - RNA, 17 nt, Mus sp.
cuagcacucugcugggc

SEQ ID NO: 3542 - RNA, 17 nt, Mus sp.
gcugggcucccccuugc

SEQ ID NO: 3543 - RNA, 17 nt, Mus sp.
cucccccuugcugaagc

SEQ ID NO: 3544 - RNA, 17 nt, Mus sp.
gaagcgguucaccugga

SEQ ID NO: 3545 - RNA, 17 nt, Mus sp.
aagcgguucaccuggac

SEQ ID NO: 3546 - RNA, 17 nt, Mus sp.
caaggccuccaugaaga

SEQ ID NO: 3547 - RNA, 17 nt, Mus sp.
augaagauagacuugag

SEQ ID NO: 3548 - RNA, 17 nt, Mus sp.
gauagacuugagaauag

SEQ ID NO: 3549 - RNA, 17 nt, Mus sp.
uugagaauagcgaguaa

SEQ ID NO: 3550 - RNA, 17 nt, Mus sp.
uagcgaguaaaagcaag

SEQ ID NO: 3551 - RNA, 17 nt, Mus sp.
gcgggacuuuccgaucu

SEQ ID NO: 3552 - RNA, 17 nt, Mus sp.
cgggacuuuccgaucug

SEQ ID NO: 3553 - RNA, 17 nt, Mus sp.
gggacuuuccgaucugc

SEQ ID NO: 3554 - RNA, 17 nt, Mus sp.
uuuccgaucugccgagg

SEQ ID NO: 3555 - RNA, 17 nt, Mus sp.
gcccagcuucugcuucu

SEQ ID NO: 3556 - RNA, 17 nt, Mus sp.
cccagcuucugcuucuc

SEQ ID NO: 3557 - RNA, 17 nt, Mus sp.
cuucugcuucuccagcu

SEQ ID NO: 3558 - RNA, 17 nt, Mus sp.
uucugcuucuccagcug

SEQ ID NO: 3559 - RNA, 17 nt, Mus sp.
cugcuucuccagcugug

SEQ ID NO: 3560 - RNA, 17 nt, Mus sp.
ggccacaucaggcccgu

SEQ ID NO: 3561 - RNA, 17 nt, Mus sp.
cgaugaaucugagcugg

SEQ ID NO: 3562 - RNA, 17 nt, Mus sp.
aaaggaguccugcuguu

SEQ ID NO: 3563 - RNA, 17 nt, Mus sp.
ccugcuguucuccaccc

SEQ ID NO: 3564 - RNA, 17 nt, Mus sp.
cugcuguucuccacccc

SEQ ID NO: 3565 - RNA, 17 nt, Mus sp.
gcuguucuccaccccca

SEQ ID NO: 3566 - RNA, 17 nt, Mus sp.
cccagacuacaacuccg

SEQ ID NO: 3567 - RNA, 17 nt, Mus sp.
cuacaacuccguggugu

SEQ ID NO: 3568 - RNA, 17 nt, Mus sp.
cgugguguuguacuccu

SEQ ID NO: 3569 - RNA, 17 nt, Mus sp.
gguguuguacuccuccc

SEQ ID NO: 3570 - RNA, 17 nt, Mus sp.
guuguacuccuccccgc

SEQ ID NO: 3571 - RNA, 17 nt, Mus sp.
guacuccuccccgcccg

SEQ ID NO: 3572 - RNA, 17 nt, Mus sp.
gcccgccuaaagcuucu

SEQ ID NO: 3573 - RNA, 17 nt, Mus sp.
cuaaagcuucucaccag

SEQ ID NO: 3574 - RNA, 17 nt, Mus sp.
uaaagcuucucaccagc

SEQ ID NO: 3575 - RNA, 17 nt, Mus sp.
aagcuucucaccagccc

SEQ ID NO: 3576 - RNA, 17 nt, Mus sp.
cugacaguauuauacau

SEQ ID NO: 3577 - RNA, 17 nt, Mus sp.
gacaguauuauacaucu

SEQ ID NO: 3578 - RNA, 17 nt, Mus sp.
acaguauuauacaucua

SEQ ID NO: 3579 - RNA, 17 nt, Mus sp.
aguauuauacaucuaug

SEQ ID NO: 3580 - RNA, 17 nt, Mus sp.
uuauacaucuaugaguu

SEQ ID NO: 3581 - RNA, 17 nt, Mus sp.
auacaucuaugaguuua

SEQ ID NO: 3582 - RNA, 17 nt, Mus sp.
cuaugaguuuacaccua

SEQ ID NO: 3583 - RNA, 17 nt, Mus sp.
uaugaguuuacaccuau

SEQ ID NO: 3584 - RNA, 17 nt, Mus sp.
augaguuuacaccuauu

SEQ ID NO: 3585 - RNA, 17 nt, Mus sp.
uuacaccuauuccgcuc

SEQ ID NO: 3586 - RNA, 17 nt, Mus sp.
acaccuauuccgcucca

SEQ ID NO: 3587 - RNA, 17 nt, Mus sp.
caccuauuccgcuccac

SEQ ID NO: 3588 - RNA, 17 nt, Mus sp.
auuccgcuccacaggag

SEQ ID NO: 3589 - RNA, 17 nt, Mus sp.
cagcugcuuuucgugac

SEQ ID NO: 3590 - RNA, 17 nt, Mus sp.
agcugcuuuucgugacc

SEQ ID NO: 3591 - RNA, 17 nt, Mus sp.
gcugcuuuucgugaccu

SEQ ID NO: 3592 - RNA, 17 nt, Mus sp.
cugcuuuucgugaccuu

SEQ ID NO: 3593 - RNA, 17 nt, Mus sp.
cgugaccuuuaaucgug

SEQ ID NO: 3594 - RNA, 17 nt, Mus sp.
gugaccuuuaaucgugc

SEQ ID NO: 3595 - RNA, 17 nt, Mus sp.
ugaccuuuaaucgugcu

SEQ ID NO: 3596 - RNA, 17 nt, Mus sp.
ccuuuaaucgugcuuuu

SEQ ID NO: 3597 - RNA, 17 nt, Mus sp.
aucgugcuuuuuuguuu

SEQ ID NO: 3598 - RNA, 17 nt, Mus sp.
ucgugcuuuuuuguuuu

SEQ ID NO: 3599 - RNA, 17 nt, Mus sp.
cgugcuuuuuuguuuuu

SEQ ID NO: 3600 - RNA, 17 nt, Mus sp.
gugcuuuuuuguuuuuu

SEQ ID NO: 3601 - RNA, 17 nt, Mus sp.
ugcuuuuuuguuuuuug

SEQ ID NO: 3602 - RNA, 17 nt, Mus sp.
uuuuuuguuuuuuguuu

SEQ ID NO: 3603 - RNA, 17 nt, Mus sp.
uuuuuguuuuuuguuuu

SEQ ID NO: 3604 - RNA, 17 nt, Mus sp.
uuuuguuuuuuguuuug

SEQ ID NO: 3605 - RNA, 17 nt, Mus sp.
uuuguuuuuuguuuugu

SEQ ID NO: 3606 - RNA, 17 nt, Mus sp.
uuguuuuuuguuuuguu

SEQ ID NO: 3607 - RNA, 17 nt, Mus sp.
uuuuuuguuuuguuugu

SEQ ID NO: 3608 - RNA, 17 nt, Mus sp.
uuuuuguuuuguuuguu

SEQ ID NO: 3609 - RNA, 17 nt, Mus sp.
uuuuguuuuguuuguug

SEQ ID NO: 3610 - RNA, 17 nt, Mus sp.
uguuuuguuuguuguug

SEQ ID NO: 3611 - RNA, 17 nt, Mus sp.
guuuuguuuguuguugc

SEQ ID NO: 3612 - RNA, 17 nt, Mus sp.
uuguuuguuguugcugu

SEQ ID NO: 3613 - RNA, 17 nt, Mus sp.
uuuguuguugcuguuuu

SEQ ID NO: 3614 - RNA, 17 nt, Mus sp.
guugcuguuuugacuaa

SEQ ID NO: 3615 - RNA, 17 nt, Mus sp.
uugcuguuuugacuaac

SEQ ID NO: 3616 - RNA, 17 nt, Mus sp.
ugcuguuuugacuaaca

SEQ ID NO: 3617 - RNA, 17 nt, Mus sp.
aagaauguaaccccagu

SEQ ID NO: 3618 - RNA, 17 nt, Mus sp.
accccaguuagugacgu

SEQ ID NO: 3619 - RNA, 17 nt, Mus sp.
ccccaguuagugacgug

SEQ ID NO: 3620 - RNA, 17 nt, Mus sp.
ugaagaauacuauuguu

SEQ ID NO: 3621 - RNA, 17 nt, Mus sp.
agaauacuauuguuaga

SEQ ID NO: 3622 - RNA, 17 nt, Mus sp.
aauacuauuguuagaga

SEQ ID NO: 3623 - RNA, 17 nt, Mus sp.
acuauuguuagagaaau

SEQ ID NO: 3624 - RNA, 17 nt, Mus sp.
cuauuguuagagaaauc

SEQ ID NO: 3625 - RNA, 17 nt, Mus sp.
agagaaaucccccccgc

SEQ ID NO: 3626 - RNA, 17 nt, Mus sp.
caaagccucaggguaac

SEQ ID NO: 3627 - RNA, 17 nt, Mus sp.
cucaggguaaccuggac

SEQ ID NO: 3628 - RNA, 17 nt, Mus sp.
aggugccucuggcgacc

SEQ ID NO: 3629 - RNA, 17 nt, Mus sp.
cccacccucccugcagc

SEQ ID NO: 3630 - RNA, 17 nt, Mus sp.
gugggacuagaggcagu

SEQ ID NO: 3631 - RNA, 17 nt, Mus sp.
gaggcaguaagcccauu

SEQ ID NO: 3632 - RNA, 17 nt, Mus sp.
aagcccauuagcucaug

SEQ ID NO: 3633 - RNA, 17 nt, Mus sp.
agcccauuagcucaugg

SEQ ID NO: 3634 - RNA, 17 nt, Mus sp.
cauuagcucauggcugc

SEQ ID NO: 3635 - RNA, 17 nt, Mus sp.
gaccugcucugucucuc

SEQ ID NO: 3636 - RNA, 17 nt, Mus sp.
ugcucugucucucuuau

SEQ ID NO: 3637 - RNA, 17 nt, Mus sp.
cucugucucucuuaugg

SEQ ID NO: 3638 - RNA, 17 nt, Mus sp.
cugucucucuuauggag

SEQ ID NO: 3639 - RNA, 17 nt, Mus sp.
gucucucuuauggagga

SEQ ID NO: 3640 - RNA, 17 nt, Mus sp.
ucucucuuauggaggaa

SEQ ID NO: 3641 - RNA, 17 nt, Mus sp.
aaaaggcuuugggaugc

SEQ ID NO: 3642 - RNA, 17 nt, Mus sp.
aaaggcuuugggaugcg

SEQ ID NO: 3643 - RNA, 17 nt, Mus sp.
ggaugcguccguccugu

SEQ ID NO: 3644 - RNA, 17 nt, Mus sp.
gcguccguccuguggag

SEQ ID NO: 3645 - RNA, 17 nt, Mus sp.
agggggcuccgcuaugc

SEQ ID NO: 3646 - RNA, 17 nt, Mus sp.
gcuccgcuaugccacuu

SEQ ID NO: 3647 - RNA, 17 nt, Mus sp.
augccacuucagugacu

SEQ ID NO: 3648 - RNA, 17 nt, Mus sp.
ugccacuucagugacuu

SEQ ID NO: 3649 - RNA, 17 nt, Mus sp.
cagugacuucucacucc

SEQ ID NO: 3650 - RNA, 17 nt, Mus sp.
agugacuucucacuccu

SEQ ID NO: 3651 - RNA, 17 nt, Mus sp.
ugacuucucacuccugg

SEQ ID NO: 3652 - RNA, 17 nt, Mus sp.
uucucacuccuggccuc

SEQ ID NO: 3653 - RNA, 17 nt, Mus sp.
ccuggccuccgcuguuu

SEQ ID NO: 3654 - RNA, 17 nt, Mus sp.
uccgcuguuucgggccc

SEQ ID NO: 3655 - RNA, 17 nt, Mus sp.
ccgcuguuucgggcccc

SEQ ID NO: 3656 - RNA, 17 nt, Mus sp.
cgcuguuucgggccccc

SEQ ID NO: 3657 - RNA, 17 nt, Mus sp.
ggcccccuuccaagagg

SEQ ID NO: 3658 - RNA, 17 nt, Mus sp.
gcccccuuccaagaggu

SEQ ID NO: 3659 - RNA, 17 nt, Mus sp.
caagagguaucagagca

SEQ ID NO: 3660 - RNA, 17 nt, Mus sp.
agagguaucagagcaga

SEQ ID NO: 3661 - RNA, 17 nt, Mus sp.
agggacguuuccuagac

SEQ ID NO: 3662 - RNA, 17 nt, Mus sp.
gggacguuuccuagacc

SEQ ID NO: 3663 - RNA, 17 nt, Mus sp.
ggacguuuccuagacca

SEQ ID NO: 3664 - RNA, 17 nt, Mus sp.
cguuuccuagaccaggg

SEQ ID NO: 3665 - RNA, 17 nt, Mus sp.
gcacauguucucgggaa

SEQ ID NO: 3666 - RNA, 17 nt, Mus sp.
cacauguucucgggaac

SEQ ID NO: 3667 - RNA, 17 nt, Mus sp.
cauguucucgggaacca

SEQ ID NO: 3668 - RNA, 17 nt, Mus sp.
accacaguuaaucuuaa

SEQ ID NO: 3669 - RNA, 17 nt, Mus sp.
ccacaguuaaucuuaaa

SEQ ID NO: 3670 - RNA, 17 nt, Mus sp.
caguuaaucuuaaaucu

SEQ ID NO: 3671 - RNA, 17 nt, Mus sp.
guuaaucuuaaaucuuu

SEQ ID NO: 3672 - RNA, 17 nt, Mus sp.
uuaaucuuaaaucuuuu

SEQ ID NO: 3673 - RNA, 17 nt, Mus sp.
ucuuaaaucuuuucccg

SEQ ID NO: 3674 - RNA, 17 nt, Mus sp.
uuaaaucuuuucccggg

SEQ ID NO: 3675 - RNA, 17 nt, Mus sp.
uaaaucuuuucccggga

SEQ ID NO: 3676 - RNA, 17 nt, Mus sp.
aaaucuuuucccgggag

SEQ ID NO: 3677 - RNA, 17 nt, Mus sp.
aaucuuuucccgggagu

SEQ ID NO: 3678 - RNA, 17 nt, Mus sp.
ccgggagucuucuguug

SEQ ID NO: 3679 - RNA, 17 nt, Mus sp.
gggagucuucuguuguc

SEQ ID NO: 3680 - RNA, 17 nt, Mus sp.
ggagucuucuguugucu

SEQ ID NO: 3681 - RNA, 17 nt, Mus sp.
ucuucuguugucuguuu

SEQ ID NO: 3682 - RNA, 17 nt, Mus sp.
ucuguugucuguuuacc

SEQ ID NO: 3683 - RNA, 17 nt, Mus sp.
uugucuguuuaccaucc

SEQ ID NO: 3684 - RNA, 17 nt, Mus sp.
ugucuguuuaccaucca

SEQ ID NO: 3685 - RNA, 17 nt, Mus sp.
gucuguuuaccauccaa

SEQ ID NO: 3686 - RNA, 17 nt, Mus sp.
uuuaccauccaaagcau

SEQ ID NO: 3687 - RNA, 17 nt, Mus sp.
caaagcauauuuaacau

SEQ ID NO: 3688 - RNA, 17 nt, Mus sp.
aagcauauuuaacaugu

SEQ ID NO: 3689 - RNA, 17 nt, Mus sp.
agcauauuuaacaugug

SEQ ID NO: 3690 - RNA, 17 nt, Mus sp.
gcauauuuaacaugugu

SEQ ID NO: 3691 - RNA, 17 nt, Mus sp.
acaugugucaguggggg

SEQ ID NO: 3692 - RNA, 17 nt, Mus sp.
guggcgcuuggcuucug

SEQ ID NO: 3693 - RNA, 17 nt, Mus sp.
gcuuggcuucugaggcc

SEQ ID NO: 3694 - RNA, 17 nt, Mus sp.
cuuggcuucugaggcca

SEQ ID NO: 3695 - RNA, 17 nt, Mus sp.
agagccaucaucaguuc

SEQ ID NO: 3696 - RNA, 17 nt, Mus sp.
gccaucaucaguuccuc

SEQ ID NO: 3697 - RNA, 17 nt, Mus sp.
ucaucaguuccucuagu

SEQ ID NO: 3698 - RNA, 17 nt, Mus sp.
caucaguuccucuagug

SEQ ID NO: 3699 - RNA, 17 nt, Mus sp.
caguuccucuagugaga

SEQ ID NO: 3700 - RNA, 17 nt, Mus sp.
guuccucuagugagaug

SEQ ID NO: 3701 - RNA, 17 nt, Mus sp.
agaugcauugaggucau

SEQ ID NO: 3702 - RNA, 17 nt, Mus sp.
auugaggucauacccaa

SEQ ID NO: 3703 - RNA, 17 nt, Mus sp.
gaggucauacccaagcu

SEQ ID NO: 3704 - RNA, 17 nt, Mus sp.
cccaagcuugcaggccu

SEQ ID NO: 3705 - RNA, 17 nt, Mus sp.
ccugaccuucgcauacu

SEQ ID NO: 3706 - RNA, 17 nt, Mus sp.
cugaccuucgcauacug

SEQ ID NO: 3707 - RNA, 17 nt, Mus sp.
cuucgcauacugcucac

SEQ ID NO: 3708 - RNA, 17 nt, Mus sp.
auacugcucacggggag

SEQ ID NO: 3709 - RNA, 17 nt, Mus sp.
cggggaguuaagugguc

SEQ ID NO: 3710 - RNA, 17 nt, Mus sp.
ggggaguuaaguggucc

SEQ ID NO: 3711 - RNA, 17 nt, Mus sp.
uaagugguccaguuugg

SEQ ID NO: 3712 - RNA, 17 nt, Mus sp.
gguccaguuuggccuag

SEQ ID NO: 3713 - RNA, 17 nt, Mus sp.
guccaguuuggccuagu

SEQ ID NO: 3714 - RNA, 17 nt, Mus sp.
uuuggccuaguaagguu

SEQ ID NO: 3715 - RNA, 17 nt, Mus sp.
ggccuaguaagguugcc

SEQ ID NO: 3716 - RNA, 17 nt, Mus sp.
aguaagguugccuacug

SEQ ID NO: 3717 - RNA, 17 nt, Mus sp.
gguugccuacugauggg

SEQ ID NO: 3718 - RNA, 17 nt, Mus sp.
gaugggcucaaaagcca

SEQ ID NO: 3719 - RNA, 17 nt, Mus sp.
agccacauuuuaaacag

SEQ ID NO: 3720 - RNA, 17 nt, Mus sp.
gccacauuuuaaacagg

SEQ ID NO: 3721 - RNA, 17 nt, Mus sp.
ccacauuuuaaacaggu

SEQ ID NO: 3722 - RNA, 17 nt, Mus sp.
cacauuuuaaacagguu

SEQ ID NO: 3723 - RNA, 17 nt, Mus sp.
aaacagguuuuaucuca

SEQ ID NO: 3724 - RNA, 17 nt, Mus sp.
aacagguuuuaucucaa

SEQ ID NO: 3725 - RNA, 17 nt, Mus sp.
acagguuuuaucucaag

SEQ ID NO: 3726 - RNA, 17 nt, Mus sp.
cagguuuuaucucaagu

SEQ ID NO: 3727 - RNA, 17 nt, Mus sp.
gguuuuaucucaaguau

SEQ ID NO: 3728 - RNA, 17 nt, Mus sp.
uuuuaucucaaguauua

SEQ ID NO: 3729 - RNA, 17 nt, Mus sp.
ucucaaguauuaauaua

SEQ ID NO: 3730 - RNA, 17 nt, Mus sp.
ucaaguauuaauauaua

SEQ ID NO: 3731 - RNA, 17 nt, Mus sp.
caaguauuaauauauag

SEQ ID NO: 3732 - RNA, 17 nt, Mus sp.
guauuaauauauagaca

SEQ ID NO: 3733 - RNA, 17 nt, Mus sp.
auuaauauauagacaag

SEQ ID NO: 3734 - RNA, 17 nt, Mus sp.
uaauauauagacaagac

SEQ ID NO: 3735 - RNA, 17 nt, Mus sp.
aagacacuuaugcauua

SEQ ID NO: 3736 - RNA, 17 nt, Mus sp.
agacacuuaugcauuau

SEQ ID NO: 3737 - RNA, 17 nt, Mus sp.
uuaugcauuauccuguu

SEQ ID NO: 3738 - RNA, 17 nt, Mus sp.
uaugcauuauccuguuu

SEQ ID NO: 3739 - RNA, 17 nt, Mus sp.
ugcauuauccuguuuua

SEQ ID NO: 3740 - RNA, 17 nt, Mus sp.
uauccuguuuuauauau

SEQ ID NO: 3741 - RNA, 17 nt, Mus sp.
auccuguuuuauauauc

SEQ ID NO: 3742 - RNA, 17 nt, Mus sp.
uccuguuuuauauaucc

SEQ ID NO: 3743 - RNA, 17 nt, Mus sp.
ccuguuuuauauaucca

SEQ ID NO: 3744 - RNA, 17 nt, Mus sp.
uguuuuauauauccaau

SEQ ID NO: 3745 - RNA, 17 nt, Mus sp.
uuuuauauauccaauga

SEQ ID NO: 3746 - RNA, 17 nt, Mus sp.
uuauauauccaaugaau

SEQ ID NO: 3747 - RNA, 17 nt, Mus sp.
caaugaauauaacuggg

SEQ ID NO: 3748 - RNA, 17 nt, Mus sp.
augaauauaacuggggc

SEQ ID NO: 3749 - RNA, 17 nt, Mus sp.
gggcgaguuaagaguca

SEQ ID NO: 3750 - RNA, 17 nt, Mus sp.
ggcgaguuaagagucau

SEQ ID NO: 3751 - RNA, 17 nt, Mus sp.
uuaagagucauggucua

SEQ ID NO: 3752 - RNA, 17 nt, Mus sp.
gucauggucuagaaaag

SEQ ID NO: 3753 - RNA, 17 nt, Mus sp.
cauggucuagaaaaggg

SEQ ID NO: 3754 - RNA, 17 nt, Mus sp.
aaagggguuucucugua

SEQ ID NO: 3755 - RNA, 17 nt, Mus sp.
aagggguuucucuguac

SEQ ID NO: 3756 - RNA, 17 nt, Mus sp.
agggguuucucuguacc

SEQ ID NO: 3757 - RNA, 17 nt, Mus sp.
ggguuucucuguaccca

SEQ ID NO: 3758 - RNA, 17 nt, Mus sp.
uucucuguacccaaauc

SEQ ID NO: 3759 - RNA, 17 nt, Mus sp.
acccaaaucgggcuggu

SEQ ID NO: 3760 - RNA, 17 nt, Mus sp.
gggcugguuggaccaag

SEQ ID NO: 3761 - RNA, 17 nt, Mus sp.
agagugguugucccagc

SEQ ID NO: 3762 - RNA, 17 nt, Mus sp.
gugguugucccagcuau

SEQ ID NO: 3763 - RNA, 17 nt, Mus sp.
ucccagcuauaguuacu

SEQ ID NO: 3764 - RNA, 17 nt, Mus sp.
ccagcuauaguuacuaa

SEQ ID NO: 3765 - RNA, 17 nt, Mus sp.
gcuauaguuacuaaacu

SEQ ID NO: 3766 - RNA, 17 nt, Mus sp.
cuauaguuacuaaacua

SEQ ID NO: 3767 - RNA, 17 nt, Mus sp.
uaguuacuaaacuacuc

SEQ ID NO: 3768 - RNA, 17 nt, Mus sp.
acuaaacuacucaccca

SEQ ID NO: 3769 - RNA, 17 nt, Mus sp.
aaacuacucacccaaag

SEQ ID NO: 3770 - RNA, 17 nt, Mus sp.
cccaaaguugggaccuc

SEQ ID NO: 3771 - RNA, 17 nt, Mus sp.
ugggaccucacuggcuu

SEQ ID NO: 3772 - RNA, 17 nt, Mus sp.
cacuggcuucucuuuac

SEQ ID NO: 3773 - RNA, 17 nt, Mus sp.
acuggcuucucuuuacu

SEQ ID NO: 3774 - RNA, 17 nt, Mus sp.
uggcuucucuuuacuuc

SEQ ID NO: 3775 - RNA, 17 nt, Mus sp.
gcuucucuuuacuucau

SEQ ID NO: 3776 - RNA, 17 nt, Mus sp.
cuucucuuuacuucauc

SEQ ID NO: 3777 - RNA, 17 nt, Mus sp.
uucucuuuacuucauca

SEQ ID NO: 3778 - RNA, 17 nt, Mus sp.
ucuuuacuucaucaugg

SEQ ID NO: 3779 - RNA, 17 nt, Mus sp.
cuuuacuucaucaugga

SEQ ID NO: 3780 - RNA, 17 nt, Mus sp.
uacuucaucauggauuu

SEQ ID NO: 3781 - RNA, 17 nt, Mus sp.
ucauggauuucaccauc

SEQ ID NO: 3782 - RNA, 17 nt, Mus sp.
cauggauuucaccaucc

SEQ ID NO: 3783 - RNA, 17 nt, Mus sp.
auggauuucaccauccc

SEQ ID NO: 3784 - RNA, 17 nt, Mus sp.
uucaccaucccaaggca

SEQ ID NO: 3785 - RNA, 17 nt, Mus sp.
aaggcagucugagagga

SEQ ID NO: 3786 - RNA, 17 nt, Mus sp.
gaggagcuaaagaguau

SEQ ID NO: 3787 - RNA, 17 nt, Mus sp.
uaaagaguaucagccca

SEQ ID NO: 3788 - RNA, 17 nt, Mus sp.
aagaguaucagcccaua

SEQ ID NO: 3789 - RNA, 17 nt, Mus sp.
cagcccauauuuauuaa

SEQ ID NO: 3790 - RNA, 17 nt, Mus sp.
gcccauauuuauuaagc

SEQ ID NO: 3791 - RNA, 17 nt, Mus sp.
cccauauuuauuaagca

SEQ ID NO: 3792 - RNA, 17 nt, Mus sp.
ccauauuuauuaagcac

SEQ ID NO: 3793 - RNA, 17 nt, Mus sp.
auauuuauuaagcacuu

SEQ ID NO: 3794 - RNA, 17 nt, Mus sp.
uauuuauuaagcacuuu

SEQ ID NO: 3795 - RNA, 17 nt, Mus sp.
uaagcacuuuaugcucc

SEQ ID NO: 3796 - RNA, 17 nt, Mus sp.
aagcacuuuaugcuccu

SEQ ID NO: 3797 - RNA, 17 nt, Mus sp.
agcacuuuaugcuccuu

SEQ ID NO: 3798 - RNA, 17 nt, Mus sp.
uuuaugcuccuuggcac

SEQ ID NO: 3799 - RNA, 17 nt, Mus sp.
augcuccuuggcacagc

SEQ ID NO: 3800 - RNA, 17 nt, Mus sp.
ugauguguaauuuaugc

SEQ ID NO: 3801 - RNA, 17 nt, Mus sp.
uguguaauuuaugcaag

SEQ ID NO: 3802 - RNA, 17 nt, Mus sp.
guguaauuuaugcaagc

SEQ ID NO: 3803 - RNA, 17 nt, Mus sp.
uguaauuuaugcaagcu

SEQ ID NO: 3804 - RNA, 17 nt, Mus sp.
ugcaagcucccucucca

SEQ ID NO: 3805 - RNA, 17 nt, Mus sp.
agcucccucuccagcua

SEQ ID NO: 3806 - RNA, 17 nt, Mus sp.
cucccucuccagcuagg

SEQ ID NO: 3807 - RNA, 17 nt, Mus sp.
cuccagcuaggacucag

SEQ ID NO: 3808 - RNA, 17 nt, Mus sp.
cuaggacucaggauauu

SEQ ID NO: 3809 - RNA, 17 nt, Mus sp.
cucaggauauuagucaa

SEQ ID NO: 3810 - RNA, 17 nt, Mus sp.
caggauauuagucaaug

SEQ ID NO: 3811 - RNA, 17 nt, Mus sp.
aggauauuagucaauga

SEQ ID NO: 3812 - RNA, 17 nt, Mus sp.
auauuagucaaugagcc

SEQ ID NO: 3813 - RNA, 17 nt, Mus sp.
ugagccaucaaaaggaa

SEQ ID NO: 3814 - RNA, 17 nt, Mus sp.
aaaaaccuaucuuauuu

SEQ ID NO: 3815 - RNA, 17 nt, Mus sp.
aaaccuaucuuauuuuc

SEQ ID NO: 3816 - RNA, 17 nt, Mus sp.
accuaucuuauuuucau

SEQ ID NO: 3817 - RNA, 17 nt, Mus sp.
ccuaucuuauuuucauc

SEQ ID NO: 3818 - RNA, 17 nt, Mus sp.
uaucuuauuuucaucug

SEQ ID NO: 3819 - RNA, 17 nt, Mus sp.
aucuuauuuucaucugu

SEQ ID NO: 3820 - RNA, 17 nt, Mus sp.
ucuuauuuucaucuguu

SEQ ID NO: 3821 - RNA, 17 nt, Mus sp.
cuuauuuucaucuguuu

SEQ ID NO: 3822 - RNA, 17 nt, Mus sp.
auuuucaucuguuucau

SEQ ID NO: 3823 - RNA, 17 nt, Mus sp.
ucaucuguuucauaccu

SEQ ID NO: 3824 - RNA, 17 nt, Mus sp.
caucuguuucauaccuu

SEQ ID NO: 3825 - RNA, 17 nt, Mus sp.
aucuguuucauaccuug

SEQ ID NO: 3826 - RNA, 17 nt, Mus sp.
uguuucauaccuugucu

SEQ ID NO: 3827 - RNA, 17 nt, Mus sp.
ucauaccuugucugggg

SEQ ID NO: 3828 - RNA, 17 nt, Mus sp.
uaccuugucuggggucu

SEQ ID NO: 3829 - RNA, 17 nt, Mus sp.
ucuggggucuaaugacg

SEQ ID NO: 3830 - RNA, 17 nt, Mus sp.
uggggucuaaugacgau

SEQ ID NO: 3831 - RNA, 17 nt, Mus sp.
aacaggguagacauggg

SEQ ID NO: 3832 - RNA, 17 nt, Mus sp.
gacaggguagaaaaggg

SEQ ID NO: 3833 - RNA, 17 nt, Mus sp.
ugcccgcucuuuggggu

SEQ ID NO: 3834 - RNA, 17 nt, Mus sp.
cccgcucuuuggggucu

SEQ ID NO: 3835 - RNA, 17 nt, Mus sp.
ccgcucuuuggggucua

SEQ ID NO: 3836 - RNA, 17 nt, Mus sp.
uuuggggucuagagaug

SEQ ID NO: 3837 - RNA, 17 nt, Mus sp.
uggggucuagagaugag

SEQ ID NO: 3838 - RNA, 17 nt, Mus sp.
cccugggucucuaaaau

SEQ ID NO: 3839 - RNA, 17 nt, Mus sp.
cugggucucuaaaaugg

SEQ ID NO: 3840 - RNA, 17 nt, Mus sp.
gggucucuaaaauggcu

SEQ ID NO: 3841 - RNA, 17 nt, Mus sp.
aaauggcucucuuagaa

SEQ ID NO: 3842 - RNA, 17 nt, Mus sp.
auggcucucuuagaagu

SEQ ID NO: 3843 - RNA, 17 nt, Mus sp.
ggcucucuuagaaguug

SEQ ID NO: 3844 - RNA, 17 nt, Mus sp.
gcucucuuagaaguugu

SEQ ID NO: 3845 - RNA, 17 nt, Mus sp.
uuagaaguuguaugugc

SEQ ID NO: 3846 - RNA, 17 nt, Mus sp.
gaaguuguaugugcaaa

SEQ ID NO: 3847 - RNA, 17 nt, Mus sp.
gugcaaauuauggucug

SEQ ID NO: 3848 - RNA, 17 nt, Mus sp.
ugcaaauuauggucugu

SEQ ID NO: 3849 - RNA, 17 nt, Mus sp.
auuauggucugugugcu

SEQ ID NO: 3850 - RNA, 17 nt, Mus sp.
ugugugcuuaggucgug

SEQ ID NO: 3851 - RNA, 17 nt, Mus sp.
gugugcuuaggucgugc

SEQ ID NO: 3852 - RNA, 17 nt, Mus sp.
gcuuaggucgugcacac

SEQ ID NO: 3853 - RNA, 17 nt, Mus sp.
gagccggucacagcugg

SEQ ID NO: 3854 - RNA, 17 nt, Mus sp.
cgaugaauagcugcuuu

SEQ ID NO: 3855 - RNA, 17 nt, Mus sp.
uagcugcuuugggagag

SEQ ID NO: 3856 - RNA, 17 nt, Mus sp.
agcugcuuugggagagc

SEQ ID NO: 3857 - RNA, 17 nt, Mus sp.
agcaugcuagccacuua

SEQ ID NO: 3858 - RNA, 17 nt, Mus sp.
uagccacuuaauucucu

SEQ ID NO: 3859 - RNA, 17 nt, Mus sp.
agccacuuaauucucug

SEQ ID NO: 3860 - RNA, 17 nt, Mus sp.
cacuuaauucucugacc

SEQ ID NO: 3861 - RNA, 17 nt, Mus sp.
acuuaauucucugaccg

SEQ ID NO: 3862 - RNA, 17 nt, Mus sp.
uuaauucucugaccggg

SEQ ID NO: 3863 - RNA, 17 nt, Mus sp.
gccagcaucauggguac

SEQ ID NO: 3864 - RNA, 17 nt, Mus sp.
ucauggguaccugcucc

SEQ ID NO: 3865 - RNA, 17 nt, Mus sp.
uaccugcuccccugugu

SEQ ID NO: 3866 - RNA, 17 nt, Mus sp.
cccuguguaccccaucc

SEQ ID NO: 3867 - RNA, 17 nt, Mus sp.
uaccccauccuuaaggu

SEQ ID NO: 3868 - RNA, 17 nt, Mus sp.
cccauccuuaagguuuu

SEQ ID NO: 3869 - RNA, 17 nt, Mus sp.
ccauccuuaagguuuuc

SEQ ID NO: 3870 - RNA, 17 nt, Mus sp.
cuuaagguuuucugucu

SEQ ID NO: 3871 - RNA, 17 nt, Mus sp.
uuaagguuuucugucug

SEQ ID NO: 3872 - RNA, 17 nt, Mus sp.
uaagguuuucugucuga

SEQ ID NO: 3873 - RNA, 17 nt, Mus sp.
aagguuuucugucugau

SEQ ID NO: 3874 - RNA, 17 nt, Mus sp.
uuuucugucugaugaga

SEQ ID NO: 3875 - RNA, 17 nt, Mus sp.
agugcaauccccacuga

SEQ ID NO: 3876 - RNA, 17 nt, Mus sp.
cuguggcucuuggugca

SEQ ID NO: 3877 - RNA, 17 nt, Mus sp.
guggcucuuggugcacu

SEQ ID NO: 3878 - RNA, 17 nt, Mus sp.
ggugcacucaccagcca

SEQ ID NO: 3879 - RNA, 17 nt, Mus sp.
ccaggacuagacaagua

SEQ ID NO: 3880 - RNA, 17 nt, Mus sp.
agacaaguaggaaaggg

SEQ ID NO: 3881 - RNA, 17 nt, Mus sp.
aaagggcuucuagccac

SEQ ID NO: 3882 - RNA, 17 nt, Mus sp.
aagggcuucuagccaca

SEQ ID NO: 3883 - RNA, 17 nt, Mus sp.
gggcuucuagccacacu

SEQ ID NO: 3884 - RNA, 17 nt, Mus sp.
aagaaaaucagguaggg

SEQ ID NO: 3885 - RNA, 17 nt, Mus sp.
aaucagguagggcuggc

SEQ ID NO: 3886 - RNA, 17 nt, Mus sp.
aaagacaucuuugucca

SEQ ID NO: 3887 - RNA, 17 nt, Mus sp.
agacaucuuuguccauu

SEQ ID NO: 3888 - RNA, 17 nt, Mus sp.
gacaucuuuguccauuc

SEQ ID NO: 3889 - RNA, 17 nt, Mus sp.
aucuuuguccauucgca

SEQ ID NO: 3890 - RNA, 17 nt, Mus sp.
uuguccauucgcaaaag

SEQ ID NO: 3891 - RNA, 17 nt, Mus sp.
uguccauucgcaaaagc

SEQ ID NO: 3892 - RNA, 17 nt, Mus sp.
caaaagcucuugucggc

SEQ ID NO: 3893 - RNA, 17 nt, Mus sp.
aaagcucuugucggcug

SEQ ID NO: 3894 - RNA, 17 nt, Mus sp.
gcucuugucggcugcag

SEQ ID NO: 3895 - RNA, 17 nt, Mus sp.
caguguguaagucaggc

SEQ ID NO: 3896 - RNA, 17 nt, Mus sp.
guguaagucaggcgaug

SEQ ID NO: 3897 - RNA, 17 nt, Mus sp.
cagaggcuaccagagaa

SEQ ID NO: 3898 - RNA, 17 nt, Mus sp.
ccugagguuucucaucc

SEQ ID NO: 3899 - RNA, 17 nt, Mus sp.
cugagguuucucaucca

SEQ ID NO: 3900 - RNA, 17 nt, Mus sp.
ugagguuucucauccag

SEQ ID NO: 3901 - RNA, 17 nt, Mus sp.
agguuucucauccagau

SEQ ID NO: 3902 - RNA, 17 nt, Mus sp.
uuucucauccagauauc

SEQ ID NO: 3903 - RNA, 17 nt, Mus sp.
auccagauauccagcaa

SEQ ID NO: 3904 - RNA, 17 nt, Mus sp.
ccagauauccagcaauu

SEQ ID NO: 3905 - RNA, 17 nt, Mus sp.
ccagcaauuggggggug

SEQ ID NO: 3906 - RNA, 17 nt, Mus sp.
aagaccauagauggucc

SEQ ID NO: 3907 - RNA, 17 nt, Mus sp.
uagaugguccuguauua

SEQ ID NO: 3908 - RNA, 17 nt, Mus sp.
gguccuguauuauuccg

SEQ ID NO: 3909 - RNA, 17 nt, Mus sp.
uccuguauuauuccgau

SEQ ID NO: 3910 - RNA, 17 nt, Mus sp.
ccuguauuauuccgauu

SEQ ID NO: 3911 - RNA, 17 nt, Mus sp.
uguauuauuccgauuuu

SEQ ID NO: 3912 - RNA, 17 nt, Mus sp.
guauuauuccgauuuua

SEQ ID NO: 3913 - RNA, 17 nt, Mus sp.
auuccgauuuuaauaau

SEQ ID NO: 3914 - RNA, 17 nt, Mus sp.
uuccgauuuuaauaauc

SEQ ID NO: 3915 - RNA, 17 nt, Mus sp.
uccgauuuuaauaaucu

SEQ ID NO: 3916 - RNA, 17 nt, Mus sp.
ccgauuuuaauaaucua

SEQ ID NO: 3917 - RNA, 17 nt, Mus sp.
auuuuaauaaucuaauu

SEQ ID NO: 3918 - RNA, 17 nt, Mus sp.
uuaauaaucuaauucgu

SEQ ID NO: 3919 - RNA, 17 nt, Mus sp.
aauaaucuaauucguga

SEQ ID NO: 3920 - RNA, 17 nt, Mus sp.
aaucuaauucgugauca

SEQ ID NO: 3921 - RNA, 17 nt, Mus sp.
aucuaauucgugaucau

SEQ ID NO: 3922 - RNA, 17 nt, Mus sp.
uucgugaucauuaagag

SEQ ID NO: 3923 - RNA, 17 nt, Mus sp.
gugaucauuaagagacu

SEQ ID NO: 3924 - RNA, 17 nt, Mus sp.
ugaucauuaagagacuu

SEQ ID NO: 3925 - RNA, 17 nt, Mus sp.
aagagacuuuaguaaau

SEQ ID NO: 3926 - RNA, 17 nt, Mus sp.
agagacuuuaguaaaug

SEQ ID NO: 3927 - RNA, 17 nt, Mus sp.
gagacuuuaguaaaugu

SEQ ID NO: 3928 - RNA, 17 nt, Mus sp.
acuuuaguaaauguccc

SEQ ID NO: 3929 - RNA, 17 nt, Mus sp.
guaaaugucccuuuucc

SEQ ID NO: 3930 - RNA, 17 nt, Mus sp.
augucccuuuucccaca

SEQ ID NO: 3931 - RNA, 17 nt, Mus sp.
ugucccuuuucccacaa

SEQ ID NO: 3932 - RNA, 17 nt, Mus sp.
gucccuuuucccacaaa

SEQ ID NO: 3933 - RNA, 17 nt, Mus sp.
ucccuuuucccacaaaa

SEQ ID NO: 3934 - RNA, 17 nt, Mus sp.
acaaaaguaaagaaaag

SEQ ID NO: 3935 - RNA, 17 nt, Mus sp.
gaaaagcuaucgggauu

SEQ ID NO: 3936 - RNA, 17 nt, Mus sp.
aaagcuaucgggauucu

SEQ ID NO: 3937 - RNA, 17 nt, Mus sp.
aucgggauucucugguu

SEQ ID NO: 3938 - RNA, 17 nt, Mus sp.
ucgggauucucugguuc

SEQ ID NO: 3939 - RNA, 17 nt, Mus sp.
gggauucucugguucug

SEQ ID NO: 3940 - RNA, 17 nt, Mus sp.
ucucugguucugcuuaa

SEQ ID NO: 3941 - RNA, 17 nt, Mus sp.
cucugguucugcuuaaa

SEQ ID NO: 3942 - RNA, 17 nt, Mus sp.
guucugcuuaaagacuu

SEQ ID NO: 3943 - RNA, 17 nt, Mus sp.
uucugcuuaaagacuua

SEQ ID NO: 3944 - RNA, 17 nt, Mus sp.
uaaagacuuagcuuugg

SEQ ID NO: 3945 - RNA, 17 nt, Mus sp.
aaagacuuagcuuugga

SEQ ID NO: 3946 - RNA, 17 nt, Mus sp.
acuuagcuuuggagccu

SEQ ID NO: 3947 - RNA, 17 nt, Mus sp.
cuuagcuuuggagccua

SEQ ID NO: 3948 - RNA, 17 nt, Mus sp.
uggagccuaugaaaguu

SEQ ID NO: 3949 - RNA, 17 nt, Mus sp.
augaaaguugaucagcc

SEQ ID NO: 3950 - RNA, 18 nt, Mus sp.
auggucagcugcugggac

SEQ ID NO: 3951 - RNA, 18 nt, Mus sp.
gucagcugcugggacacc

SEQ ID NO: 3952 - RNA, 18 nt, Mus sp.
caccgcggucuugccuua

SEQ ID NO: 3953 - RNA, 18 nt, Mus sp.
acgcgcugcucggguguc

SEQ ID NO: 3954 - RNA, 18 nt, Mus sp.
ggugucugcuucucacag

SEQ ID NO: 3955 - RNA, 18 nt, Mus sp.
caggccagacucucuuuc

SEQ ID NO: 3956 - RNA, 18 nt, Mus sp.
ggaggcagcccacucaug

SEQ ID NO: 3957 - RNA, 18 nt, Mus sp.
ggucucugcccacgaccg

SEQ ID NO: 3958 - RNA, 18 nt, Mus sp.
cccaucggccugugggag

SEQ ID NO: 3959 - RNA, 18 nt, Mus sp.
gaagacagcucaucaucc

SEQ ID NO: 3960 - RNA, 18 nt, Mus sp.
auccccugccgggugacg

SEQ ID NO: 3961 - RNA, 18 nt, Mus sp.
uaccccugaugggcaaag

SEQ ID NO: 3962 - RNA, 18 nt, Mus sp.
uaggacugcugaacugcg

SEQ ID NO: 3963 - RNA, 18 nt, Mus sp.
acuaucugacccaucggc

SEQ ID NO: 3964 - RNA, 18 nt, Mus sp.
aucggcagaccaauacaa

SEQ ID NO: 3965 - RNA, 18 nt, Mus sp.
uacgcccgccgagcccag

SEQ ID NO: 3966 - RNA, 18 nt, Mus sp.
ugagacugcuccacgggc

SEQ ID NO: 3967 - RNA, 18 nt, Mus sp.
acgggcagacucuugucc

SEQ ID NO: 3968 - RNA, 18 nt, Mus sp.
ggcagcggauugaccgga

SEQ ID NO: 3969 - RNA, 18 nt, Mus sp.
uacaccugucgcgugaag

SEQ ID NO: 3970 - RNA, 18 nt, Mus sp.
cguuccagucuuucaaca

SEQ ID NO: 3971 - RNA, 18 nt, Mus sp.
ggaagcagccggugcagg

SEQ ID NO: 3972 - RNA, 18 nt, Mus sp.
gaagacgguccuaucggc

SEQ ID NO: 3973 - RNA, 18 nt, Mus sp.
ccuaucggcuguccauga

SEQ ID NO: 3974 - RNA, 18 nt, Mus sp.
aucggcuguccaugaaag

SEQ ID NO: 3975 - RNA, 18 nt, Mus sp.
gaagucugcucgcuauuu

SEQ ID NO: 3976 - RNA, 18 nt, Mus sp.
aaccucagaucuacgaaa

SEQ ID NO: 3977 - RNA, 18 nt, Mus sp.
ucuauccgcugggcagca

SEQ ID NO: 3978 - RNA, 18 nt, Mus sp.
gguggcugacucucagac

SEQ ID NO: 3979 - RNA, 18 nt, Mus sp.
acucucagaccccuggaa

SEQ ID NO: 3980 - RNA, 18 nt, Mus sp.
aucuacagcugccgggcc

SEQ ID NO: 3981 - RNA, 18 nt, Mus sp.
uacagcugccgggccuuc

SEQ ID NO: 3982 - RNA, 18 nt, Mus sp.
ugucacagaugugccgaa

SEQ ID NO: 3983 - RNA, 18 nt, Mus sp.
gaugccagccgaaggaga

SEQ ID NO: 3984 - RNA, 18 nt, Mus sp.
ugaaacuguccugugugg

SEQ ID NO: 3985 - RNA, 18 nt, Mus sp.
cacaccugcuucaaaacc

SEQ ID NO: 3986 - RNA, 18 nt, Mus sp.
cgccucagaucacuuggu

SEQ ID NO: 3987 - RNA, 18 nt, Mus sp.
aagcgcagccuaccucac

SEQ ID NO: 3988 - RNA, 18 nt, Mus sp.
uggagcugaucacgcuca

SEQ ID NO: 3989 - RNA, 18 nt, Mus sp.
ugaagcggucuucuuccg

SEQ ID NO: 3990 - RNA, 18 nt, Mus sp.
aaagacagacuaccuguc

SEQ ID NO: 3991 - RNA, 18 nt, Mus sp.
gugaacggcugcccuaug

SEQ ID NO: 3992 - RNA, 18 nt, Mus sp.
aacggcugcccuaugaug

SEQ ID NO: 3993 - RNA, 18 nt, Mus sp.
cccaccugccggacugug

SEQ ID NO: 3994 - RNA, 18 nt, Mus sp.
ccugccggacuguggcug

SEQ ID NO: 3995 - RNA, 18 nt, Mus sp.
aagcucugaugaccgaac

SEQ ID NO: 3996 - RNA, 18 nt, Mus sp.
ggccucugauggugaucg

SEQ ID NO: 3997 - RNA, 18 nt, Mus sp.
gaaaccuguccaacuacc

SEQ ID NO: 3998 - RNA, 18 nt, Mus sp.
uuauucugucucaacaag

SEQ ID NO: 3999 - RNA, 18 nt, Mus sp.
ggacgcagccuugcauau

SEQ ID NO: 4000 - RNA, 18 nt, Mus sp.
aagccccgccuagacagu

SEQ ID NO: 4001 - RNA, 18 nt, Mus sp.
gucagcagcucaaguguc

SEQ ID NO: 4002 - RNA, 18 nt, Mus sp.
gucaccagcuccagcuuc

SEQ ID NO: 4003 - RNA, 18 nt, Mus sp.
agcuccagcuucccugaa

SEQ ID NO: 4004 - RNA, 18 nt, Mus sp.
ccaagcagccccucacca

SEQ ID NO: 4005 - RNA, 18 nt, Mus sp.
aagaccugauuuccuaca

SEQ ID NO: 4006 - RNA, 18 nt, Mus sp.
uccuacaguuuccaagug

SEQ ID NO: 4007 - RNA, 18 nt, Mus sp.
aguuucuguccuccagaa

SEQ ID NO: 4008 - RNA, 18 nt, Mus sp.
gaacccugauuaugugag

SEQ ID NO: 4009 - RNA, 18 nt, Mus sp.
uucugcagccgccugaag

SEQ ID NO: 4010 - RNA, 18 nt, Mus sp.
ugcagccgccugaaggaa

SEQ ID NO: 4011 - RNA, 18 nt, Mus sp.
gcaugcggaugagaaccc

SEQ ID NO: 4012 - RNA, 18 nt, Mus sp.
ggccccgguuugcugaac

SEQ ID NO: 4013 - RNA, 18 nt, Mus sp.
gugaccugcuucaagcca

SEQ ID NO: 4014 - RNA, 18 nt, Mus sp.
ccauacugacuagaaaca

SEQ ID NO: 4015 - RNA, 18 nt, Mus sp.
aaggacggcuuugcagau

SEQ ID NO: 4016 - RNA, 18 nt, Mus sp.
cuuugcagauccacauuu

SEQ ID NO: 4017 - RNA, 18 nt, Mus sp.
aagcucugaugaugugag

SEQ ID NO: 4018 - RNA, 18 nt, Mus sp.
acuaucagcuggacacua

SEQ ID NO: 4019 - RNA, 18 nt, Mus sp.
gcacucugcugggcuccc

SEQ ID NO: 4020 - RNA, 18 nt, Mus sp.
ugaagcgguucaccugga

SEQ ID NO: 4021 - RNA, 18 nt, Mus sp.
acuuuccgaucugccgag

SEQ ID NO: 4022 - RNA, 18 nt, Mus sp.
ccgaucugccgaggccca

SEQ ID NO: 4023 - RNA, 18 nt, Mus sp.
aggcccagcuucugcuuc

SEQ ID NO: 4024 - RNA, 18 nt, Mus sp.
agcuucugcuucuccagc

SEQ ID NO: 4025 - RNA, 18 nt, Mus sp.
uucuccagcuguggccac

SEQ ID NO: 4026 - RNA, 18 nt, Mus sp.
gaguccugcuguucucca

SEQ ID NO: 4027 - RNA, 18 nt, Mus sp.
uccugcuguucuccaccc

SEQ ID NO: 4028 - RNA, 18 nt, Mus sp.
acccccagacuacaacuc

SEQ ID NO: 4029 - RNA, 18 nt, Mus sp.
ccuccccgcccgccuaaa

SEQ ID NO: 4030 - RNA, 18 nt, Mus sp.
cccgcccgccuaaagcuu

SEQ ID NO: 4031 - RNA, 18 nt, Mus sp.
cucaccagccccgacaac

SEQ ID NO: 4032 - RNA, 18 nt, Mus sp.
acaaccagccccugacag

SEQ ID NO: 4033 - RNA, 18 nt, Mus sp.
cuauuccgcuccacagga

SEQ ID NO: 4034 - RNA, 18 nt, Mus sp.
ggagccagcugcuuuucg

SEQ ID NO: 4035 - RNA, 18 nt, Mus sp.
gccagcugcuuuucguga

SEQ ID NO: 4036 - RNA, 18 nt, Mus sp.
uguugcuguuuugacuaa

SEQ ID NO: 4037 - RNA, 18 nt, Mus sp.
ggcgaccgcccgcccacc

SEQ ID NO: 4038 - RNA, 18 nt, Mus sp.
accgcccgcccaccggcc

SEQ ID NO: 4039 - RNA, 18 nt, Mus sp.
cccugcagcugugggacu

SEQ ID NO: 4040 - RNA, 18 nt, Mus sp.
augcacugaccugcucug

SEQ ID NO: 4041 - RNA, 18 nt, Mus sp.
cugaccugcucugucucu

SEQ ID NO: 4042 - RNA, 18 nt, Mus sp.
cugcucugucucucuuau

SEQ ID NO: 4043 - RNA, 18 nt, Mus sp.
ugcguccguccuguggag

SEQ ID NO: 4044 - RNA, 18 nt, Mus sp.
ggccuccgcuguuucggg

SEQ ID NO: 4045 - RNA, 18 nt, Mus sp.
cuccgcuguuucgggccc

SEQ ID NO: 4046 - RNA, 18 nt, Mus sp.
gucuucuguugucuguuu

SEQ ID NO: 4047 - RNA, 18 nt, Mus sp.
guugucuguuuaccaucc

SEQ ID NO: 4048 - RNA, 18 nt, Mus sp.
aucaucaguuccucuagu

SEQ ID NO: 4049 - RNA, 18 nt, Mus sp.
caggccugaccuucgcau

SEQ ID NO: 4050 - RNA, 18 nt, Mus sp.
gcauacugcucacgggga

SEQ ID NO: 4051 - RNA, 18 nt, Mus sp.
ugguccaguuuggccuag

SEQ ID NO: 4052 - RNA, 18 nt, Mus sp.
gccuacugaugggcucaa

SEQ ID NO: 4053 - RNA, 18 nt, Mus sp.
uuauccuguuuuauauau

SEQ ID NO: 4054 - RNA, 18 nt, Mus sp.
caaggcagucugagagga

SEQ ID NO: 4055 - RNA, 18 nt, Mus sp.
aguaucagcccauauuua

SEQ ID NO: 4056 - RNA, 18 nt, Mus sp.
uucaucuguuucauaccu

SEQ ID NO: 4057 - RNA, 18 nt, Mus sp.
ggugcccgcucuuugggg

SEQ ID NO: 4058 - RNA, 18 nt, Mus sp.
cacaccugccggagccgg

SEQ ID NO: 4059 - RNA, 18 nt, Mus sp.
ggucacagcugggcagac

SEQ ID NO: 4060 - RNA, 18 nt, Mus sp.
cugggcagacgaugaaua

SEQ ID NO: 4061 - RNA, 18 nt, Mus sp.
aauagcugcuuugggaga

SEQ ID NO: 4062 - RNA, 18 nt, Mus sp.
auucucugaccgggccag

SEQ ID NO: 4063 - RNA, 18 nt, Mus sp.
gguaccugcuccccugug

SEQ ID NO: 4064 - RNA, 18 nt, Mus sp.
guuuucugucugaugaga

SEQ ID NO: 4065 - RNA, 18 nt, Mus sp.
ucugucugaugagacugg

SEQ ID NO: 4066 - RNA, 18 nt, Mus sp.
ugagacagccugcagccc

SEQ ID NO: 4067 - RNA, 18 nt, Mus sp.
gccugcagcccacugugg

SEQ ID NO: 4068 - RNA, 18 nt, Mus sp.
cuugucggcugcagugug

SEQ ID NO: 4069 - RNA, 18 nt, Mus sp.
agaaacggaugagaacag

SEQ ID NO: 4070 - RNA, 18 nt, Mus sp.
aacagcagccugagguuu

SEQ ID NO: 4071 - RNA, 18 nt, Mus sp.
uuauuccgauuuuaauaa

SEQ ID NO: 4072 - RNA, 18 nt, Mus sp.
ugguucugcuuaaagacu

SEQ ID NO: 4073 - RNA, 15 nt, Homo sapiens
ccgggauauuuauaa

SEQ ID NO: 4074 - RNA, 15 nt, Homo sapiens
aauguauacacaggg

SEQ ID NO: 4075 - RNA, 15 nt, Homo sapiens
ugcaaauauggaaau

SEQ ID NO: 4076 - RNA, 15 nt, Homo sapiens
cucccuuaugaugcc

SEQ ID NO: 4077 - RNA, 15 nt, Homo sapiens
guugaauacugcaaa

SEQ ID NO: 4078 - RNA, 15 nt, Homo sapiens
uaugguuaaaagaug

SEQ ID NO: 4079 - RNA, 15 nt, Homo sapiens
gggauauuuauaaga

SEQ ID NO: 4080 - RNA, 15 nt, Homo sapiens
ggauauuuauaagaa

SEQ ID NO: 4081 - RNA, 15 nt, Homo sapiens
acgugguuaaccugc

SEQ ID NO: 4082 - RNA, 15 nt, Homo sapiens
uauuucuagucauga

SEQ ID NO: 4083 - RNA, 15 nt, Homo sapiens
caauaauagaaggaa

SEQ ID NO: 4084 - RNA, 15 nt, Homo sapiens
gagacuuaaacuggg

SEQ ID NO: 4085 - RNA, 15 nt, Homo sapiens
gaugacuaccagggc

SEQ ID NO: 4086 - RNA, 15 nt, Homo sapiens
uuaauguagaaagaa

SEQ ID NO: 4087 - RNA, 15 nt, Homo sapiens
gccauuuaugacaaa

SEQ ID NO: 4088 - RNA, 15 nt, Homo sapiens
gucaaauuacuuaga

SEQ ID NO: 4089 - RNA, 15 nt, Homo sapiens
auaaaguugggacug

SEQ ID NO: 4090 - RNA, 15 nt, Homo sapiens
acuugguuuaaaaac

SEQ ID NO: 4091 - RNA, 15 nt, Homo sapiens
aagugguucaagcau

SEQ ID NO: 4092 - RNA, 15 nt, Homo sapiens
uucuccuuagguggg

SEQ ID NO: 4093 - RNA, 15 nt, Homo sapiens
ucuccuuaggugggu

SEQ ID NO: 4094 - RNA, 15 nt, Homo sapiens
guacucuacuccuga

SEQ ID NO: 4095 - RNA, 15 nt, Homo sapiens
agcaccuugguugug

SEQ ID NO: 4096 - RNA, 15 nt, Homo sapiens
ggcaaaucacuugga

SEQ ID NO: 4097 - RNA, 15 nt, Homo sapiens
caagcaucagcauuu

SEQ ID NO: 4098 - RNA, 15 nt, Homo sapiens
gagagcuccugagua

SEQ ID NO: 4099 - RNA, 15 nt, Homo sapiens
aaggccucgcucaag

SEQ ID NO: 4100 - RNA, 15 nt, Homo sapiens
ucuccauaucaaaac

SEQ ID NO: 4101 - RNA, 15 nt, Homo sapiens
auguauuuuguauac

SEQ ID NO: 4102 - RNA, 15 nt, Homo sapiens
cuagaauuucuggaa

SEQ ID NO: 4103 - RNA, 15 nt, Homo sapiens
cucucuucuggcucc

SEQ ID NO: 4104 - RNA, 15 nt, Homo sapiens
cuguacuccacccca

SEQ ID NO: 4105 - RNA, 15 nt, Homo sapiens
acaugguuugguccu

SEQ ID NO: 4106 - RNA, 15 nt, Homo sapiens
auggucuuugccuga

SEQ ID NO: 4107 - RNA, 15 nt, Homo sapiens
gcaccauaccuccug

SEQ ID NO: 4108 - RNA, 15 nt, Homo sapiens
gggcuuuuggaaaag

SEQ ID NO: 4109 - RNA, 15 nt, Homo sapiens
ccagacuacaacucg

SEQ ID NO: 4110 - RNA, 15 nt, Homo sapiens
guuuucuccauauca

SEQ ID NO: 4111 - RNA, 15 nt, Homo sapiens
agaauguaugccucu

SEQ ID NO: 4112 - RNA, 15 nt, Homo sapiens
auucccuagugagcc

SEQ ID NO: 4113 - RNA, 15 nt, Homo sapiens
uguuguuccucuucu

SEQ ID NO: 4114 - RNA, 15 nt, Homo sapiens
gcuuccuuuuaucca

SEQ ID NO: 4115 - RNA, 15 nt, Homo sapiens
uauauauucucugcu

SEQ ID NO: 4116 - RNA, 15 nt, Mus sp.
aguguauccacaggg

SEQ ID NO: 4117 - RNA, 15 nt, Mus sp.
ugcaaauuuggaaac

SEQ ID NO: 4118 - RNA, 15 nt, Mus sp.
cugccuuaugaugcc

SEQ ID NO: 4119 - RNA, 15 nt, Mus sp.
guggaauucugcaaa

SEQ ID NO: 4120 - RNA, 15 nt, Mus sp.
ugugguuuaaagaua

SEQ ID NO: 4121 - RNA, 15 nt, Mus sp.
gggauauuuauaaag

SEQ ID NO: 4122 - RNA, 15 nt, Mus sp.
ggauauuuauaaaga

SEQ ID NO: 4123 - RNA, 15 nt, Mus sp.
auguggucaaccuuc

SEQ ID NO: 4124 - RNA, 15 nt, Mus sp.
uacuucuugucauca

SEQ ID NO: 4125 - RNA, 15 nt, Mus sp.
cucuaauugaaggaa

SEQ ID NO: 4126 - RNA, 15 nt, Mus sp.
uugacuucaacuggg

SEQ ID NO: 4127 - RNA, 15 nt, Mus sp.
gaggacuuccaggga

SEQ ID NO: 4128 - RNA, 15 nt, Mus sp.
aaaauguugaaagaa

SEQ ID NO: 4129 - RNA, 15 nt, Mus sp.
acaauuuuugacaga

SEQ ID NO: 4130 - RNA, 15 nt, Mus sp.
uucaaauuacuugca

SEQ ID NO: 4131 - RNA, 15 nt, Mus sp.
acaaagucgggagag

SEQ ID NO: 4132 - RNA, 15 nt, Mus sp.
aaaugguauaaaaau

SEQ ID NO: 4133 - RNA, 15 nt, Mus sp.
acaugguacaagcuu

SEQ ID NO: 4134 - RNA, 15 nt, Mus sp.
uuuuccuuaggugcu

SEQ ID NO: 4135 - RNA, 15 nt, Mus sp.
uuuccuuaggugcuu

SEQ ID NO: 4136 - RNA, 15 nt, Mus sp.
gagcucuccuccugu

SEQ ID NO: 4137 - RNA, 15 nt, Mus sp.
aguaccuugguuacc

SEQ ID NO: 4138 - RNA, 15 nt, Mus sp.
gaagcaucagcauaa

SEQ ID NO: 4139 - RNA, 15 nt, Mus sp.
ggaagcuccugaaga

SEQ ID NO: 4140 - RNA, 15 nt, Mus sp.
ucugccuugcucaag

SEQ ID NO: 4141 - RNA, 15 nt, Mus sp.
gguccauuucaaauc

SEQ ID NO: 4142 - RNA, 15 nt, Mus sp.
gucuauuauguacau

SEQ ID NO: 4143 - RNA, 15 nt, Mus sp.
auggaaucucuggug

SEQ ID NO: 4144 - RNA, 15 nt, Mus sp.
uguucuucuggcuac

SEQ ID NO: 4145 - RNA, 15 nt, Mus sp.
uuauacuacaccaga

SEQ ID NO: 4146 - RNA, 15 nt, Mus sp.
cagugguaugguucu

SEQ ID NO: 4147 - RNA, 15 nt, Mus sp.
acggucuaugccauu

SEQ ID NO: 4148 - RNA, 15 nt, Mus sp.
augccauuccucccc

SEQ ID NO: 4149 - RNA, 15 nt, Mus sp.
uugcuuuuggaagug

SEQ ID NO: 4150 - RNA, 15 nt, Mus sp.
auugacuucaacugg

SEQ ID NO: 4151 - RNA, 15 nt, Mus sp.
ugcuucuccauaucc

SEQ ID NO: 4152 - RNA, 15 nt, Mus sp.
acuaugucugccuug

SEQ ID NO: 4153 - RNA, 15 nt, Mus sp.
auacccuugugaaga

SEQ ID NO: 4154 - RNA, 15 nt, Mus sp.
uaguguuucucuuga

SEQ ID NO: 4155 - RNA, 15 nt, Mus sp.
auauccucuuaucgg

SEQ ID NO: 4156 - RNA, 15 nt, Mus sp.
gaaauauccucuuau

SEQ ID NO: 4157 - RNA, 17 nt, Homo sapiens
gcggacacuccucucgg

SEQ ID NO: 4158 - RNA, 17 nt, Homo sapiens
ggacacuccucucggcu

SEQ ID NO: 4159 - RNA, 17 nt, Homo sapiens
gacacuccucucggcuc

SEQ ID NO: 4160 - RNA, 17 nt, Homo sapiens
cacuccucucggcuccu

SEQ ID NO: 4161 - RNA, 17 nt, Mus sp.
cucucggcuccuccccg

SEQ ID NO: 4162 - RNA, 17 nt, Homo sapiens
cucggcuccuccccggc

SEQ ID NO: 4163 - RNA, 17 nt, Homo sapiens
ucggcuccuccccggca

SEQ ID NO: 4164 - RNA, 17 nt, Homo sapiens
ggcuccuccccggcagc

SEQ ID NO: 4165 - RNA, 17 nt, Homo sapiens
gcuccuccccggcagcg

SEQ ID NO: 4166 - RNA, 17 nt, Homo sapiens
cuccuccccggcagcgg

SEQ ID NO: 4167 - RNA, 17 nt, Homo sapiens
uccccggcagcggcggc

SEQ ID NO: 4168 - RNA, 17 nt, Homo sapiens
gcggcggcucggagcgg

SEQ ID NO: 4169 - RNA, 17 nt, Homo sapiens
gagcgggcuccggggcu

SEQ ID NO: 4170 - RNA, 17 nt, Homo sapiens
gcgggcuccggggcucg

SEQ ID NO: 4171 - RNA, 17 nt, Homo sapiens
uccggggcucgggugca

SEQ ID NO: 4172 - RNA, 17 nt, Homo sapiens
ucgggugcagcggccag

SEQ ID NO: 4173 - RNA, 17 nt, Homo sapiens
gcagcggccagcgggcc

SEQ ID NO: 4174 - RNA, 17 nt, Homo sapiens
cagcggccagcgggccu

SEQ ID NO: 4175 - RNA, 17 nt, Homo sapiens
cagcgggccuggcggcg

SEQ ID NO: 4176 - RNA, 17 nt, Homo sapiens
agcgggccuggcggcga

SEQ ID NO: 4177 - RNA, 17 nt, Homo sapiens
aggauuacccggggaag

SEQ ID NO: 4178 - RNA, 17 nt, Homo sapiens
ggauuacccggggaagu

SEQ ID NO: 4179 - RNA, 17 nt, Homo sapiens
ugguugucuccuggcug

SEQ ID NO: 4180 - RNA, 17 nt, Homo sapiens
guugucuccuggcugga

SEQ ID NO: 4181 - RNA, 17 nt, Homo sapiens
uugucuccuggcuggag

SEQ ID NO: 4182 - RNA, 17 nt, Homo sapiens
cuccuggcuggagccgc

SEQ ID NO: 4183 - RNA, 17 nt, Homo sapiens
gcuggagccgcgagacg

SEQ ID NO: 4184 - RNA, 17 nt, Homo sapiens
acgggcgcucagggcgc

SEQ ID NO: 4185 - RNA, 17 nt, Homo sapiens
gggcgcucagggcgcgg

SEQ ID NO: 4186 - RNA, 17 nt, Homo sapiens
cgcggggccggcggcgg

SEQ ID NO: 4187 - RNA, 17 nt, Homo sapiens
ggacggacucuggcggc

SEQ ID NO: 4188 - RNA, 17 nt, Homo sapiens
acggacucuggcggccg

SEQ ID NO: 4189 - RNA, 17 nt, Homo sapiens
cuggcggccgggucguu

SEQ ID NO: 4190 - RNA, 17 nt, Homo sapiens
ucguuggccgggggagc

SEQ ID NO: 4191 - RNA, 17 nt, Homo sapiens
gcgcgggcaccgggcga

SEQ ID NO: 4192 - RNA, 17 nt, Homo sapiens
gcgggcaccgggcgagc

SEQ ID NO: 4193 - RNA, 17 nt, Homo sapiens
gggcgagcaggccgcgu

SEQ ID NO: 4194 - RNA, 17 nt, Homo sapiens
gagcaggccgcgucgcg

SEQ ID NO: 4195 - RNA, 17 nt, Homo sapiens
cgucgcgcucaccaugg

SEQ ID NO: 4196 - RNA, 17 nt, Homo sapiens
ucgcgcucaccaugguc

SEQ ID NO: 4197 - RNA, 17 nt, Homo sapiens
gcgcucaccauggucag

SEQ ID NO: 4198 - RNA, 17 nt, Homo sapiens
cgcucaccauggucagc

SEQ ID NO: 4199 - RNA, 17 nt, Homo sapiens
ccauggucagcuacugg

SEQ ID NO: 4200 - RNA, 17 nt, Homo sapiens
uggucagcuacugggac

SEQ ID NO: 4201 - RNA, 17 nt, Homo sapiens
ucagcuacugggacacc

SEQ ID NO: 4202 - RNA, 17 nt, Homo sapiens
acugggacaccgggguc

SEQ ID NO: 4203 - RNA, 17 nt, Homo sapiens
ugggacaccgggguccu

SEQ ID NO: 4204 - RNA, 17 nt, Homo sapiens
ccgggguccugcugugc

SEQ ID NO: 4205 - RNA, 17 nt, Homo sapiens
cgggguccugcugugcg

SEQ ID NO: 4206 - RNA, 17 nt, Homo sapiens
gguccugcugugcgcgc

SEQ ID NO: 4207 - RNA, 17 nt, Homo sapiens
gugcgcgcugcucagcu

SEQ ID NO: 4208 - RNA, 17 nt, Homo sapiens
cgcgcugcucagcuguc

SEQ ID NO: 4209 - RNA, 17 nt, Homo sapiens
cgcugcucagcugucug

SEQ ID NO: 4210 - RNA, 17 nt, Homo sapiens
ugcucagcugucugcuu

SEQ ID NO: 4211 - RNA, 17 nt, Homo sapiens
cagcugucugcuucuca

SEQ ID NO: 4212 - RNA, 17 nt, Homo sapiens
cugucugcuucucacag

SEQ ID NO: 4213 - RNA, 17 nt, Homo sapiens
ucugcuucucacaggau

SEQ ID NO: 4214 - RNA, 17 nt, Homo sapiens
ugcuucucacaggaucu

SEQ ID NO: 4215 - RNA, 17 nt, Homo sapiens
cuucucacaggaucuag

SEQ ID NO: 4216 - RNA, 17 nt, Homo sapiens
acaggaucuaguucagg

SEQ ID NO: 4217 - RNA, 17 nt, Homo sapiens
ucuaguucagguucaaa

SEQ ID NO: 4218 - RNA, 17 nt, Homo sapiens
ucagguucaaaauuaaa

SEQ ID NO: 4219 - RNA, 17 nt, Homo sapiens
aaaagauccugaacuga

SEQ ID NO: 4220 - RNA, 17 nt, Homo sapiens
aaagauccugaacugag

SEQ ID NO: 4221 - RNA, 17 nt, Homo sapiens
uccugaacugaguuuaa

SEQ ID NO: 4222 - RNA, 17 nt, Homo sapiens
uaaaaggcacccagcac

SEQ ID NO: 4223 - RNA, 17 nt, Homo sapiens
aaaggcacccagcacau

SEQ ID NO: 4224 - RNA, 17 nt, Homo sapiens
aaggcacccagcacauc

SEQ ID NO: 4225 - RNA, 17 nt, Homo sapiens
aggcacccagcacauca

SEQ ID NO: 4226 - RNA, 17 nt, Homo sapiens
cacccagcacaucaugc

SEQ ID NO: 4227 - RNA, 17 nt, Homo sapiens
cccagcacaucaugcaa

SEQ ID NO: 4228 - RNA, 17 nt, Homo sapiens
agcacaucaugcaagca

SEQ ID NO: 4229 - RNA, 17 nt, Homo sapiens
caucaugcaagcaggcc

SEQ ID NO: 4230 - RNA, 17 nt, Homo sapiens
augcaagcaggccagac

SEQ ID NO: 4231 - RNA, 17 nt, Homo sapiens
aagcaggccagacacug

SEQ ID NO: 4232 - RNA, 17 nt, Homo sapiens
agcaggccagacacugc

SEQ ID NO: 4233 - RNA, 17 nt, Homo sapiens
ggccagacacugcaucu

SEQ ID NO: 4234 - RNA, 17 nt, Homo sapiens
ccagacacugcaucucc

SEQ ID NO: 4235 - RNA, 17 nt, Homo sapiens
gacacugcaucuccaau

SEQ ID NO: 4236 - RNA, 17 nt, Homo sapiens
acugcaucuccaaugca

SEQ ID NO: 4237 - RNA, 17 nt, Homo sapiens
ugcaucuccaaugcagg

SEQ ID NO: 4238 - RNA, 17 nt, Homo sapiens
gcaucuccaaugcaggg

SEQ ID NO: 4239 - RNA, 17 nt, Homo sapiens
uccaaugcaggggggaa

SEQ ID NO: 4240 - RNA, 17 nt, Homo sapiens
ggggaagcagcccauaa

SEQ ID NO: 4241 - RNA, 17 nt, Homo sapiens
gaagcagcccauaaaug

SEQ ID NO: 4242 - RNA, 17 nt, Homo sapiens
aagcagcccauaaaugg

SEQ ID NO: 4243 - RNA, 17 nt, Homo sapiens
agcagcccauaaauggu

SEQ ID NO: 4244 - RNA, 17 nt, Homo sapiens
aaauggucuuugccuga

SEQ ID NO: 4245 - RNA, 17 nt, Homo sapiens
gucuuugccugaaaugg

SEQ ID NO: 4246 - RNA, 17 nt, Homo sapiens
ucuuugccugaaauggu

SEQ ID NO: 4247 - RNA, 17 nt, Homo sapiens
cgaaaggcugagcauaa

SEQ ID NO: 4248 - RNA, 17 nt, Homo sapiens
ggcugagcauaacuaaa

SEQ ID NO: 4249 - RNA, 17 nt, Homo sapiens
agcauaacuaaaucugc

SEQ ID NO: 4250 - RNA, 17 nt, Homo sapiens
acuaaaucugccugugg

SEQ ID NO: 4251 - RNA, 17 nt, Homo sapiens
aaaucugccuguggaag

SEQ ID NO: 4252 - RNA, 17 nt, Homo sapiens
aaucugccuguggaaga

SEQ ID NO: 4253 - RNA, 17 nt, Homo sapiens
gaaauggcaaacaauuc

SEQ ID NO: 4254 - RNA, 17 nt, Homo sapiens
uggcaaacaauucugca

SEQ ID NO: 4255 - RNA, 17 nt, Homo sapiens
aacaauucugcaguacu

SEQ ID NO: 4256 - RNA, 17 nt, Homo sapiens
aauucugcaguacuuua

SEQ ID NO: 4257 - RNA, 17 nt, Homo sapiens
ugcaguacuuuaaccuu

SEQ ID NO: 4258 - RNA, 17 nt, Homo sapiens
acuuuaaccuugaacac

SEQ ID NO: 4259 - RNA, 17 nt, Homo sapiens
cuuuaaccuugaacaca

SEQ ID NO: 4260 - RNA, 17 nt, Homo sapiens
ccuugaacacagcucaa

SEQ ID NO: 4261 - RNA, 17 nt, Homo sapiens
uugaacacagcucaagc

SEQ ID NO: 4262 - RNA, 17 nt, Homo sapiens
aacacagcucaagcaaa

SEQ ID NO: 4263 - RNA, 17 nt, Homo sapiens
cacagcucaagcaaacc

SEQ ID NO: 4264 - RNA, 17 nt, Homo sapiens
gcucaagcaaaccacac

SEQ ID NO: 4265 - RNA, 17 nt, Homo sapiens
aagcaaaccacacuggc

SEQ ID NO: 4266 - RNA, 17 nt, Homo sapiens
agcaaaccacacuggcu

SEQ ID NO: 4267 - RNA, 17 nt, Homo sapiens
caaaccacacuggcuuc

SEQ ID NO: 4268 - RNA, 17 nt, Homo sapiens
aaccacacuggcuucua

SEQ ID NO: 4269 - RNA, 17 nt, Homo sapiens
acacuggcuucuacagc

SEQ ID NO: 4270 - RNA, 17 nt, Homo sapiens
cuggcuucuacagcugc

SEQ ID NO: 4271 - RNA, 17 nt, Homo sapiens
gcuucuacagcugcaaa

SEQ ID NO: 4272 - RNA, 17 nt, Homo sapiens
ucuacagcugcaaauau

SEQ ID NO: 4273 - RNA, 17 nt, Homo sapiens
acagcugcaaauaucua

SEQ ID NO: 4274 - RNA, 17 nt, Homo sapiens
caaauaucuagcuguac

SEQ ID NO: 4275 - RNA, 17 nt, Homo sapiens
uaucuagcuguaccuac

SEQ ID NO: 4276 - RNA, 17 nt, Homo sapiens
agcuguaccuacuucaa

SEQ ID NO: 4277 - RNA, 17 nt, Homo sapiens
gcuguaccuacuucaaa

SEQ ID NO: 4278 - RNA, 17 nt, Homo sapiens
guaccuacuucaaagaa

SEQ ID NO: 4279 - RNA, 17 nt, Homo sapiens
ccuacuucaaagaagaa

SEQ ID NO: 4280 - RNA, 17 nt, Homo sapiens
aaggaaacagaaucugc

SEQ ID NO: 4281 - RNA, 17 nt, Homo sapiens
acagaaucugcaaucua

SEQ ID NO: 4282 - RNA, 17 nt, Homo sapiens
gaaucugcaaucuauau

SEQ ID NO: 4283 - RNA, 17 nt, Homo sapiens
cugcaaucuauauauuu

SEQ ID NO: 4284 - RNA, 17 nt, Homo sapiens
agugauacagguagacc

SEQ ID NO: 4285 - RNA, 17 nt, Homo sapiens
agguagaccuuucguag

SEQ ID NO: 4286 - RNA, 17 nt, Homo sapiens
gguagaccuuucguaga

SEQ ID NO: 4287 - RNA, 17 nt, Homo sapiens
agauguacagugaaauc

SEQ ID NO: 4288 - RNA, 17 nt, Homo sapiens
gugaaauccccgaaauu

SEQ ID NO: 4289 - RNA, 17 nt, Homo sapiens
ugaaauccccgaaauua

SEQ ID NO: 4290 - RNA, 17 nt, Homo sapiens
gaaauccccgaaauuau

SEQ ID NO: 4291 - RNA, 17 nt, Homo sapiens
aauuauacacaugacug

SEQ ID NO: 4292 - RNA, 17 nt, Homo sapiens
uuauacacaugacugaa

SEQ ID NO: 4293 - RNA, 17 nt, Homo sapiens
cacaugacugaaggaag

SEQ ID NO: 4294 - RNA, 17 nt, Homo sapiens
aagggagcucgucauuc

SEQ ID NO: 4295 - RNA, 17 nt, Homo sapiens
agcucgucauucccugc

SEQ ID NO: 4296 - RNA, 17 nt, Homo sapiens
cgucauucccugccggg

SEQ ID NO: 4297 - RNA, 17 nt, Homo sapiens
gucauucccugccgggu

SEQ ID NO: 4298 - RNA, 17 nt, Homo sapiens
ucauucccugccggguu

SEQ ID NO: 4299 - RNA, 17 nt, Homo sapiens
uucccugccggguuacg

SEQ ID NO: 4300 - RNA, 17 nt, Homo sapiens
guuacgucaccuaacau

SEQ ID NO: 4301 - RNA, 17 nt, Homo sapiens
uacgucaccuaacauca

SEQ ID NO: 4302 - RNA, 17 nt, Homo sapiens
acgucaccuaacaucac

SEQ ID NO: 4303 - RNA, 17 nt, Homo sapiens
caccuaacaucacuguu

SEQ ID NO: 4304 - RNA, 17 nt, Homo sapiens
cuaacaucacuguuacu

SEQ ID NO: 4305 - RNA, 17 nt, Homo sapiens
aacaucacuguuacuuu

SEQ ID NO: 4306 - RNA, 17 nt, Homo sapiens
acuguuacuuuaaaaaa

SEQ ID NO: 4307 - RNA, 17 nt, Homo sapiens
aaaguuuccacuugaca

SEQ ID NO: 4308 - RNA, 17 nt, Homo sapiens
aaguuuccacuugacac

SEQ ID NO: 4309 - RNA, 17 nt, Homo sapiens
guuuccacuugacacuu

SEQ ID NO: 4310 - RNA, 17 nt, Homo sapiens
cacuugacacuuugauc

SEQ ID NO: 4311 - RNA, 17 nt, Homo sapiens
cuugacacuuugauccc

SEQ ID NO: 4312 - RNA, 17 nt, Homo sapiens
cuuugaucccugaugga

SEQ ID NO: 4313 - RNA, 17 nt, Homo sapiens
uuugaucccugauggaa

SEQ ID NO: 4314 - RNA, 17 nt, Homo sapiens
uugaucccugauggaaa

SEQ ID NO: 4315 - RNA, 17 nt, Homo sapiens
gaaaacgcauaaucugg

SEQ ID NO: 4316 - RNA, 17 nt, Homo sapiens
gcauaaucugggacagu

SEQ ID NO: 4317 - RNA, 17 nt, Homo sapiens
ucugggacaguagaaag

SEQ ID NO: 4318 - RNA, 17 nt, Homo sapiens
gaaagggcuucaucaua

SEQ ID NO: 4319 - RNA, 17 nt, Homo sapiens
agggcuucaucauauca

SEQ ID NO: 4320 - RNA, 17 nt, Homo sapiens
gcuucaucauaucaaau

SEQ ID NO: 4321 - RNA, 17 nt, Homo sapiens
aucauaucaaaugcaac

SEQ ID NO: 4322 - RNA, 17 nt, Homo sapiens
ucaaaugcaacguacaa

SEQ ID NO: 4323 - RNA, 17 nt, Homo sapiens
caacguacaaagaaaua

SEQ ID NO: 4324 - RNA, 17 nt, Homo sapiens
aauagggcuucugaccu

SEQ ID NO: 4325 - RNA, 17 nt, Homo sapiens
agggcuucugaccugug

SEQ ID NO: 4326 - RNA, 17 nt, Homo sapiens
cuucugaccugugaagc

SEQ ID NO: 4327 - RNA, 17 nt, Homo sapiens
uucugaccugugaagca

SEQ ID NO: 4328 - RNA, 17 nt, Homo sapiens
ugugaagcaacagucaa

SEQ ID NO: 4329 - RNA, 17 nt, Homo sapiens
gaagcaacagucaaugg

SEQ ID NO: 4330 - RNA, 17 nt, Homo sapiens
caacagucaaugggcau

SEQ ID NO: 4331 - RNA, 17 nt, Homo sapiens
caaugggcauuuguaua

SEQ ID NO: 4332 - RNA, 17 nt, Homo sapiens
uauaagacaaacuaucu

SEQ ID NO: 4333 - RNA, 17 nt, Homo sapiens
agacaaacuaucucaca

SEQ ID NO: 4334 - RNA, 17 nt, Homo sapiens
aaacuaucucacacauc

SEQ ID NO: 4335 - RNA, 17 nt, Homo sapiens
acuaucucacacaucga

SEQ ID NO: 4336 - RNA, 17 nt, Homo sapiens
uaucucacacaucgaca

SEQ ID NO: 4337 - RNA, 17 nt, Homo sapiens
ucucacacaucgacaaa

SEQ ID NO: 4338 - RNA, 17 nt, Homo sapiens
acaucgacaaaccaaua

SEQ ID NO: 4339 - RNA, 17 nt, Homo sapiens
cgacaaaccaauacaau

SEQ ID NO: 4340 - RNA, 17 nt, Homo sapiens
gacaaaccaauacaauc

SEQ ID NO: 4341 - RNA, 17 nt, Homo sapiens
accaauacaaucauaga

SEQ ID NO: 4342 - RNA, 17 nt, Homo sapiens
auacaaucauagauguc

SEQ ID NO: 4343 - RNA, 17 nt, Homo sapiens
uagauguccaaauaagc

SEQ ID NO: 4344 - RNA, 17 nt, Homo sapiens
agauguccaaauaagca

SEQ ID NO: 4345 - RNA, 17 nt, Homo sapiens
aaauaagcacaccacgc

SEQ ID NO: 4346 - RNA, 17 nt, Homo sapiens
auaagcacaccacgccc

SEQ ID NO: 4347 - RNA, 17 nt, Homo sapiens
aagcacaccacgcccag

SEQ ID NO: 4348 - RNA, 17 nt, Homo sapiens
agcacaccacgcccagu

SEQ ID NO: 4349 - RNA, 17 nt, Homo sapiens
caccacgcccagucaaa

SEQ ID NO: 4350 - RNA, 17 nt, Homo sapiens
accacgcccagucaaau

SEQ ID NO: 4351 - RNA, 17 nt, Homo sapiens
ccacgcccagucaaauu

SEQ ID NO: 4352 - RNA, 17 nt, Homo sapiens
gcccagucaaauuacuu

SEQ ID NO: 4353 - RNA, 17 nt, Homo sapiens
caaauuacuuagaggcc

SEQ ID NO: 4354 - RNA, 17 nt, Homo sapiens
uuagaggccauacucuu

SEQ ID NO: 4355 - RNA, 17 nt, Homo sapiens
uagaggccauacucuug

SEQ ID NO: 4356 - RNA, 17 nt, Homo sapiens
ggccauacucuuguccu

SEQ ID NO: 4357 - RNA, 17 nt, Homo sapiens
ccauacucuuguccuca

SEQ ID NO: 4358 - RNA, 17 nt, Homo sapiens
cucuuguccucaauugu

SEQ ID NO: 4359 - RNA, 17 nt, Homo sapiens
ucuuguccucaauugua

SEQ ID NO: 4360 - RNA, 17 nt, Homo sapiens
uuguccucaauuguacu

SEQ ID NO: 4361 - RNA, 17 nt, Homo sapiens
aauuguacugcuaccac

SEQ ID NO: 4362 - RNA, 17 nt, Homo sapiens
uguacugcuaccacucc

SEQ ID NO: 4363 - RNA, 17 nt, Homo sapiens
acugcuaccacucccuu

SEQ ID NO: 4364 - RNA, 17 nt, Homo sapiens
cugcuaccacucccuug

SEQ ID NO: 4365 - RNA, 17 nt, Homo sapiens
gcuaccacucccuugaa

SEQ ID NO: 4366 - RNA, 17 nt, Homo sapiens
uaccacucccuugaaca

SEQ ID NO: 4367 - RNA, 17 nt, Homo sapiens
accacucccuugaacac

SEQ ID NO: 4368 - RNA, 17 nt, Homo sapiens
ccacucccuugaacacg

SEQ ID NO: 4369 - RNA, 17 nt, Homo sapiens
ccuugaacacgagaguu

SEQ ID NO: 4370 - RNA, 17 nt, Homo sapiens
gagaguucaaaugaccu

SEQ ID NO: 4371 - RNA, 17 nt, Homo sapiens
caaaugaccuggaguua

SEQ ID NO: 4372 - RNA, 17 nt, Homo sapiens
aaaugaccuggaguuac

SEQ ID NO: 4373 - RNA, 17 nt, Homo sapiens
ggaguuacccugaugaa

SEQ ID NO: 4374 - RNA, 17 nt, Homo sapiens
gaguuacccugaugaaa

SEQ ID NO: 4375 - RNA, 17 nt, Homo sapiens
aguuacccugaugaaaa

SEQ ID NO: 4376 - RNA, 17 nt, Homo sapiens
aagagagcuuccguaag

SEQ ID NO: 4377 - RNA, 17 nt, Homo sapiens
agagcuuccguaaggcg

SEQ ID NO: 4378 - RNA, 17 nt, Homo sapiens
gaauugaccaaagcaau

SEQ ID NO: 4379 - RNA, 17 nt, Homo sapiens
aauugaccaaagcaauu

SEQ ID NO: 4380 - RNA, 17 nt, Homo sapiens
accaaagcaauucccau

SEQ ID NO: 4381 - RNA, 17 nt, Homo sapiens
agcaauucccaugccaa

SEQ ID NO: 4382 - RNA, 17 nt, Homo sapiens
gcaauucccaugccaac

SEQ ID NO: 4383 - RNA, 17 nt, Homo sapiens
caauucccaugccaaca

SEQ ID NO: 4384 - RNA, 17 nt, Homo sapiens
ucccaugccaacauauu

SEQ ID NO: 4385 - RNA, 17 nt, Homo sapiens
cccaugccaacauauuc

SEQ ID NO: 4386 - RNA, 17 nt, Homo sapiens
augccaacauauucuac

SEQ ID NO: 4387 - RNA, 17 nt, Homo sapiens
acauauucuacaguguu

SEQ ID NO: 4388 - RNA, 17 nt, Homo sapiens
uauucuacaguguucuu

SEQ ID NO: 4389 - RNA, 17 nt, Homo sapiens
caguguucuuacuauug

SEQ ID NO: 4390 - RNA, 17 nt, Homo sapiens
guucuuacuauugacaa

SEQ ID NO: 4391 - RNA, 17 nt, Homo sapiens
cuauugacaaaaugcag

SEQ ID NO: 4392 - RNA, 17 nt, Homo sapiens
caaaaugcagaacaaag

SEQ ID NO: 4393 - RNA, 17 nt, Homo sapiens
ugcagaacaaagacaaa

SEQ ID NO: 4394 - RNA, 17 nt, Homo sapiens
acaaagacaaaggacuu

SEQ ID NO: 4395 - RNA, 17 nt, Homo sapiens
caaaggacuuuauacuu

SEQ ID NO: 4396 - RNA, 17 nt, Homo sapiens
cuuuauacuugucgugu

SEQ ID NO: 4397 - RNA, 17 nt, Homo sapiens
gaguggaccaucauuca

SEQ ID NO: 4398 - RNA, 17 nt, Homo sapiens
aguggaccaucauucaa

SEQ ID NO: 4399 - RNA, 17 nt, Homo sapiens
ggaccaucauucaaauc

SEQ ID NO: 4400 - RNA, 17 nt, Homo sapiens
caucauucaaaucuguu

SEQ ID NO: 4401 - RNA, 17 nt, Homo sapiens
uucaaaucuguuaacac

SEQ ID NO: 4402 - RNA, 17 nt, Homo sapiens
cuguuaacaccucagug

SEQ ID NO: 4403 - RNA, 17 nt, Homo sapiens
guuaacaccucagugca

SEQ ID NO: 4404 - RNA, 17 nt, Homo sapiens
uuaacaccucagugcau

SEQ ID NO: 4405 - RNA, 17 nt, Homo sapiens
aacaccucagugcauau

SEQ ID NO: 4406 - RNA, 17 nt, Homo sapiens
cucagugcauauauaug

SEQ ID NO: 4407 - RNA, 17 nt, Homo sapiens
gauaaagcauucaucac

SEQ ID NO: 4408 - RNA, 17 nt, Homo sapiens
aagcauucaucacugug

SEQ ID NO: 4409 - RNA, 17 nt, Homo sapiens
cauucaucacugugaaa

SEQ ID NO: 4410 - RNA, 17 nt, Homo sapiens
uucaucacugugaaaca

SEQ ID NO: 4411 - RNA, 17 nt, Homo sapiens
ugugaaacaucgaaaac

SEQ ID NO: 4412 - RNA, 17 nt, Homo sapiens
ucgaaaacagcaggugc

SEQ ID NO: 4413 - RNA, 17 nt, Homo sapiens
aaaacagcaggugcuug

SEQ ID NO: 4414 - RNA, 17 nt, Homo sapiens
gcaggugcuugaaaccg

SEQ ID NO: 4415 - RNA, 17 nt, Homo sapiens
cuugaaaccguagcugg

SEQ ID NO: 4416 - RNA, 17 nt, Homo sapiens
accguagcuggcaagcg

SEQ ID NO: 4417 - RNA, 17 nt, Homo sapiens
uagcuggcaagcggucu

SEQ ID NO: 4418 - RNA, 17 nt, Homo sapiens
aagcggucuuaccggcu

SEQ ID NO: 4419 - RNA, 17 nt, Homo sapiens
ggucuuaccggcucucu

SEQ ID NO: 4420 - RNA, 17 nt, Homo sapiens
uuaccggcucucuauga

SEQ ID NO: 4421 - RNA, 17 nt, Homo sapiens
accggcucucuaugaaa

SEQ ID NO: 4422 - RNA, 17 nt, Homo sapiens
cggcucucuaugaaagu

SEQ ID NO: 4423 - RNA, 17 nt, Homo sapiens
gugaaggcauuucccuc

SEQ ID NO: 4424 - RNA, 17 nt, Homo sapiens
ggcauuucccucgccgg

SEQ ID NO: 4425 - RNA, 17 nt, Homo sapiens
gcauuucccucgccgga

SEQ ID NO: 4426 - RNA, 17 nt, Homo sapiens
cauuucccucgccggaa

SEQ ID NO: 4427 - RNA, 17 nt, Homo sapiens
ucccucgccggaaguug

SEQ ID NO: 4428 - RNA, 17 nt, Homo sapiens
uggguuaccugcgacug

SEQ ID NO: 4429 - RNA, 17 nt, Homo sapiens
ggguuaccugcgacuga

SEQ ID NO: 4430 - RNA, 17 nt, Homo sapiens
ccugcgacugagaaauc

SEQ ID NO: 4431 - RNA, 17 nt, Homo sapiens
gagaaaucugcucgcua

SEQ ID NO: 4432 - RNA, 17 nt, Homo sapiens
aaaucugcucgcuauuu

SEQ ID NO: 4433 - RNA, 17 nt, Homo sapiens
cugcucgcuauuugacu

SEQ ID NO: 4434 - RNA, 17 nt, Homo sapiens
uauuugacucguggcua

SEQ ID NO: 4435 - RNA, 17 nt, Homo sapiens
cucguggcuacucguua

SEQ ID NO: 4436 - RNA, 17 nt, Homo sapiens
guggcuacucguuaauu

SEQ ID NO: 4437 - RNA, 17 nt, Homo sapiens
uaauuaucaaggacgua

SEQ ID NO: 4438 - RNA, 17 nt, Homo sapiens
gacguaacugaagagga

SEQ ID NO: 4439 - RNA, 17 nt, Homo sapiens
gaggaugcagggaauua

SEQ ID NO: 4440 - RNA, 17 nt, Homo sapiens
aauuauacaaucuugcu

SEQ ID NO: 4441 - RNA, 17 nt, Homo sapiens
auacaaucuugcugagc

SEQ ID NO: 4442 - RNA, 17 nt, Homo sapiens
aaucuugcugagcauaa

SEQ ID NO: 4443 - RNA, 17 nt, Homo sapiens
ugcugagcauaaaacag

SEQ ID NO: 4444 - RNA, 17 nt, Homo sapiens
cauaaaacagucaaaug

SEQ ID NO: 4445 - RNA, 17 nt, Homo sapiens
aaacagucaaauguguu

SEQ ID NO: 4446 - RNA, 17 nt, Homo sapiens
uuaaaaaccucacugcc

SEQ ID NO: 4447 - RNA, 17 nt, Homo sapiens
uaaaaaccucacugcca

SEQ ID NO: 4448 - RNA, 17 nt, Homo sapiens
aaaaccucacugccacu

SEQ ID NO: 4449 - RNA, 17 nt, Homo sapiens
aaccucacugccacucu

SEQ ID NO: 4450 - RNA, 17 nt, Homo sapiens
cucacugccacucuaau

SEQ ID NO: 4451 - RNA, 17 nt, Homo sapiens
ucacugccacucuaauu

SEQ ID NO: 4452 - RNA, 17 nt, Homo sapiens
acugccacucuaauugu

SEQ ID NO: 4453 - RNA, 17 nt, Homo sapiens
ugccacucuaauuguca

SEQ ID NO: 4454 - RNA, 17 nt, Homo sapiens
uaauugucaaugugaaa

SEQ ID NO: 4455 - RNA, 17 nt, Homo sapiens
ugugaaaccccagauuu

SEQ ID NO: 4456 - RNA, 17 nt, Homo sapiens
gugaaaccccagauuua

SEQ ID NO: 4457 - RNA, 17 nt, Homo sapiens
ugaaaccccagauuuac

SEQ ID NO: 4458 - RNA, 17 nt, Homo sapiens
gaaaccccagauuuacg

SEQ ID NO: 4459 - RNA, 17 nt, Homo sapiens
gaaaaggccgugucauc

SEQ ID NO: 4460 - RNA, 17 nt, Homo sapiens
gccgugucaucguuucc

SEQ ID NO: 4461 - RNA, 17 nt, Homo sapiens
aucguuuccagacccgg

SEQ ID NO: 4462 - RNA, 17 nt, Homo sapiens
ucguuuccagacccggc

SEQ ID NO: 4463 - RNA, 17 nt, Homo sapiens
uuccagacccggcucuc

SEQ ID NO: 4464 - RNA, 17 nt, Homo sapiens
uccagacccggcucucu

SEQ ID NO: 4465 - RNA, 17 nt, Homo sapiens
gacccggcucucuaccc

SEQ ID NO: 4466 - RNA, 17 nt, Homo sapiens
cccggcucucuacccac

SEQ ID NO: 4467 - RNA, 17 nt, Homo sapiens
cggcucucuacccacug

SEQ ID NO: 4468 - RNA, 17 nt, Homo sapiens
cucucuacccacugggc

SEQ ID NO: 4469 - RNA, 17 nt, Homo sapiens
ucucuacccacugggca

SEQ ID NO: 4470 - RNA, 17 nt, Homo sapiens
cucuacccacugggcag

SEQ ID NO: 4471 - RNA, 17 nt, Homo sapiens
cuacccacugggcagca

SEQ ID NO: 4472 - RNA, 17 nt, Homo sapiens
cacugggcagcagacaa

SEQ ID NO: 4473 - RNA, 17 nt, Homo sapiens
ugggcagcagacaaauc

SEQ ID NO: 4474 - RNA, 17 nt, Homo sapiens
cagcagacaaauccuga

SEQ ID NO: 4475 - RNA, 17 nt, Homo sapiens
gacaaauccugacuugu

SEQ ID NO: 4476 - RNA, 17 nt, Homo sapiens
acaaauccugacuugua

SEQ ID NO: 4477 - RNA, 17 nt, Homo sapiens
auccugacuuguaccgc

SEQ ID NO: 4478 - RNA, 17 nt, Homo sapiens
acuuguaccgcauaugg

SEQ ID NO: 4479 - RNA, 17 nt, Homo sapiens
uguaccgcauaugguau

SEQ ID NO: 4480 - RNA, 17 nt, Homo sapiens
augguaucccucaaccu

SEQ ID NO: 4481 - RNA, 17 nt, Homo sapiens
ugguaucccucaaccua

SEQ ID NO: 4482 - RNA, 17 nt, Homo sapiens
gguaucccucaaccuac

SEQ ID NO: 4483 - RNA, 17 nt, Homo sapiens
uaucccucaaccuacaa

SEQ ID NO: 4484 - RNA, 17 nt, Homo sapiens
cccucaaccuacaauca

SEQ ID NO: 4485 - RNA, 17 nt, Homo sapiens
ccucaaccuacaaucaa

SEQ ID NO: 4486 - RNA, 17 nt, Homo sapiens
caaccuacaaucaagug

SEQ ID NO: 4487 - RNA, 17 nt, Homo sapiens
cuacaaucaagugguuc

SEQ ID NO: 4488 - RNA, 17 nt, Homo sapiens
agugguucuggcacccc

SEQ ID NO: 4489 - RNA, 17 nt, Homo sapiens
guucuggcaccccugua

SEQ ID NO: 4490 - RNA, 17 nt, Homo sapiens
ucuggcaccccuguaac

SEQ ID NO: 4491 - RNA, 17 nt, Homo sapiens
cuggcaccccuguaacc

SEQ ID NO: 4492 - RNA, 17 nt, Homo sapiens
uggcaccccuguaacca

SEQ ID NO: 4493 - RNA, 17 nt, Homo sapiens
ggcaccccuguaaccau

SEQ ID NO: 4494 - RNA, 17 nt, Homo sapiens
ccuguaaccauaaucau

SEQ ID NO: 4495 - RNA, 17 nt, Homo sapiens
cuguaaccauaaucauu

SEQ ID NO: 4496 - RNA, 17 nt, Homo sapiens
ccauaaucauuccgaag

SEQ ID NO: 4497 - RNA, 17 nt, Homo sapiens
aaucauuccgaagcaag

SEQ ID NO: 4498 - RNA, 17 nt, Homo sapiens
uccgaagcaagguguga

SEQ ID NO: 4499 - RNA, 17 nt, Homo sapiens
ggugugacuuuuguucc

SEQ ID NO: 4500 - RNA, 17 nt, Homo sapiens
uuuuguuccaauaauga

SEQ ID NO: 4501 - RNA, 17 nt, Homo sapiens
uuuguuccaauaaugaa

SEQ ID NO: 4502 - RNA, 17 nt, Homo sapiens
gaagaguccuuuauccu

SEQ ID NO: 4503 - RNA, 17 nt, Homo sapiens
aagaguccuuuauccug

SEQ ID NO: 4504 - RNA, 17 nt, Homo sapiens
ccuuuauccuggaugcu

SEQ ID NO: 4505 - RNA, 17 nt, Homo sapiens
cuuuauccuggaugcug

SEQ ID NO: 4506 - RNA, 17 nt, Homo sapiens
cuggaugcugacagcaa

SEQ ID NO: 4507 - RNA, 17 nt, Homo sapiens
augcugacagcaacaug

SEQ ID NO: 4508 - RNA, 17 nt, Homo sapiens
cugacagcaacauggga

SEQ ID NO: 4509 - RNA, 17 nt, Homo sapiens
acagcaacaugggaaac

SEQ ID NO: 4510 - RNA, 17 nt, Homo sapiens
ugggaaacagaauugag

SEQ ID NO: 4511 - RNA, 17 nt, Homo sapiens
uugagagcaucacucag

SEQ ID NO: 4512 - RNA, 17 nt, Homo sapiens
agagcaucacucagcgc

SEQ ID NO: 4513 - RNA, 17 nt, Homo sapiens
agcaucacucagcgcau

SEQ ID NO: 4514 - RNA, 17 nt, Homo sapiens
caucacucagcgcaugg

SEQ ID NO: 4515 - RNA, 17 nt, Homo sapiens
cucagcgcauggcaaua

SEQ ID NO: 4516 - RNA, 17 nt, Homo sapiens
cgcauggcaauaauaga

SEQ ID NO: 4517 - RNA, 17 nt, Homo sapiens
aagauggcuagcaccuu

SEQ ID NO: 4518 - RNA, 17 nt, Homo sapiens
uggcuagcaccuugguu

SEQ ID NO: 4519 - RNA, 17 nt, Homo sapiens
gcuagcaccuugguugu

SEQ ID NO: 4520 - RNA, 17 nt, Homo sapiens
cuagcaccuugguugug

SEQ ID NO: 4521 - RNA, 17 nt, Homo sapiens
guuguggcugacucuag

SEQ ID NO: 4522 - RNA, 17 nt, Homo sapiens
uggcugacucuagaauu

SEQ ID NO: 4523 - RNA, 17 nt, Homo sapiens
gcugacucuagaauuuc

SEQ ID NO: 4524 - RNA, 17 nt, Homo sapiens
agaauuucuggaaucua

SEQ ID NO: 4525 - RNA, 17 nt, Homo sapiens
cuggaaucuacauuugc

SEQ ID NO: 4526 - RNA, 17 nt, Homo sapiens
gaaucuacauuugcaua

SEQ ID NO: 4527 - RNA, 17 nt, Homo sapiens
acauuugcauagcuucc

SEQ ID NO: 4528 - RNA, 17 nt, Homo sapiens
ugcauagcuuccaauaa

SEQ ID NO: 4529 - RNA, 17 nt, Homo sapiens
auagcuuccaauaaagu

SEQ ID NO: 4530 - RNA, 17 nt, Homo sapiens
uagcuuccaauaaaguu

SEQ ID NO: 4531 - RNA, 17 nt, Homo sapiens
guugggacugugggaag

SEQ ID NO: 4532 - RNA, 17 nt, Homo sapiens
gaagaaacauaagcuuu

SEQ ID NO: 4533 - RNA, 17 nt, Homo sapiens
acauaagcuuuuauauc

SEQ ID NO: 4534 - RNA, 17 nt, Homo sapiens
uuuauaucacagaugug

SEQ ID NO: 4535 - RNA, 17 nt, Homo sapiens
uauaucacagaugugcc

SEQ ID NO: 4536 - RNA, 17 nt, Homo sapiens
agaugugccaaaugggu

SEQ ID NO: 4537 - RNA, 17 nt, Homo sapiens
gaugugccaaauggguu

SEQ ID NO: 4538 - RNA, 17 nt, Homo sapiens
uggguuucauguuaacu

SEQ ID NO: 4539 - RNA, 17 nt, Homo sapiens
auguuaacuuggaaaaa

SEQ ID NO: 4540 - RNA, 17 nt, Homo sapiens
aaaaaugccgacggaag

SEQ ID NO: 4541 - RNA, 17 nt, Homo sapiens
gagaggaccugaaacug

SEQ ID NO: 4542 - RNA, 17 nt, Homo sapiens
agaggaccugaaacugu

SEQ ID NO: 4543 - RNA, 17 nt, Homo sapiens
ccugaaacugucuugca

SEQ ID NO: 4544 - RNA, 17 nt, Homo sapiens
aaacugucuugcacagu

SEQ ID NO: 4545 - RNA, 17 nt, Homo sapiens
ugucuugcacaguuaac

SEQ ID NO: 4546 - RNA, 17 nt, Homo sapiens
ucuugcacaguuaacaa

SEQ ID NO: 4547 - RNA, 17 nt, Homo sapiens
caguuaacaaguucuua

SEQ ID NO: 4548 - RNA, 17 nt, Homo sapiens
acaaguucuuauacaga

SEQ ID NO: 4549 - RNA, 17 nt, Homo sapiens
ucuuauacagagacguu

SEQ ID NO: 4550 - RNA, 17 nt, Homo sapiens
gacguuacuuggauuuu

SEQ ID NO: 4551 - RNA, 17 nt, Homo sapiens
gauuuuacugcggacag

SEQ ID NO: 4552 - RNA, 17 nt, Homo sapiens
cugcggacaguuaauaa

SEQ ID NO: 4553 - RNA, 17 nt, Homo sapiens
uuaauaacagaacaaug

SEQ ID NO: 4554 - RNA, 17 nt, Homo sapiens
aacagaacaaugcacua

SEQ ID NO: 4555 - RNA, 17 nt, Homo sapiens
aacaaugcacuacagua

SEQ ID NO: 4556 - RNA, 17 nt, Homo sapiens
caaugcacuacaguauu

SEQ ID NO: 4557 - RNA, 17 nt, Homo sapiens
ugcacuacaguauuagc

SEQ ID NO: 4558 - RNA, 17 nt, Homo sapiens
guauuagcaagcaaaaa

SEQ ID NO: 4559 - RNA, 17 nt, Homo sapiens
uagcaagcaaaaaaugg

SEQ ID NO: 4560 - RNA, 17 nt, Homo sapiens
aaaauggccaucacuaa

SEQ ID NO: 4561 - RNA, 17 nt, Homo sapiens
aaauggccaucacuaag

SEQ ID NO: 4562 - RNA, 17 nt, Homo sapiens
uggccaucacuaaggag

SEQ ID NO: 4563 - RNA, 17 nt, Homo sapiens
gccaucacuaaggagca

SEQ ID NO: 4564 - RNA, 17 nt, Homo sapiens
uaaggagcacuccauca

SEQ ID NO: 4565 - RNA, 17 nt, Homo sapiens
aggagcacuccaucacu

SEQ ID NO: 4566 - RNA, 17 nt, Homo sapiens
gagcacuccaucacucu

SEQ ID NO: 4567 - RNA, 17 nt, Homo sapiens
agcacuccaucacucuu

SEQ ID NO: 4568 - RNA, 17 nt, Homo sapiens
acuccaucacucuuaau

SEQ ID NO: 4569 - RNA, 17 nt, Homo sapiens
uccaucacucuuaaucu

SEQ ID NO: 4570 - RNA, 17 nt, Homo sapiens
caucacucuuaaucuua

SEQ ID NO: 4571 - RNA, 17 nt, Homo sapiens
ucuuaaucuuaccauca

SEQ ID NO: 4572 - RNA, 17 nt, Homo sapiens
aaucuuaccaucaugaa

SEQ ID NO: 4573 - RNA, 17 nt, Homo sapiens
aucuuaccaucaugaau

SEQ ID NO: 4574 - RNA, 17 nt, Homo sapiens
uuaccaucaugaauguu

SEQ ID NO: 4575 - RNA, 17 nt, Homo sapiens
aauguuucccugcaaga

SEQ ID NO: 4576 - RNA, 17 nt, Homo sapiens
auguuucccugcaagau

SEQ ID NO: 4577 - RNA, 17 nt, Homo sapiens
uguuucccugcaagauu

SEQ ID NO: 4578 - RNA, 17 nt, Homo sapiens
uucccugcaagauucag

SEQ ID NO: 4579 - RNA, 17 nt, Homo sapiens
caagauucaggcaccua

SEQ ID NO: 4580 - RNA, 17 nt, Homo sapiens
auucaggcaccuaugcc

SEQ ID NO: 4581 - RNA, 17 nt, Homo sapiens
ucaggcaccuaugccug

SEQ ID NO: 4582 - RNA, 17 nt, Homo sapiens
caggcaccuaugccugc

SEQ ID NO: 4583 - RNA, 17 nt, Homo sapiens
accuaugccugcagagc

SEQ ID NO: 4584 - RNA, 17 nt, Homo sapiens
ccuaugccugcagagcc

SEQ ID NO: 4585 - RNA, 17 nt, Homo sapiens
augccugcagagccagg

SEQ ID NO: 4586 - RNA, 17 nt, Homo sapiens
ugcagagccaggaaugu

SEQ ID NO: 4587 - RNA, 17 nt, Homo sapiens
gcagagccaggaaugua

SEQ ID NO: 4588 - RNA, 17 nt, Homo sapiens
auguauacacaggggaa

SEQ ID NO: 4589 - RNA, 17 nt, Homo sapiens
guauacacaggggaaga

SEQ ID NO: 4590 - RNA, 17 nt, Homo sapiens
aagaaauccuccagaag

SEQ ID NO: 4591 - RNA, 17 nt, Homo sapiens
agaaauccuccagaaga

SEQ ID NO: 4592 - RNA, 17 nt, Homo sapiens
aaauccuccagaagaaa

SEQ ID NO: 4593 - RNA, 17 nt, Homo sapiens
aauccuccagaagaaag

SEQ ID NO: 4594 - RNA, 17 nt, Homo sapiens
gaaauuacaaucagaga

SEQ ID NO: 4595 - RNA, 17 nt, Homo sapiens
uuacaaucagagaucag

SEQ ID NO: 4596 - RNA, 17 nt, Homo sapiens
cagagaucaggaagcac

SEQ ID NO: 4597 - RNA, 17 nt, Homo sapiens
caggaagcaccauaccu

SEQ ID NO: 4598 - RNA, 17 nt, Homo sapiens
ggaagcaccauaccucc

SEQ ID NO: 4599 - RNA, 17 nt, Homo sapiens
gaagcaccauaccuccu

SEQ ID NO: 4600 - RNA, 17 nt, Homo sapiens
caccauaccuccugcga

SEQ ID NO: 4601 - RNA, 17 nt, Homo sapiens
accauaccuccugcgaa

SEQ ID NO: 4602 - RNA, 17 nt, Homo sapiens
cauaccuccugcgaaac

SEQ ID NO: 4603 - RNA, 17 nt, Homo sapiens
auaccuccugcgaaacc

SEQ ID NO: 4604 - RNA, 17 nt, Homo sapiens
ugcgaaaccucagugau

SEQ ID NO: 4605 - RNA, 17 nt, Homo sapiens
gcgaaaccucagugauc

SEQ ID NO: 4606 - RNA, 17 nt, Homo sapiens
gaaaccucagugaucac

SEQ ID NO: 4607 - RNA, 17 nt, Homo sapiens
cagugaucacacagugg

SEQ ID NO: 4608 - RNA, 17 nt, Homo sapiens
gugaucacacaguggcc

SEQ ID NO: 4609 - RNA, 17 nt, Homo sapiens
gaucacacaguggccau

SEQ ID NO: 4610 - RNA, 17 nt, Homo sapiens
acaguggccaucagcag

SEQ ID NO: 4611 - RNA, 17 nt, Homo sapiens
caguggccaucagcagu

SEQ ID NO: 4612 - RNA, 17 nt, Homo sapiens
uggccaucagcaguucc

SEQ ID NO: 4613 - RNA, 17 nt, Homo sapiens
ccaucagcaguuccacc

SEQ ID NO: 4614 - RNA, 17 nt, Homo sapiens
agcaguuccaccacuuu

SEQ ID NO: 4615 - RNA, 17 nt, Homo sapiens
gcaguuccaccacuuua

SEQ ID NO: 4616 - RNA, 17 nt, Homo sapiens
aguuccaccacuuuaga

SEQ ID NO: 4617 - RNA, 17 nt, Homo sapiens
guuccaccacuuuagac

SEQ ID NO: 4618 - RNA, 17 nt, Homo sapiens
uccaccacuuuagacug

SEQ ID NO: 4619 - RNA, 17 nt, Homo sapiens
cuuuagacugucaugcu

SEQ ID NO: 4620 - RNA, 17 nt, Homo sapiens
agacugucaugcuaaug

SEQ ID NO: 4621 - RNA, 17 nt, Homo sapiens
ugucaugcuaauggugu

SEQ ID NO: 4622 - RNA, 17 nt, Homo sapiens
augguguccccgagccu

SEQ ID NO: 4623 - RNA, 17 nt, Homo sapiens
ugguguccccgagccuc

SEQ ID NO: 4624 - RNA, 17 nt, Homo sapiens
gguguccccgagccuca

SEQ ID NO: 4625 - RNA, 17 nt, Homo sapiens
ccccgagccucagauca

SEQ ID NO: 4626 - RNA, 17 nt, Homo sapiens
cccgagccucagaucac

SEQ ID NO: 4627 - RNA, 17 nt, Homo sapiens
cgagccucagaucacuu

SEQ ID NO: 4628 - RNA, 17 nt, Homo sapiens
cucagaucacuugguuu

SEQ ID NO: 4629 - RNA, 17 nt, Homo sapiens
cagaucacuugguuuaa

SEQ ID NO: 4630 - RNA, 17 nt, Homo sapiens
uuaaaaacaaccacaaa

SEQ ID NO: 4631 - RNA, 17 nt, Homo sapiens
aaaacaaccacaaaaua

SEQ ID NO: 4632 - RNA, 17 nt, Homo sapiens
aaacaaccacaaaauac

SEQ ID NO: 4633 - RNA, 17 nt, Homo sapiens
acaaccacaaaauacaa

SEQ ID NO: 4634 - RNA, 17 nt, Homo sapiens
caaaauacaacaagagc

SEQ ID NO: 4635 - RNA, 17 nt, Homo sapiens
aauacaacaagagccug

SEQ ID NO: 4636 - RNA, 17 nt, Homo sapiens
acaagagccuggaauua

SEQ ID NO: 4637 - RNA, 17 nt, Homo sapiens
caagagccuggaauuau

SEQ ID NO: 4638 - RNA, 17 nt, Homo sapiens
uuuaggaccaggaagca

SEQ ID NO: 4639 - RNA, 17 nt, Homo sapiens
uuaggaccaggaagcag

SEQ ID NO: 4640 - RNA, 17 nt, Homo sapiens
caggaagcagcacgcug

SEQ ID NO: 4641 - RNA, 17 nt, Homo sapiens
gaagcagcacgcuguuu

SEQ ID NO: 4642 - RNA, 17 nt, Homo sapiens
cagcacgcuguuuauug

SEQ ID NO: 4643 - RNA, 17 nt, Homo sapiens
aaagagucacagaagag

SEQ ID NO: 4644 - RNA, 17 nt, Homo sapiens
agagucacagaagagga

SEQ ID NO: 4645 - RNA, 17 nt, Homo sapiens
aaggugucuaucacugc

SEQ ID NO: 4646 - RNA, 17 nt, Homo sapiens
ugucuaucacugcaaag

SEQ ID NO: 4647 - RNA, 17 nt, Homo sapiens
ucuaucacugcaaagcc

SEQ ID NO: 4648 - RNA, 17 nt, Homo sapiens
aucacugcaaagccacc

SEQ ID NO: 4649 - RNA, 17 nt, Homo sapiens
ugcaaagccaccaacca

SEQ ID NO: 4650 - RNA, 17 nt, Homo sapiens
gcaaagccaccaaccag

SEQ ID NO: 4651 - RNA, 17 nt, Homo sapiens
aaagccaccaaccagaa

SEQ ID NO: 4652 - RNA, 17 nt, Homo sapiens
aagccaccaaccagaag

SEQ ID NO: 4653 - RNA, 17 nt, Homo sapiens
ccaccaaccagaagggc

SEQ ID NO: 4654 - RNA, 17 nt, Homo sapiens
caccaaccagaagggcu

SEQ ID NO: 4655 - RNA, 17 nt, Homo sapiens
agaagggcucuguggaa

SEQ ID NO: 4656 - RNA, 17 nt, Homo sapiens
aagggcucuguggaaag

SEQ ID NO: 4657 - RNA, 17 nt, Homo sapiens
gaaaguucagcauaccu

SEQ ID NO: 4658 - RNA, 17 nt, Homo sapiens
aguucagcauaccucac

SEQ ID NO: 4659 - RNA, 17 nt, Homo sapiens
cagcauaccucacuguu

SEQ ID NO: 4660 - RNA, 17 nt, Homo sapiens
agcauaccucacuguuc

SEQ ID NO: 4661 - RNA, 17 nt, Homo sapiens
cauaccucacuguucaa

SEQ ID NO: 4662 - RNA, 17 nt, Homo sapiens
uaccucacuguucaagg

SEQ ID NO: 4663 - RNA, 17 nt, Homo sapiens
cacuguucaaggaaccu

SEQ ID NO: 4664 - RNA, 17 nt, Homo sapiens
caaggaaccucggacaa

SEQ ID NO: 4665 - RNA, 17 nt, Homo sapiens
aaggaaccucggacaag

SEQ ID NO: 4666 - RNA, 17 nt, Homo sapiens
ccucggacaagucuaau

SEQ ID NO: 4667 - RNA, 17 nt, Homo sapiens
gacaagucuaaucugga

SEQ ID NO: 4668 - RNA, 17 nt, Homo sapiens
gucuaaucuggagcuga

SEQ ID NO: 4669 - RNA, 17 nt, Homo sapiens
ucuggagcugaucacuc

SEQ ID NO: 4670 - RNA, 17 nt, Homo sapiens
agcugaucacucuaaca

SEQ ID NO: 4671 - RNA, 17 nt, Homo sapiens
cugaucacucuaacaug

SEQ ID NO: 4672 - RNA, 17 nt, Homo sapiens
gaucacucuaacaugca

SEQ ID NO: 4673 - RNA, 17 nt, Homo sapiens
acucuaacaugcaccug

SEQ ID NO: 4674 - RNA, 17 nt, Homo sapiens
uaacaugcaccugugug

SEQ ID NO: 4675 - RNA, 17 nt, Homo sapiens
acaugcaccuguguggc

SEQ ID NO: 4676 - RNA, 17 nt, Homo sapiens
caugcaccuguguggcu

SEQ ID NO: 4677 - RNA, 17 nt, Homo sapiens
uguguggcugcgacucu

SEQ ID NO: 4678 - RNA, 17 nt, Homo sapiens
gcugcgacucucuucug

SEQ ID NO: 4679 - RNA, 17 nt, Homo sapiens
ugcgacucucuucuggc

SEQ ID NO: 4680 - RNA, 17 nt, Homo sapiens
cgacucucuucuggcuc

SEQ ID NO: 4681 - RNA, 17 nt, Homo sapiens
cucucuucuggcuccua

SEQ ID NO: 4682 - RNA, 17 nt, Homo sapiens
cuucuggcuccuauuaa

SEQ ID NO: 4683 - RNA, 17 nt, Homo sapiens
ucuggcuccuauuaacc

SEQ ID NO: 4684 - RNA, 17 nt, Homo sapiens
cuggcuccuauuaaccc

SEQ ID NO: 4685 - RNA, 17 nt, Homo sapiens
cuauuaacccuccuuau

SEQ ID NO: 4686 - RNA, 17 nt, Homo sapiens
uauuaacccuccuuauc

SEQ ID NO: 4687 - RNA, 17 nt, Homo sapiens
auuaacccuccuuaucc

SEQ ID NO: 4688 - RNA, 17 nt, Homo sapiens
uaacccuccuuauccga

SEQ ID NO: 4689 - RNA, 17 nt, Homo sapiens
aacccuccuuauccgaa

SEQ ID NO: 4690 - RNA, 17 nt, Homo sapiens
uccuuauccgaaaaaug

SEQ ID NO: 4691 - RNA, 17 nt, Homo sapiens
aaaaggucuucuucuga

SEQ ID NO: 4692 - RNA, 17 nt, Homo sapiens
aggucuucuucugaaau

SEQ ID NO: 4693 - RNA, 17 nt, Homo sapiens
ucuucuucugaaauaaa

SEQ ID NO: 4694 - RNA, 17 nt, Homo sapiens
auaaagacugacuaccu

SEQ ID NO: 4695 - RNA, 17 nt, Homo sapiens
agacugacuaccuauca

SEQ ID NO: 4696 - RNA, 17 nt, Homo sapiens
cugacuaccuaucaauu

SEQ ID NO: 4697 - RNA, 17 nt, Homo sapiens
ugacuaccuaucaauua

SEQ ID NO: 4698 - RNA, 17 nt, Homo sapiens
uaccuaucaauuauaau

SEQ ID NO: 4699 - RNA, 17 nt, Homo sapiens
uaauggacccagaugaa

SEQ ID NO: 4700 - RNA, 17 nt, Homo sapiens
aauggacccagaugaag

SEQ ID NO: 4701 - RNA, 17 nt, Homo sapiens
auggacccagaugaagu

SEQ ID NO: 4702 - RNA, 17 nt, Homo sapiens
ugaaguuccuuuggaug

SEQ ID NO: 4703 - RNA, 17 nt, Homo sapiens
gaaguuccuuuggauga

SEQ ID NO: 4704 - RNA, 17 nt, Homo sapiens
ggaugagcagugugagc

SEQ ID NO: 4705 - RNA, 17 nt, Homo sapiens
ugagcggcucccuuaug

SEQ ID NO: 4706 - RNA, 17 nt, Homo sapiens
agcggcucccuuaugau

SEQ ID NO: 4707 - RNA, 17 nt, Homo sapiens
gcggcucccuuaugaug

SEQ ID NO: 4708 - RNA, 17 nt, Homo sapiens
cggcucccuuaugaugc

SEQ ID NO: 4709 - RNA, 17 nt, Homo sapiens
uaugaugccagcaagug

SEQ ID NO: 4710 - RNA, 17 nt, Homo sapiens
augaugccagcaagugg

SEQ ID NO: 4711 - RNA, 17 nt, Homo sapiens
augccagcaagugggag

SEQ ID NO: 4712 - RNA, 17 nt, Homo sapiens
gaguuugcccgggagag

SEQ ID NO: 4713 - RNA, 17 nt, Homo sapiens
aguuugcccgggagaga

SEQ ID NO: 4714 - RNA, 17 nt, Homo sapiens
ggagagacuuaaacugg

SEQ ID NO: 4715 - RNA, 17 nt, Homo sapiens
acuuaaacugggcaaau

SEQ ID NO: 4716 - RNA, 17 nt, Homo sapiens
aacugggcaaaucacuu

SEQ ID NO: 4717 - RNA, 17 nt, Homo sapiens
ggcaaaucacuuggaag

SEQ ID NO: 4718 - RNA, 17 nt, Homo sapiens
caaaucacuuggaagag

SEQ ID NO: 4719 - RNA, 17 nt, Homo sapiens
agaggggcuuuuggaaa

SEQ ID NO: 4720 - RNA, 17 nt, Homo sapiens
agugguucaagcaucag

SEQ ID NO: 4721 - RNA, 17 nt, Homo sapiens
guucaagcaucagcauu

SEQ ID NO: 4722 - RNA, 17 nt, Homo sapiens
caagcaucagcauuugg

SEQ ID NO: 4723 - RNA, 17 nt, Homo sapiens
gcaucagcauuuggcau

SEQ ID NO: 4724 - RNA, 17 nt, Homo sapiens
cauuuggcauuaagaaa

SEQ ID NO: 4725 - RNA, 17 nt, Homo sapiens
aagaaaucaccuacgug

SEQ ID NO: 4726 - RNA, 17 nt, Homo sapiens
gaaaucaccuacgugcc

SEQ ID NO: 4727 - RNA, 17 nt, Homo sapiens
aaaucaccuacgugccg

SEQ ID NO: 4728 - RNA, 17 nt, Homo sapiens
cuacgugccggacugug

SEQ ID NO: 4729 - RNA, 17 nt, Homo sapiens
ugccggacuguggcugu

SEQ ID NO: 4730 - RNA, 17 nt, Homo sapiens
acuguggcugugaaaau

SEQ ID NO: 4731 - RNA, 17 nt, Homo sapiens
gaaaaugcugaaagagg

SEQ ID NO: 4732 - RNA, 17 nt, Homo sapiens
gagggggccacggccag

SEQ ID NO: 4733 - RNA, 17 nt, Homo sapiens
agggggccacggccagc

SEQ ID NO: 4734 - RNA, 17 nt, Homo sapiens
gccacggccagcgagua

SEQ ID NO: 4735 - RNA, 17 nt, Homo sapiens
ccacggccagcgaguac

SEQ ID NO: 4736 - RNA, 17 nt, Homo sapiens
gcgaguacaaagcucug

SEQ ID NO: 4737 - RNA, 17 nt, Homo sapiens
uacaaagcucugaugac

SEQ ID NO: 4738 - RNA, 17 nt, Homo sapiens
caaagcucugaugacug

SEQ ID NO: 4739 - RNA, 17 nt, Homo sapiens
cugaugacugagcuaaa

SEQ ID NO: 4740 - RNA, 17 nt, Homo sapiens
gacugagcuaaaaaucu

SEQ ID NO: 4741 - RNA, 17 nt, Homo sapiens
uaaaaaucuugacccac

SEQ ID NO: 4742 - RNA, 17 nt, Homo sapiens
aucuugacccacauugg

SEQ ID NO: 4743 - RNA, 17 nt, Homo sapiens
ucuugacccacauuggc

SEQ ID NO: 4744 - RNA, 17 nt, Homo sapiens
cuugacccacauuggcc

SEQ ID NO: 4745 - RNA, 17 nt, Homo sapiens
ugacccacauuggccac

SEQ ID NO: 4746 - RNA, 17 nt, Homo sapiens
acauuggccaccaucug

SEQ ID NO: 4747 - RNA, 17 nt, Homo sapiens
cauuggccaccaucuga

SEQ ID NO: 4748 - RNA, 17 nt, Homo sapiens
uuggccaccaucugaac

SEQ ID NO: 4749 - RNA, 17 nt, Homo sapiens
uggccaccaucugaacg

SEQ ID NO: 4750 - RNA, 17 nt, Homo sapiens
ccaccaucugaacgugg

SEQ ID NO: 4751 - RNA, 17 nt, Homo sapiens
ugguuaaccugcuggga

SEQ ID NO: 4752 - RNA, 17 nt, Homo sapiens
gguuaaccugcugggag

SEQ ID NO: 4753 - RNA, 17 nt, Homo sapiens
uaaccugcugggagccu

SEQ ID NO: 4754 - RNA, 17 nt, Homo sapiens
cugggagccugcaccaa

SEQ ID NO: 4755 - RNA, 17 nt, Homo sapiens
ugggagccugcaccaag

SEQ ID NO: 4756 - RNA, 17 nt, Homo sapiens
gagccugcaccaagcaa

SEQ ID NO: 4757 - RNA, 17 nt, Homo sapiens
gccugcaccaagcaagg

SEQ ID NO: 4758 - RNA, 17 nt, Homo sapiens
ccugcaccaagcaagga

SEQ ID NO: 4759 - RNA, 17 nt, Homo sapiens
caccaagcaaggagggc

SEQ ID NO: 4760 - RNA, 17 nt, Homo sapiens
aggagggccucugaugg

SEQ ID NO: 4761 - RNA, 17 nt, Homo sapiens
ggagggccucugauggu

SEQ ID NO: 4762 - RNA, 17 nt, Homo sapiens
agggccucugaugguga

SEQ ID NO: 4763 - RNA, 17 nt, Homo sapiens
uugaauacugcaaauau

SEQ ID NO: 4764 - RNA, 17 nt, Homo sapiens
aauacugcaaauaugga

SEQ ID NO: 4765 - RNA, 17 nt, Homo sapiens
uggaaaucucuccaacu

SEQ ID NO: 4766 - RNA, 17 nt, Homo sapiens
gaaaucucuccaacuac

SEQ ID NO: 4767 - RNA, 17 nt, Homo sapiens
aaucucuccaacuaccu

SEQ ID NO: 4768 - RNA, 17 nt, Homo sapiens
aucucuccaacuaccuc

SEQ ID NO: 4769 - RNA, 17 nt, Homo sapiens
ucuccaacuaccucaag

SEQ ID NO: 4770 - RNA, 17 nt, Homo sapiens
ccaacuaccucaagagc

SEQ ID NO: 4771 - RNA, 17 nt, Homo sapiens
caacuaccucaagagca

SEQ ID NO: 4772 - RNA, 17 nt, Homo sapiens
acuaccucaagagcaaa

SEQ ID NO: 4773 - RNA, 17 nt, Homo sapiens
ucaagagcaaacgugac

SEQ ID NO: 4774 - RNA, 17 nt, Homo sapiens
aacgugacuuauuuuuu

SEQ ID NO: 4775 - RNA, 17 nt, Homo sapiens
auuuuuucucaacaagg

SEQ ID NO: 4776 - RNA, 17 nt, Homo sapiens
uuuuucucaacaaggau

SEQ ID NO: 4777 - RNA, 17 nt, Homo sapiens
uucucaacaaggaugca

SEQ ID NO: 4778 - RNA, 17 nt, Homo sapiens
aaggaugcagcacuaca

SEQ ID NO: 4779 - RNA, 17 nt, Homo sapiens
gaugcagcacuacacau

SEQ ID NO: 4780 - RNA, 17 nt, Homo sapiens
ugcagcacuacacaugg

SEQ ID NO: 4781 - RNA, 17 nt, Homo sapiens
agcacuacacauggagc

SEQ ID NO: 4782 - RNA, 17 nt, Homo sapiens
cacuacacauggagccu

SEQ ID NO: 4783 - RNA, 17 nt, Homo sapiens
cauggagccuaagaaag

SEQ ID NO: 4784 - RNA, 17 nt, Homo sapiens
auggagccuaagaaaga

SEQ ID NO: 4785 - RNA, 17 nt, Homo sapiens
aauggagccaggccugg

SEQ ID NO: 4786 - RNA, 17 nt, Homo sapiens
auggagccaggccugga

SEQ ID NO: 4787 - RNA, 17 nt, Homo sapiens
agccaggccuggaacaa

SEQ ID NO: 4788 - RNA, 17 nt, Homo sapiens
gccaggccuggaacaag

SEQ ID NO: 4789 - RNA, 17 nt, Homo sapiens
ccuggaacaaggcaaga

SEQ ID NO: 4790 - RNA, 17 nt, Homo sapiens
aacaaggcaagaaacca

SEQ ID NO: 4791 - RNA, 17 nt, Homo sapiens
caagaaaccaagacuag

SEQ ID NO: 4792 - RNA, 17 nt, Homo sapiens
aagaaaccaagacuaga

SEQ ID NO: 4793 - RNA, 17 nt, Homo sapiens
accaagacuagauagcg

SEQ ID NO: 4794 - RNA, 17 nt, Homo sapiens
auagcgucaccagcagc

SEQ ID NO: 4795 - RNA, 17 nt, Homo sapiens
agcgucaccagcagcga

SEQ ID NO: 4796 - RNA, 17 nt, Homo sapiens
gcgucaccagcagcgaa

SEQ ID NO: 4797 - RNA, 17 nt, Homo sapiens
ucaccagcagcgaaagc

SEQ ID NO: 4798 - RNA, 17 nt, Homo sapiens
gcgaaagcuuugcgagc

SEQ ID NO: 4799 - RNA, 17 nt, Homo sapiens
uugcgagcuccggcuuu

SEQ ID NO: 4800 - RNA, 17 nt, Homo sapiens
gcgagcuccggcuuuca

SEQ ID NO: 4801 - RNA, 17 nt, Homo sapiens
gcuccggcuuucaggaa

SEQ ID NO: 4802 - RNA, 17 nt, Homo sapiens
cggcuuucaggaagaua

SEQ ID NO: 4803 - RNA, 17 nt, Homo sapiens
uaaaagucugagugaug

SEQ ID NO: 4804 - RNA, 17 nt, Homo sapiens
gaggauucugacgguuu

SEQ ID NO: 4805 - RNA, 17 nt, Homo sapiens
acgguuucuacaaggag

SEQ ID NO: 4806 - RNA, 17 nt, Homo sapiens
guuucuacaaggagccc

SEQ ID NO: 4807 - RNA, 17 nt, Homo sapiens
caaggagcccaucacua

SEQ ID NO: 4808 - RNA, 17 nt, Homo sapiens
aaggagcccaucacuau

SEQ ID NO: 4809 - RNA, 17 nt, Homo sapiens
aggagcccaucacuaug

SEQ ID NO: 4810 - RNA, 17 nt, Homo sapiens
agcccaucacuauggaa

SEQ ID NO: 4811 - RNA, 17 nt, Homo sapiens
cccaucacuauggaaga

SEQ ID NO: 4812 - RNA, 17 nt, Homo sapiens
ggaagaucugauuucuu

SEQ ID NO: 4813 - RNA, 17 nt, Homo sapiens
cugauuucuuacaguuu

SEQ ID NO: 4814 - RNA, 17 nt, Homo sapiens
uuucuuacaguuuucaa

SEQ ID NO: 4815 - RNA, 17 nt, Homo sapiens
caguuuucaaguggcca

SEQ ID NO: 4816 - RNA, 17 nt, Homo sapiens
caaguggccagaggcau

SEQ ID NO: 4817 - RNA, 17 nt, Homo sapiens
aaguggccagaggcaug

SEQ ID NO: 4818 - RNA, 17 nt, Homo sapiens
ccagaggcauggaguuc

SEQ ID NO: 4819 - RNA, 17 nt, Homo sapiens
uggaguuccugucuucc

SEQ ID NO: 4820 - RNA, 17 nt, Homo sapiens
ggaguuccugucuucca

SEQ ID NO: 4821 - RNA, 17 nt, Homo sapiens
uuccugucuuccagaaa

SEQ ID NO: 4822 - RNA, 17 nt, Homo sapiens
cugucuuccagaaagug

SEQ ID NO: 4823 - RNA, 17 nt, Homo sapiens
ugucuuccagaaagugc

SEQ ID NO: 4824 - RNA, 17 nt, Homo sapiens
gaaagugcauucaucgg

SEQ ID NO: 4825 - RNA, 17 nt, Homo sapiens
gugcauucaucgggacc

SEQ ID NO: 4826 - RNA, 17 nt, Homo sapiens
aucgggaccuggcagcg

SEQ ID NO: 4827 - RNA, 17 nt, Homo sapiens
ucgggaccuggcagcga

SEQ ID NO: 4828 - RNA, 17 nt, Homo sapiens
gaccuggcagcgagaaa

SEQ ID NO: 4829 - RNA, 17 nt, Homo sapiens
cgagaaacauucuuuua

SEQ ID NO: 4830 - RNA, 17 nt, Homo sapiens
aaacauucuuuuaucug

SEQ ID NO: 4831 - RNA, 17 nt, Homo sapiens
cuuuuaucugagaacaa

SEQ ID NO: 4832 - RNA, 17 nt, Homo sapiens
cugagaacaacguggug

SEQ ID NO: 4833 - RNA, 17 nt, Homo sapiens
auuuuggccuugcccgg

SEQ ID NO: 4834 - RNA, 17 nt, Homo sapiens
uuuuggccuugcccggg

SEQ ID NO: 4835 - RNA, 17 nt, Homo sapiens
ggccuugcccgggauau

SEQ ID NO: 4836 - RNA, 17 nt, Homo sapiens
gccuugcccgggauauu

SEQ ID NO: 4837 - RNA, 17 nt, Homo sapiens
auaagaaccccgauuau

SEQ ID NO: 4838 - RNA, 17 nt, Homo sapiens
uaagaaccccgauuaug

SEQ ID NO: 4839 - RNA, 17 nt, Homo sapiens
aagaaccccgauuaugu

SEQ ID NO: 4840 - RNA, 17 nt, Homo sapiens
ggagauacucgacuucc

SEQ ID NO: 4841 - RNA, 17 nt, Homo sapiens
uacucgacuuccucuga

SEQ ID NO: 4842 - RNA, 17 nt, Homo sapiens
ucgacuuccucugaaau

SEQ ID NO: 4843 - RNA, 17 nt, Homo sapiens
cgacuuccucugaaaug

SEQ ID NO: 4844 - RNA, 17 nt, Homo sapiens
acuuccucugaaaugga

SEQ ID NO: 4845 - RNA, 17 nt, Homo sapiens
uggauggcucccgaauc

SEQ ID NO: 4846 - RNA, 17 nt, Homo sapiens
gauggcucccgaaucua

SEQ ID NO: 4847 - RNA, 17 nt, Homo sapiens
auggcucccgaaucuau

SEQ ID NO: 4848 - RNA, 17 nt, Homo sapiens
cccgaaucuaucuuuga

SEQ ID NO: 4849 - RNA, 17 nt, Homo sapiens
aaucuaucuuugacaaa

SEQ ID NO: 4850 - RNA, 17 nt, Homo sapiens
ucuuugacaaaaucuac

SEQ ID NO: 4851 - RNA, 17 nt, Homo sapiens
acaaaaucuacagcacc

SEQ ID NO: 4852 - RNA, 17 nt, Homo sapiens
aaaucuacagcaccaag

SEQ ID NO: 4853 - RNA, 17 nt, Homo sapiens
ucuacagcaccaagagc

SEQ ID NO: 4854 - RNA, 17 nt, Homo sapiens
uacagcaccaagagcga

SEQ ID NO: 4855 - RNA, 17 nt, Homo sapiens
acagcaccaagagcgac

SEQ ID NO: 4856 - RNA, 17 nt, Homo sapiens
guguggucuuacggagu

SEQ ID NO: 4857 - RNA, 17 nt, Homo sapiens
aguauugcugugggaaa

SEQ ID NO: 4858 - RNA, 17 nt, Homo sapiens
gggaaaucuucuccuua

SEQ ID NO: 4859 - RNA, 17 nt, Homo sapiens
aaaucuucuccuuaggu

SEQ ID NO: 4860 - RNA, 17 nt, Homo sapiens
aucuucuccuuaggugg

SEQ ID NO: 4861 - RNA, 17 nt, Homo sapiens
ucuucuccuuagguggg

SEQ ID NO: 4862 - RNA, 17 nt, Homo sapiens
ggugggucuccauaccc

SEQ ID NO: 4863 - RNA, 17 nt, Homo sapiens
ugggucuccauacccag

SEQ ID NO: 4864 - RNA, 17 nt, Homo sapiens
gggucuccauacccagg

SEQ ID NO: 4865 - RNA, 17 nt, Homo sapiens
cuccauacccaggagua

SEQ ID NO: 4866 - RNA, 17 nt, Homo sapiens
uccauacccaggaguac

SEQ ID NO: 4867 - RNA, 17 nt, Homo sapiens
ccauacccaggaguaca

SEQ ID NO: 4868 - RNA, 17 nt, Homo sapiens
aggaguacaaauggaug

SEQ ID NO: 4869 - RNA, 17 nt, Homo sapiens
augaggacuuuugcagu

SEQ ID NO: 4870 - RNA, 17 nt, Homo sapiens
acuuuugcagucgccug

SEQ ID NO: 4871 - RNA, 17 nt, Homo sapiens
gcagucgccugagggaa

SEQ ID NO: 4872 - RNA, 17 nt, Homo sapiens
cagucgccugagggaag

SEQ ID NO: 4873 - RNA, 17 nt, Homo sapiens
gggaaggcaugaggaug

SEQ ID NO: 4874 - RNA, 17 nt, Homo sapiens
augagagcuccugagua

SEQ ID NO: 4875 - RNA, 17 nt, Homo sapiens
gagagcuccugaguacu

SEQ ID NO: 4876 - RNA, 17 nt, Homo sapiens
agagcuccugaguacuc

SEQ ID NO: 4877 - RNA, 17 nt, Homo sapiens
cugaguacucuacuccu

SEQ ID NO: 4878 - RNA, 17 nt, Homo sapiens
gaguacucuacuccuga

SEQ ID NO: 4879 - RNA, 17 nt, Homo sapiens
uacucuacuccugaaau

SEQ ID NO: 4880 - RNA, 17 nt, Homo sapiens
cucuacuccugaaaucu

SEQ ID NO: 4881 - RNA, 17 nt, Homo sapiens
ucuacuccugaaaucua

SEQ ID NO: 4882 - RNA, 17 nt, Homo sapiens
cugaaaucuaucagauc

SEQ ID NO: 4883 - RNA, 17 nt, Homo sapiens
aaucuaucagaucaugc

SEQ ID NO: 4884 - RNA, 17 nt, Homo sapiens
aucagaucaugcuggac

SEQ ID NO: 4885 - RNA, 17 nt, Homo sapiens
gaucaugcuggacugcu

SEQ ID NO: 4886 - RNA, 17 nt, Homo sapiens
ugcuggacugcuggcac

SEQ ID NO: 4887 - RNA, 17 nt, Homo sapiens
uggacugcuggcacaga

SEQ ID NO: 4888 - RNA, 17 nt, Homo sapiens
cugcuggcacagagacc

SEQ ID NO: 4889 - RNA, 17 nt, Homo sapiens
gcuggcacagagaccca

SEQ ID NO: 4890 - RNA, 17 nt, Homo sapiens
acagagacccaaaagaa

SEQ ID NO: 4891 - RNA, 17 nt, Homo sapiens
cagagacccaaaagaaa

SEQ ID NO: 4892 - RNA, 17 nt, Homo sapiens
agagacccaaaagaaag

SEQ ID NO: 4893 - RNA, 17 nt, Homo sapiens
agaaaggccaagauuug

SEQ ID NO: 4894 - RNA, 17 nt, Homo sapiens
gaaaggccaagauuugc

SEQ ID NO: 4895 - RNA, 17 nt, Homo sapiens
agauuugcagaacuugu

SEQ ID NO: 4896 - RNA, 17 nt, Homo sapiens
ugcagaacuuguggaaa

SEQ ID NO: 4897 - RNA, 17 nt, Homo sapiens
ggaaaaacuaggugauu

SEQ ID NO: 4898 - RNA, 17 nt, Homo sapiens
ugauuugcuucaagcaa

SEQ ID NO: 4899 - RNA, 17 nt, Homo sapiens
uuugcuucaagcaaaug

SEQ ID NO: 4900 - RNA, 17 nt, Homo sapiens
cuucaagcaaauguaca

SEQ ID NO: 4901 - RNA, 17 nt, Homo sapiens
aaauguacaacaggaug

SEQ ID NO: 4902 - RNA, 17 nt, Homo sapiens
uguacaacaggauggua

SEQ ID NO: 4903 - RNA, 17 nt, Homo sapiens
guaaagacuacauccca

SEQ ID NO: 4904 - RNA, 17 nt, Homo sapiens
aagacuacaucccaauc

SEQ ID NO: 4905 - RNA, 17 nt, Homo sapiens
acuacaucccaaucaau

SEQ ID NO: 4906 - RNA, 17 nt, Homo sapiens
cuacaucccaaucaaug

SEQ ID NO: 4907 - RNA, 17 nt, Homo sapiens
uacaucccaaucaaugc

SEQ ID NO: 4908 - RNA, 17 nt, Homo sapiens
ucccaaucaaugccaua

SEQ ID NO: 4909 - RNA, 17 nt, Homo sapiens
aucaaugccauacugac

SEQ ID NO: 4910 - RNA, 17 nt, Homo sapiens
ucaaugccauacugaca

SEQ ID NO: 4911 - RNA, 17 nt, Homo sapiens
ugccauacugacaggaa

SEQ ID NO: 4912 - RNA, 17 nt, Homo sapiens
auacugacaggaaauag

SEQ ID NO: 4913 - RNA, 17 nt, Homo sapiens
ggguuuacauacucaac

SEQ ID NO: 4914 - RNA, 17 nt, Homo sapiens
uuacauacucaacuccu

SEQ ID NO: 4915 - RNA, 17 nt, Homo sapiens
acauacucaacuccugc

SEQ ID NO: 4916 - RNA, 17 nt, Homo sapiens
uacucaacuccugccuu

SEQ ID NO: 4917 - RNA, 17 nt, Homo sapiens
cucaacuccugccuucu

SEQ ID NO: 4918 - RNA, 17 nt, Homo sapiens
ucaacuccugccuucuc

SEQ ID NO: 4919 - RNA, 17 nt, Homo sapiens
acuccugccuucucuga

SEQ ID NO: 4920 - RNA, 17 nt, Homo sapiens
cuccugccuucucugag

SEQ ID NO: 4921 - RNA, 17 nt, Homo sapiens
cugccuucucugaggac

SEQ ID NO: 4922 - RNA, 17 nt, Homo sapiens
gccuucucugaggacuu

SEQ ID NO: 4923 - RNA, 17 nt, Homo sapiens
cugaggacuucuucaag

SEQ ID NO: 4924 - RNA, 17 nt, Homo sapiens
aggacuucuucaaggaa

SEQ ID NO: 4925 - RNA, 17 nt, Homo sapiens
acuucuucaaggaaagu

SEQ ID NO: 4926 - RNA, 17 nt, Homo sapiens
aguauuucagcuccgaa

SEQ ID NO: 4927 - RNA, 17 nt, Homo sapiens
auuucagcuccgaaguu

SEQ ID NO: 4928 - RNA, 17 nt, Homo sapiens
uucagcuccgaaguuua

SEQ ID NO: 4929 - RNA, 17 nt, Homo sapiens
uuuaauucaggaagcuc

SEQ ID NO: 4930 - RNA, 17 nt, Homo sapiens
caggaagcucugaugau

SEQ ID NO: 4931 - RNA, 17 nt, Homo sapiens
ggaagcucugaugaugu

SEQ ID NO: 4932 - RNA, 17 nt, Homo sapiens
augaugucagauaugua

SEQ ID NO: 4933 - RNA, 17 nt, Homo sapiens
guaaaugcuuucaaguu

SEQ ID NO: 4934 - RNA, 17 nt, Homo sapiens
augcuuucaaguucaug

SEQ ID NO: 4935 - RNA, 17 nt, Homo sapiens
ucaaguucaugagccug

SEQ ID NO: 4936 - RNA, 17 nt, Homo sapiens
ucaugagccuggaaaga

SEQ ID NO: 4937 - RNA, 17 nt, Homo sapiens
caugagccuggaaagaa

SEQ ID NO: 4938 - RNA, 17 nt, Homo sapiens
aaagaaucaaaaccuuu

SEQ ID NO: 4939 - RNA, 17 nt, Homo sapiens
aucaaaaccuuugaaga

SEQ ID NO: 4940 - RNA, 17 nt, Homo sapiens
ucaaaaccuuugaagaa

SEQ ID NO: 4941 - RNA, 17 nt, Homo sapiens
ugaagaacuuuuaccga

SEQ ID NO: 4942 - RNA, 17 nt, Homo sapiens
acuuuuaccgaaugcca

SEQ ID NO: 4943 - RNA, 17 nt, Homo sapiens
ccgaaugccaccuccau

SEQ ID NO: 4944 - RNA, 17 nt, Homo sapiens
cgaaugccaccuccaug

SEQ ID NO: 4945 - RNA, 17 nt, Homo sapiens
aaugccaccuccauguu

SEQ ID NO: 4946 - RNA, 17 nt, Homo sapiens
augccaccuccauguuu

SEQ ID NO: 4947 - RNA, 17 nt, Homo sapiens
gccaccuccauguuuga

SEQ ID NO: 4948 - RNA, 17 nt, Homo sapiens
ccaccuccauguuugau

SEQ ID NO: 4949 - RNA, 17 nt, Homo sapiens
uugaugacuaccagggc

SEQ ID NO: 4950 - RNA, 17 nt, Homo sapiens
augacuaccagggcgac

SEQ ID NO: 4951 - RNA, 17 nt, Homo sapiens
ugacuaccagggcgaca

SEQ ID NO: 4952 - RNA, 17 nt, Homo sapiens
agggcgacagcagcacu

SEQ ID NO: 4953 - RNA, 17 nt, Homo sapiens
gcgacagcagcacucug

SEQ ID NO: 4954 - RNA, 17 nt, Homo sapiens
acagcagcacucuguug

SEQ ID NO: 4955 - RNA, 17 nt, Homo sapiens
agcagcacucuguuggc

SEQ ID NO: 4956 - RNA, 17 nt, Homo sapiens
cagcacucuguuggccu

SEQ ID NO: 4957 - RNA, 17 nt, Homo sapiens
cuguuggccucucccau

SEQ ID NO: 4958 - RNA, 17 nt, Homo sapiens
uguuggccucucccaug

SEQ ID NO: 4959 - RNA, 17 nt, Homo sapiens
uuggccucucccaugcu

SEQ ID NO: 4960 - RNA, 17 nt, Homo sapiens
ggccucucccaugcuga

SEQ ID NO: 4961 - RNA, 17 nt, Homo sapiens
gccucucccaugcugaa

SEQ ID NO: 4962 - RNA, 17 nt, Homo sapiens
ccucucccaugcugaag

SEQ ID NO: 4963 - RNA, 17 nt, Homo sapiens
ucccaugcugaagcgcu

SEQ ID NO: 4964 - RNA, 17 nt, Homo sapiens
ugaagcgcuucaccugg

SEQ ID NO: 4965 - RNA, 17 nt, Homo sapiens
agcgcuucaccuggacu

SEQ ID NO: 4966 - RNA, 17 nt, Homo sapiens
cgcuucaccuggacuga

SEQ ID NO: 4967 - RNA, 17 nt, Homo sapiens
gcuucaccuggacugac

SEQ ID NO: 4968 - RNA, 17 nt, Homo sapiens
accuggacugacagcaa

SEQ ID NO: 4969 - RNA, 17 nt, Homo sapiens
ggacugacagcaaaccc

SEQ ID NO: 4970 - RNA, 17 nt, Homo sapiens
cugacagcaaacccaag

SEQ ID NO: 4971 - RNA, 17 nt, Homo sapiens
cagcaaacccaaggccu

SEQ ID NO: 4972 - RNA, 17 nt, Homo sapiens
agcaaacccaaggccuc

SEQ ID NO: 4973 - RNA, 17 nt, Homo sapiens
gcaaacccaaggccucg

SEQ ID NO: 4974 - RNA, 17 nt, Homo sapiens
cccaaggccucgcucaa

SEQ ID NO: 4975 - RNA, 17 nt, Homo sapiens
ccaaggccucgcucaag

SEQ ID NO: 4976 - RNA, 17 nt, Homo sapiens
ggccucgcucaagauug

SEQ ID NO: 4977 - RNA, 17 nt, Homo sapiens
ccucgcucaagauugac

SEQ ID NO: 4978 - RNA, 17 nt, Homo sapiens
agauugacuugagagua

SEQ ID NO: 4979 - RNA, 17 nt, Homo sapiens
agaguaaccaguaaaag

SEQ ID NO: 4980 - RNA, 17 nt, Homo sapiens
gaguaaccaguaaaagu

SEQ ID NO: 4981 - RNA, 17 nt, Homo sapiens
gucggggcugucugaug

SEQ ID NO: 4982 - RNA, 17 nt, Homo sapiens
gggcugucugaugucag

SEQ ID NO: 4983 - RNA, 17 nt, Homo sapiens
cugaugucagcaggccc

SEQ ID NO: 4984 - RNA, 17 nt, Homo sapiens
augucagcaggcccagu

SEQ ID NO: 4985 - RNA, 17 nt, Homo sapiens
cagcaggcccaguuucu

SEQ ID NO: 4986 - RNA, 17 nt, Homo sapiens
agcaggcccaguuucug

SEQ ID NO: 4987 - RNA, 17 nt, Homo sapiens
gcaggcccaguuucugc

SEQ ID NO: 4988 - RNA, 17 nt, Homo sapiens
ccaguuucugccauucc

SEQ ID NO: 4989 - RNA, 17 nt, Homo sapiens
guuucugccauuccagc

SEQ ID NO: 4990 - RNA, 17 nt, Homo sapiens
uuucugccauuccagcu

SEQ ID NO: 4991 - RNA, 17 nt, Homo sapiens
ugccauuccagcugugg

SEQ ID NO: 4992 - RNA, 17 nt, Homo sapiens
gccauuccagcuguggg

SEQ ID NO: 4993 - RNA, 17 nt, Homo sapiens
auuccagcugugggcac

SEQ ID NO: 4994 - RNA, 17 nt, Homo sapiens
cugugggcacgucagcg

SEQ ID NO: 4995 - RNA, 17 nt, Homo sapiens
ggcacgucagcgaaggc

SEQ ID NO: 4996 - RNA, 17 nt, Homo sapiens
gcgaaggcaagcgcagg

SEQ ID NO: 4997 - RNA, 17 nt, Homo sapiens
gcaagcgcagguucacc

SEQ ID NO: 4998 - RNA, 17 nt, Homo sapiens
gcagguucaccuacgac

SEQ ID NO: 4999 - RNA, 17 nt, Homo sapiens
agguucaccuacgacca

SEQ ID NO: 5000 - RNA, 17 nt, Homo sapiens
gguucaccuacgaccac

SEQ ID NO: 5001 - RNA, 17 nt, Homo sapiens
ccuacgaccacgcugag

SEQ ID NO: 5002 - RNA, 17 nt, Homo sapiens
cuacgaccacgcugagc

SEQ ID NO: 5003 - RNA, 17 nt, Homo sapiens
gaccacgcugagcugga

SEQ ID NO: 5004 - RNA, 17 nt, Homo sapiens
cgcugagcuggaaagga

SEQ ID NO: 5005 - RNA, 17 nt, Homo sapiens
ucgcgugcugcuccccg

SEQ ID NO: 5006 - RNA, 17 nt, Homo sapiens
cgugcugcuccccgccc

SEQ ID NO: 5007 - RNA, 17 nt, Homo sapiens
ugcugcuccccgccccc

SEQ ID NO: 5008 - RNA, 17 nt, Homo sapiens
gcugcuccccgccccca

SEQ ID NO: 5009 - RNA, 17 nt, Homo sapiens
cugcuccccgcccccag

SEQ ID NO: 5010 - RNA, 17 nt, Homo sapiens
cuccccgcccccagacu

SEQ ID NO: 5011 - RNA, 17 nt, Homo sapiens
uccccgcccccagacua

SEQ ID NO: 5012 - RNA, 17 nt, Homo sapiens
ccccgcccccagacuac

SEQ ID NO: 5013 - RNA, 17 nt, Homo sapiens
cccgcccccagacuaca

SEQ ID NO: 5014 - RNA, 17 nt, Homo sapiens
ccgcccccagacuacaa

SEQ ID NO: 5015 - RNA, 17 nt, Homo sapiens
ccccagacuacaacucg

SEQ ID NO: 5016 - RNA, 17 nt, Homo sapiens
cagacuacaacucggug

SEQ ID NO: 5017 - RNA, 17 nt, Homo sapiens
acuacaacucggugguc

SEQ ID NO: 5018 - RNA, 17 nt, Homo sapiens
cggugguccuguacucc

SEQ ID NO: 5019 - RNA, 17 nt, Homo sapiens
ggugguccuguacucca

SEQ ID NO: 5020 - RNA, 17 nt, Homo sapiens
uccuguacuccacccca

SEQ ID NO: 5021 - RNA, 17 nt, Homo sapiens
cuguacuccaccccacc

SEQ ID NO: 5022 - RNA, 17 nt, Homo sapiens
uguacuccaccccaccc

SEQ ID NO: 5023 - RNA, 17 nt, Homo sapiens
uacuccaccccacccau

SEQ ID NO: 5024 - RNA, 17 nt, Homo sapiens
acuccaccccacccauc

SEQ ID NO: 5025 - RNA, 17 nt, Homo sapiens
cuccaccccacccaucu

SEQ ID NO: 5026 - RNA, 17 nt, Homo sapiens
uccaccccacccaucua

SEQ ID NO: 5027 - RNA, 17 nt, Homo sapiens
caccccacccaucuaga

SEQ ID NO: 5028 - RNA, 17 nt, Homo sapiens
accccacccaucuagag

SEQ ID NO: 5029 - RNA, 17 nt, Homo sapiens
ccccacccaucuagagu

SEQ ID NO: 5030 - RNA, 17 nt, Homo sapiens
cacccaucuagaguuug

SEQ ID NO: 5031 - RNA, 17 nt, Homo sapiens
aguuugacacgaagccu

SEQ ID NO: 5032 - RNA, 17 nt, Homo sapiens
cacgaagccuuauuucu

SEQ ID NO: 5033 - RNA, 17 nt, Homo sapiens
acgaagccuuauuucua

SEQ ID NO: 5034 - RNA, 17 nt, Homo sapiens
cuuauuucuagaagcac

SEQ ID NO: 5035 - RNA, 17 nt, Homo sapiens
cuagaagcacaugugua

SEQ ID NO: 5036 - RNA, 17 nt, Homo sapiens
agaagcacauguguauu

SEQ ID NO: 5037 - RNA, 17 nt, Homo sapiens
auuuauacccccaggaa

SEQ ID NO: 5038 - RNA, 17 nt, Homo sapiens
uuuauacccccaggaaa

SEQ ID NO: 5039 - RNA, 17 nt, Homo sapiens
uuauacccccaggaaac

SEQ ID NO: 5040 - RNA, 17 nt, Homo sapiens
uauacccccaggaaacu

SEQ ID NO: 5041 - RNA, 17 nt, Homo sapiens
auacccccaggaaacua

SEQ ID NO: 5042 - RNA, 17 nt, Homo sapiens
caggaaacuagcuuuug

SEQ ID NO: 5043 - RNA, 17 nt, Homo sapiens
aaacuagcuuuugccag

SEQ ID NO: 5044 - RNA, 17 nt, Homo sapiens
gcuuuugccaguauuau

SEQ ID NO: 5045 - RNA, 17 nt, Homo sapiens
cuuuugccaguauuaug

SEQ ID NO: 5046 - RNA, 17 nt, Homo sapiens
uauuaugcauauauaag

SEQ ID NO: 5047 - RNA, 17 nt, Homo sapiens
aaguuuacaccuuuauc

SEQ ID NO: 5048 - RNA, 17 nt, Homo sapiens
guuuacaccuuuaucuu

SEQ ID NO: 5049 - RNA, 17 nt, Homo sapiens
uuuacaccuuuaucuuu

SEQ ID NO: 5050 - RNA, 17 nt, Homo sapiens
ccuuuaucuuuccaugg

SEQ ID NO: 5051 - RNA, 17 nt, Homo sapiens
uaucuuuccaugggagc

SEQ ID NO: 5052 - RNA, 17 nt, Homo sapiens
aucuuuccaugggagcc

SEQ ID NO: 5053 - RNA, 17 nt, Homo sapiens
augggagccagcugcuu

SEQ ID NO: 5054 - RNA, 17 nt, Homo sapiens
ugggagccagcugcuuu

SEQ ID NO: 5055 - RNA, 17 nt, Homo sapiens
gagccagcugcuuuuug

SEQ ID NO: 5056 - RNA, 17 nt, Homo sapiens
ccagcugcuuuuuguga

SEQ ID NO: 5057 - RNA, 17 nt, Homo sapiens
aauagugcuuuuuuuuu

SEQ ID NO: 5058 - RNA, 17 nt, Homo sapiens
uuuuugacuaacaagaa

SEQ ID NO: 5059 - RNA, 17 nt, Homo sapiens
ugacuaacaagaaugua

SEQ ID NO: 5060 - RNA, 17 nt, Homo sapiens
aauguaacuccagauag

SEQ ID NO: 5061 - RNA, 17 nt, Homo sapiens
uguaacuccagauagag

SEQ ID NO: 5062 - RNA, 17 nt, Homo sapiens
guaacuccagauagaga

SEQ ID NO: 5063 - RNA, 17 nt, Homo sapiens
auagugacaagugaaga

SEQ ID NO: 5064 - RNA, 17 nt, Homo sapiens
ugaagaacacuacugcu

SEQ ID NO: 5065 - RNA, 17 nt, Homo sapiens
aagaacacuacugcuaa

SEQ ID NO: 5066 - RNA, 17 nt, Homo sapiens
aacacuacugcuaaauc

SEQ ID NO: 5067 - RNA, 17 nt, Homo sapiens
acuacugcuaaauccuc

SEQ ID NO: 5068 - RNA, 17 nt, Homo sapiens
gcuaaauccucauguua

SEQ ID NO: 5069 - RNA, 17 nt, Homo sapiens
cuaaauccucauguuac

SEQ ID NO: 5070 - RNA, 17 nt, Homo sapiens
aaauccucauguuacuc

SEQ ID NO: 5071 - RNA, 17 nt, Homo sapiens
cauguuacucaguguua

SEQ ID NO: 5072 - RNA, 17 nt, Homo sapiens
uguuacucaguguuaga

SEQ ID NO: 5073 - RNA, 17 nt, Homo sapiens
gagaaauccuuccuaaa

SEQ ID NO: 5074 - RNA, 17 nt, Homo sapiens
agaaauccuuccuaaac

SEQ ID NO: 5075 - RNA, 17 nt, Homo sapiens
aauccuuccuaaaccca

SEQ ID NO: 5076 - RNA, 17 nt, Homo sapiens
auccuuccuaaacccaa

SEQ ID NO: 5077 - RNA, 17 nt, Homo sapiens
uccuaaacccaaugacu

SEQ ID NO: 5078 - RNA, 17 nt, Homo sapiens
ccuaaacccaaugacuu

SEQ ID NO: 5079 - RNA, 17 nt, Homo sapiens
cuaaacccaaugacuuc

SEQ ID NO: 5080 - RNA, 17 nt, Homo sapiens
ccaaugacuucccugcu

SEQ ID NO: 5081 - RNA, 17 nt, Homo sapiens
augacuucccugcucca

SEQ ID NO: 5082 - RNA, 17 nt, Homo sapiens
ugacuucccugcuccaa

SEQ ID NO: 5083 - RNA, 17 nt, Homo sapiens
gacuucccugcuccaac

SEQ ID NO: 5084 - RNA, 17 nt, Homo sapiens
uucccugcuccaacccc

SEQ ID NO: 5085 - RNA, 17 nt, Homo sapiens
cccugcuccaacccccg

SEQ ID NO: 5086 - RNA, 17 nt, Homo sapiens
ccugcuccaacccccgc

SEQ ID NO: 5087 - RNA, 17 nt, Homo sapiens
gcuccaacccccgccac

SEQ ID NO: 5088 - RNA, 17 nt, Homo sapiens
cuccaacccccgccacc

SEQ ID NO: 5089 - RNA, 17 nt, Homo sapiens
uccaacccccgccaccu

SEQ ID NO: 5090 - RNA, 17 nt, Homo sapiens
ccaacccccgccaccuc

SEQ ID NO: 5091 - RNA, 17 nt, Homo sapiens
acccccgccaccucagg

SEQ ID NO: 5092 - RNA, 17 nt, Homo sapiens
cccccgccaccucaggg

SEQ ID NO: 5093 - RNA, 17 nt, Homo sapiens
cccgccaccucagggca

SEQ ID NO: 5094 - RNA, 17 nt, Homo sapiens
ccgccaccucagggcac

SEQ ID NO: 5095 - RNA, 17 nt, Homo sapiens
gccaccucagggcacgc

SEQ ID NO: 5096 - RNA, 17 nt, Homo sapiens
cucagggcacgcaggac

SEQ ID NO: 5097 - RNA, 17 nt, Homo sapiens
gggcacgcaggaccagu

SEQ ID NO: 5098 - RNA, 17 nt, Homo sapiens
cgcaggaccaguuugau

SEQ ID NO: 5099 - RNA, 17 nt, Homo sapiens
gcaggaccaguuugauu

SEQ ID NO: 5100 - RNA, 17 nt, Homo sapiens
ugaggagcugcacugau

SEQ ID NO: 5101 - RNA, 17 nt, Homo sapiens
ggagcugcacugaucac

SEQ ID NO: 5102 - RNA, 17 nt, Homo sapiens
agcugcacugaucaccc

SEQ ID NO: 5103 - RNA, 17 nt, Homo sapiens
cacugaucacccaaugc

SEQ ID NO: 5104 - RNA, 17 nt, Homo sapiens
cugaucacccaaugcau

SEQ ID NO: 5105 - RNA, 17 nt, Homo sapiens
ugaucacccaaugcauc

SEQ ID NO: 5106 - RNA, 17 nt, Homo sapiens
gaucacccaaugcauca

SEQ ID NO: 5107 - RNA, 17 nt, Homo sapiens
cccaaugcaucacguac

SEQ ID NO: 5108 - RNA, 17 nt, Homo sapiens
aaugcaucacguacccc

SEQ ID NO: 5109 - RNA, 17 nt, Homo sapiens
ucacguaccccacuggg

SEQ ID NO: 5110 - RNA, 17 nt, Homo sapiens
cacguaccccacugggc

SEQ ID NO: 5111 - RNA, 17 nt, Homo sapiens
acguaccccacugggcc

SEQ ID NO: 5112 - RNA, 17 nt, Homo sapiens
cguaccccacugggcca

SEQ ID NO: 5113 - RNA, 17 nt, Homo sapiens
uaccccacugggccagc

SEQ ID NO: 5114 - RNA, 17 nt, Homo sapiens
cacugggccagcccugc

SEQ ID NO: 5115 - RNA, 17 nt, Homo sapiens
acugggccagcccugca

SEQ ID NO: 5116 - RNA, 17 nt, Homo sapiens
gggccagcccugcagcc

SEQ ID NO: 5117 - RNA, 17 nt, Homo sapiens
ggccagcccugcagccc

SEQ ID NO: 5118 - RNA, 17 nt, Homo sapiens
gccagcccugcagccca

SEQ ID NO: 5119 - RNA, 17 nt, Homo sapiens
agcccugcagcccaaaa

SEQ ID NO: 5120 - RNA, 17 nt, Homo sapiens
ccugcagcccaaaaccc

SEQ ID NO: 5121 - RNA, 17 nt, Homo sapiens
cugcagcccaaaaccca

SEQ ID NO: 5122 - RNA, 17 nt, Homo sapiens
ugcagcccaaaacccag

SEQ ID NO: 5123 - RNA, 17 nt, Homo sapiens
cccaaaacccagggcaa

SEQ ID NO: 5124 - RNA, 17 nt, Homo sapiens
ccaaaacccagggcaac

SEQ ID NO: 5125 - RNA, 17 nt, Homo sapiens
caaaacccagggcaaca

SEQ ID NO: 5126 - RNA, 17 nt, Homo sapiens
cccagggcaacaagccc

SEQ ID NO: 5127 - RNA, 17 nt, Homo sapiens
agggcaacaagcccguu

SEQ ID NO: 5128 - RNA, 17 nt, Homo sapiens
caacaagcccguuagcc

SEQ ID NO: 5129 - RNA, 17 nt, Homo sapiens
aacaagcccguuagccc

SEQ ID NO: 5130 - RNA, 17 nt, Homo sapiens
ccguuagccccagggga

SEQ ID NO: 5131 - RNA, 17 nt, Homo sapiens
cguuagccccaggggau

SEQ ID NO: 5132 - RNA, 17 nt, Homo sapiens
guuagccccaggggauc

SEQ ID NO: 5133 - RNA, 17 nt, Homo sapiens
uuagccccaggggauca

SEQ ID NO: 5134 - RNA, 17 nt, Homo sapiens
aggggaucacuggcugg

SEQ ID NO: 5135 - RNA, 17 nt, Homo sapiens
gggaucacuggcuggcc

SEQ ID NO: 5136 - RNA, 17 nt, Homo sapiens
ucacuggcuggccugag

SEQ ID NO: 5137 - RNA, 17 nt, Homo sapiens
uggcuggccugagcaac

SEQ ID NO: 5138 - RNA, 17 nt, Homo sapiens
ggcuggccugagcaaca

SEQ ID NO: 5139 - RNA, 17 nt, Homo sapiens
gccugagcaacaucucg

SEQ ID NO: 5140 - RNA, 17 nt, Homo sapiens
ugagcaacaucucggga

SEQ ID NO: 5141 - RNA, 17 nt, Homo sapiens
gcaacaucucgggaguc

SEQ ID NO: 5142 - RNA, 17 nt, Homo sapiens
cgggaguccucuagcag

SEQ ID NO: 5143 - RNA, 17 nt, Homo sapiens
gggaguccucuagcagg

SEQ ID NO: 5144 - RNA, 17 nt, Homo sapiens
gaguccucuagcaggcc

SEQ ID NO: 5145 - RNA, 17 nt, Homo sapiens
ccucuagcaggccuaag

SEQ ID NO: 5146 - RNA, 17 nt, Homo sapiens
uagcaggccuaagacau

SEQ ID NO: 5147 - RNA, 17 nt, Homo sapiens
agcaggccuaagacaug

SEQ ID NO: 5148 - RNA, 17 nt, Homo sapiens
ccuaagacaugugagga

SEQ ID NO: 5149 - RNA, 17 nt, Homo sapiens
aaaaaagcaaaaagcaa

SEQ ID NO: 5150 - RNA, 17 nt, Homo sapiens
caaaaagcaagggagaa

SEQ ID NO: 5151 - RNA, 17 nt, Homo sapiens
agagaaaccgggagaag

SEQ ID NO: 5152 - RNA, 17 nt, Homo sapiens
gagaaggcaugagaaag

SEQ ID NO: 5153 - RNA, 17 nt, Homo sapiens
ugagacgcaccaugugg

SEQ ID NO: 5154 - RNA, 17 nt, Homo sapiens
agacgcaccaugugggc

SEQ ID NO: 5155 - RNA, 17 nt, Homo sapiens
gacgcaccaugugggca

SEQ ID NO: 5156 - RNA, 17 nt, Homo sapiens
augugggcacggagggg

SEQ ID NO: 5157 - RNA, 17 nt, Homo sapiens
gacggggcucagcaaug

SEQ ID NO: 5158 - RNA, 17 nt, Homo sapiens
cggggcucagcaaugcc

SEQ ID NO: 5159 - RNA, 17 nt, Homo sapiens
ggcucagcaaugccauu

SEQ ID NO: 5160 - RNA, 17 nt, Homo sapiens
agcaaugccauuucagu

SEQ ID NO: 5161 - RNA, 17 nt, Homo sapiens
gcaaugccauuucagug

SEQ ID NO: 5162 - RNA, 17 nt, Homo sapiens
gccauuucaguggcuuc

SEQ ID NO: 5163 - RNA, 17 nt, Homo sapiens
ucaguggcuucccagcu

SEQ ID NO: 5164 - RNA, 17 nt, Homo sapiens
guggcuucccagcucug

SEQ ID NO: 5165 - RNA, 17 nt, Homo sapiens
uggcuucccagcucuga

SEQ ID NO: 5166 - RNA, 17 nt, Homo sapiens
ggcuucccagcucugac

SEQ ID NO: 5167 - RNA, 17 nt, Homo sapiens
uucccagcucugacccu

SEQ ID NO: 5168 - RNA, 17 nt, Homo sapiens
cccagcucugacccuuc

SEQ ID NO: 5169 - RNA, 17 nt, Homo sapiens
gcucugacccuucuaca

SEQ ID NO: 5170 - RNA, 17 nt, Homo sapiens
cucugacccuucuacau

SEQ ID NO: 5171 - RNA, 17 nt, Homo sapiens
ucugacccuucuacauu

SEQ ID NO: 5172 - RNA, 17 nt, Homo sapiens
gacccuucuacauuuga

SEQ ID NO: 5173 - RNA, 17 nt, Homo sapiens
ccuucuacauuugaggg

SEQ ID NO: 5174 - RNA, 17 nt, Homo sapiens
uugagggcccagccagg

SEQ ID NO: 5175 - RNA, 17 nt, Homo sapiens
ugagggcccagccagga

SEQ ID NO: 5176 - RNA, 17 nt, Homo sapiens
gagggcccagccaggag

SEQ ID NO: 5177 - RNA, 17 nt, Homo sapiens
ggcccagccaggagcag

SEQ ID NO: 5178 - RNA, 17 nt, Homo sapiens
gcccagccaggagcaga

SEQ ID NO: 5179 - RNA, 17 nt, Homo sapiens
ccaggagcagauggaca

SEQ ID NO: 5180 - RNA, 17 nt, Homo sapiens
agauggacagcgaugag

SEQ ID NO: 5181 - RNA, 17 nt, Homo sapiens
gaggggacauuuucugg

SEQ ID NO: 5182 - RNA, 17 nt, Homo sapiens
acauuuucuggauucug

SEQ ID NO: 5183 - RNA, 17 nt, Homo sapiens
cuggauucugggaggca

SEQ ID NO: 5184 - RNA, 17 nt, Homo sapiens
ugggaggcaagaaaagg

SEQ ID NO: 5185 - RNA, 17 nt, Homo sapiens
aaaaggacaaauaucuu

SEQ ID NO: 5186 - RNA, 17 nt, Homo sapiens
caaauaucuuuuuugga

SEQ ID NO: 5187 - RNA, 17 nt, Homo sapiens
uuuggaacuaaagcaaa

SEQ ID NO: 5188 - RNA, 17 nt, Homo sapiens
acuaaagcaaauuuuag

SEQ ID NO: 5189 - RNA, 17 nt, Homo sapiens
uuuuagaccuuuaccua

SEQ ID NO: 5190 - RNA, 17 nt, Homo sapiens
uuuagaccuuuaccuau

SEQ ID NO: 5191 - RNA, 17 nt, Homo sapiens
accuuuaccuauggaag

SEQ ID NO: 5192 - RNA, 17 nt, Homo sapiens
ccuuuaccuauggaagu

SEQ ID NO: 5193 - RNA, 17 nt, Homo sapiens
agugguucuauguccau

SEQ ID NO: 5194 - RNA, 17 nt, Homo sapiens
ucuauguccauucucau

SEQ ID NO: 5195 - RNA, 17 nt, Homo sapiens
cuauguccauucucauu

SEQ ID NO: 5196 - RNA, 17 nt, Homo sapiens
guccauucucauucgug

SEQ ID NO: 5197 - RNA, 17 nt, Homo sapiens
ccauucucauucguggc

SEQ ID NO: 5198 - RNA, 17 nt, Homo sapiens
uucguggcauguuuuga

SEQ ID NO: 5199 - RNA, 17 nt, Homo sapiens
uuuguagcacugagggu

SEQ ID NO: 5200 - RNA, 17 nt, Homo sapiens
uguagcacugagggugg

SEQ ID NO: 5201 - RNA, 17 nt, Homo sapiens
aggguggcacucaacuc

SEQ ID NO: 5202 - RNA, 17 nt, Homo sapiens
gguggcacucaacucug

SEQ ID NO: 5203 - RNA, 17 nt, Homo sapiens
uggcacucaacucugag

SEQ ID NO: 5204 - RNA, 17 nt, Homo sapiens
cacucaacucugagccc

SEQ ID NO: 5205 - RNA, 17 nt, Homo sapiens
cucaacucugagcccau

SEQ ID NO: 5206 - RNA, 17 nt, Homo sapiens
cucugagcccauacuuu

SEQ ID NO: 5207 - RNA, 17 nt, Homo sapiens
ucugagcccauacuuuu

SEQ ID NO: 5208 - RNA, 17 nt, Homo sapiens
cugagcccauacuuuug

SEQ ID NO: 5209 - RNA, 17 nt, Homo sapiens
gcccauacuuuuggcuc

SEQ ID NO: 5210 - RNA, 17 nt, Homo sapiens
cuuuuggcuccucuagu

SEQ ID NO: 5211 - RNA, 17 nt, Homo sapiens
uuuggcuccucuaguaa

SEQ ID NO: 5212 - RNA, 17 nt, Homo sapiens
uuggcuccucuaguaag

SEQ ID NO: 5213 - RNA, 17 nt, Homo sapiens
ggcuccucuaguaagau

SEQ ID NO: 5214 - RNA, 17 nt, Homo sapiens
uaagaugcacugaaaac

SEQ ID NO: 5215 - RNA, 17 nt, Homo sapiens
agaugcacugaaaacuu

SEQ ID NO: 5216 - RNA, 17 nt, Homo sapiens
cugaaaacuuagccaga

SEQ ID NO: 5217 - RNA, 17 nt, Homo sapiens
aacuuagccagaguuag

SEQ ID NO: 5218 - RNA, 17 nt, Homo sapiens
acuuagccagaguuagg

SEQ ID NO: 5219 - RNA, 17 nt, Homo sapiens
agguugucuccaggcca

SEQ ID NO: 5220 - RNA, 17 nt, Homo sapiens
guugucuccaggccaug

SEQ ID NO: 5221 - RNA, 17 nt, Homo sapiens
uugucuccaggccauga

SEQ ID NO: 5222 - RNA, 17 nt, Homo sapiens
cuccaggccaugauggc

SEQ ID NO: 5223 - RNA, 17 nt, Homo sapiens
uccaggccaugauggcc

SEQ ID NO: 5224 - RNA, 17 nt, Homo sapiens
augauggccuuacacug

SEQ ID NO: 5225 - RNA, 17 nt, Homo sapiens
ugauggccuuacacuga

SEQ ID NO: 5226 - RNA, 17 nt, Homo sapiens
ggccuuacacugaaaau

SEQ ID NO: 5227 - RNA, 17 nt, Homo sapiens
ccuuacacugaaaaugu

SEQ ID NO: 5228 - RNA, 17 nt, Homo sapiens
aaaaugucacauucuau

SEQ ID NO: 5229 - RNA, 17 nt, Homo sapiens
aaugucacauucuauuu

SEQ ID NO: 5230 - RNA, 17 nt, Homo sapiens
ucacauucuauuuuggg

SEQ ID NO: 5231 - RNA, 17 nt, Homo sapiens
auauaguccagacacuu

SEQ ID NO: 5232 - RNA, 17 nt, Homo sapiens
uauaguccagacacuua

SEQ ID NO: 5233 - RNA, 17 nt, Homo sapiens
guccagacacuuaacuc

SEQ ID NO: 5234 - RNA, 17 nt, Homo sapiens
ccagacacuuaacucaa

SEQ ID NO: 5235 - RNA, 17 nt, Homo sapiens
cacuuaacucaauuucu

SEQ ID NO: 5236 - RNA, 17 nt, Homo sapiens
cuuaacucaauuucuug

SEQ ID NO: 5237 - RNA, 17 nt, Homo sapiens
ucaauuucuugguauua

SEQ ID NO: 5238 - RNA, 17 nt, Homo sapiens
uauuauucuguuuugca

SEQ ID NO: 5239 - RNA, 17 nt, Homo sapiens
uguuuugcacaguuagu

SEQ ID NO: 5240 - RNA, 17 nt, Homo sapiens
uuuugcacaguuaguug

SEQ ID NO: 5241 - RNA, 17 nt, Homo sapiens
aagaaagcugagaagaa

SEQ ID NO: 5242 - RNA, 17 nt, Homo sapiens
gaaaaugcaguccugag

SEQ ID NO: 5243 - RNA, 17 nt, Homo sapiens
augcaguccugaggaga

SEQ ID NO: 5244 - RNA, 17 nt, Homo sapiens
ugcaguccugaggagag

SEQ ID NO: 5245 - RNA, 17 nt, Homo sapiens
gaguuuucuccauauca

SEQ ID NO: 5246 - RNA, 17 nt, Homo sapiens
guuuucuccauaucaaa

SEQ ID NO: 5247 - RNA, 17 nt, Homo sapiens
uuuucuccauaucaaaa

SEQ ID NO: 5248 - RNA, 17 nt, Homo sapiens
uccauaucaaaacgagg

SEQ ID NO: 5249 - RNA, 17 nt, Homo sapiens
acgagggcugauggagg

SEQ ID NO: 5250 - RNA, 17 nt, Homo sapiens
aaaaggucaauaagguc

SEQ ID NO: 5251 - RNA, 17 nt, Homo sapiens
auaaggucaagggaaga

SEQ ID NO: 5252 - RNA, 17 nt, Homo sapiens
gggaagaccccgucucu

SEQ ID NO: 5253 - RNA, 17 nt, Homo sapiens
ggaagaccccgucucua

SEQ ID NO: 5254 - RNA, 17 nt, Homo sapiens
gaagaccccgucucuau

SEQ ID NO: 5255 - RNA, 17 nt, Homo sapiens
accccgucucuauacca

SEQ ID NO: 5256 - RNA, 17 nt, Homo sapiens
cccgucucuauaccaac

SEQ ID NO: 5257 - RNA, 17 nt, Homo sapiens
cucuauaccaaccaaac

SEQ ID NO: 5258 - RNA, 17 nt, Homo sapiens
ucuauaccaaccaaacc

SEQ ID NO: 5259 - RNA, 17 nt, Homo sapiens
auaccaaccaaaccaau

SEQ ID NO: 5260 - RNA, 17 nt, Homo sapiens
uaccaaccaaaccaauu

SEQ ID NO: 5261 - RNA, 17 nt, Homo sapiens
aaccaaaccaauucacc

SEQ ID NO: 5262 - RNA, 17 nt, Homo sapiens
accaaaccaauucacca

SEQ ID NO: 5263 - RNA, 17 nt, Homo sapiens
accaauucaccaacaca

SEQ ID NO: 5264 - RNA, 17 nt, Homo sapiens
caauucaccaacacagu

SEQ ID NO: 5265 - RNA, 17 nt, Homo sapiens
aauucaccaacacaguu

SEQ ID NO: 5266 - RNA, 17 nt, Homo sapiens
ucaccaacacaguuggg

SEQ ID NO: 5267 - RNA, 17 nt, Homo sapiens
accaacacaguugggac

SEQ ID NO: 5268 - RNA, 17 nt, Homo sapiens
guugggacccaaaacac

SEQ ID NO: 5269 - RNA, 17 nt, Homo sapiens
uugggacccaaaacaca

SEQ ID NO: 5270 - RNA, 17 nt, Homo sapiens
ugggacccaaaacacag

SEQ ID NO: 5271 - RNA, 17 nt, Homo sapiens
cccaaaacacaggaagu

SEQ ID NO: 5272 - RNA, 17 nt, Homo sapiens
caaaacacaggaaguca

SEQ ID NO: 5273 - RNA, 17 nt, Homo sapiens
aggaagucagucacguu

SEQ ID NO: 5274 - RNA, 17 nt, Homo sapiens
agucagucacguuuccu

SEQ ID NO: 5275 - RNA, 17 nt, Homo sapiens
cacguuuccuuuucauu

SEQ ID NO: 5276 - RNA, 17 nt, Homo sapiens
acguuuccuuuucauuu

SEQ ID NO: 5277 - RNA, 17 nt, Homo sapiens
uccuuuucauuuaaugg

SEQ ID NO: 5278 - RNA, 17 nt, Homo sapiens
ggggauuccacuaucuc

SEQ ID NO: 5279 - RNA, 17 nt, Homo sapiens
gggauuccacuaucuca

SEQ ID NO: 5280 - RNA, 17 nt, Homo sapiens
gauuccacuaucucaca

SEQ ID NO: 5281 - RNA, 17 nt, Homo sapiens
ccacuaucucacacuaa

SEQ ID NO: 5282 - RNA, 17 nt, Homo sapiens
acuaucucacacuaauc

SEQ ID NO: 5283 - RNA, 17 nt, Homo sapiens
uaucucacacuaaucug

SEQ ID NO: 5284 - RNA, 17 nt, Homo sapiens
ucucacacuaaucugaa

SEQ ID NO: 5285 - RNA, 17 nt, Homo sapiens
cacuaaucugaaaggau

SEQ ID NO: 5286 - RNA, 17 nt, Homo sapiens
ggaagagcauuagcugg

SEQ ID NO: 5287 - RNA, 17 nt, Homo sapiens
gcauuagcuggcgcaua

SEQ ID NO: 5288 - RNA, 17 nt, Homo sapiens
gcuggcgcauauuaagc

SEQ ID NO: 5289 - RNA, 17 nt, Homo sapiens
uauuaagcacuuuaagc

SEQ ID NO: 5290 - RNA, 17 nt, Homo sapiens
uuaagcacuuuaagcuc

SEQ ID NO: 5291 - RNA, 17 nt, Homo sapiens
cuuuaagcuccuugagu

SEQ ID NO: 5292 - RNA, 17 nt, Homo sapiens
uuaagcuccuugaguaa

SEQ ID NO: 5293 - RNA, 17 nt, Homo sapiens
uaagcuccuugaguaaa

SEQ ID NO: 5294 - RNA, 17 nt, Homo sapiens
auuuaugcaagguauuu

SEQ ID NO: 5295 - RNA, 17 nt, Homo sapiens
gguauuucuccaguugg

SEQ ID NO: 5296 - RNA, 17 nt, Homo sapiens
uauuucuccaguuggga

SEQ ID NO: 5297 - RNA, 17 nt, Homo sapiens
auuucuccaguugggac

SEQ ID NO: 5298 - RNA, 17 nt, Homo sapiens
guugggacucaggauau

SEQ ID NO: 5299 - RNA, 17 nt, Homo sapiens
ugggacucaggauauua

SEQ ID NO: 5300 - RNA, 17 nt, Homo sapiens
uaaugagccaucacuag

SEQ ID NO: 5301 - RNA, 17 nt, Homo sapiens
aaugagccaucacuaga

SEQ ID NO: 5302 - RNA, 17 nt, Homo sapiens
gagccaucacuagaaga

SEQ ID NO: 5303 - RNA, 17 nt, Homo sapiens
gccaucacuagaagaaa

SEQ ID NO: 5304 - RNA, 17 nt, Homo sapiens
agaaaagcccauuuuca

SEQ ID NO: 5305 - RNA, 17 nt, Homo sapiens
gaaaagcccauuuucaa

SEQ ID NO: 5306 - RNA, 17 nt, Homo sapiens
aaaagcccauuuucaac

SEQ ID NO: 5307 - RNA, 17 nt, Homo sapiens
ccauuuucaacugcuuu

SEQ ID NO: 5308 - RNA, 17 nt, Homo sapiens
uuuucaacugcuuugaa

SEQ ID NO: 5309 - RNA, 17 nt, Homo sapiens
ucaacugcuuugaaacu

SEQ ID NO: 5310 - RNA, 17 nt, Homo sapiens
uuugaaacuugccuggg

SEQ ID NO: 5311 - RNA, 17 nt, Homo sapiens
aaacuugccuggggucu

SEQ ID NO: 5312 - RNA, 17 nt, Homo sapiens
aacuugccuggggucug

SEQ ID NO: 5313 - RNA, 17 nt, Homo sapiens
cuggggucugagcauga

SEQ ID NO: 5314 - RNA, 17 nt, Homo sapiens
gucugagcaugauggga

SEQ ID NO: 5315 - RNA, 17 nt, Homo sapiens
agggagacaggguagga

SEQ ID NO: 5316 - RNA, 17 nt, Homo sapiens
aagggcgccuacucuuc

SEQ ID NO: 5317 - RNA, 17 nt, Homo sapiens
agggcgccuacucuuca

SEQ ID NO: 5318 - RNA, 17 nt, Homo sapiens
gcgccuacucuucaggg

SEQ ID NO: 5319 - RNA, 17 nt, Homo sapiens
gccuacucuucaggguc

SEQ ID NO: 5320 - RNA, 17 nt, Homo sapiens
uacucuucagggucuaa

SEQ ID NO: 5321 - RNA, 17 nt, Homo sapiens
ucagggucuaaagauca

SEQ ID NO: 5322 - RNA, 17 nt, Homo sapiens
uaaagaucaagugggcc

SEQ ID NO: 5323 - RNA, 17 nt, Homo sapiens
aagugggccuuggaucg

SEQ ID NO: 5324 - RNA, 17 nt, Homo sapiens
agugggccuuggaucgc

SEQ ID NO: 5325 - RNA, 17 nt, Homo sapiens
uggaucgcuaagcuggc

SEQ ID NO: 5326 - RNA, 17 nt, Homo sapiens
cgcuaagcuggcucugu

SEQ ID NO: 5327 - RNA, 17 nt, Homo sapiens
aagcuggcucuguuuga

SEQ ID NO: 5328 - RNA, 17 nt, Homo sapiens
gcuggcucuguuugaug

SEQ ID NO: 5329 - RNA, 17 nt, Homo sapiens
uuugaugcuauuuaugc

SEQ ID NO: 5330 - RNA, 17 nt, Homo sapiens
auuuaugcaaguuaggg

SEQ ID NO: 5331 - RNA, 17 nt, Homo sapiens
uuagggucuauguauuu

SEQ ID NO: 5332 - RNA, 17 nt, Homo sapiens
ggaugcgccuacucuuc

SEQ ID NO: 5333 - RNA, 17 nt, Homo sapiens
gaugcgccuacucuuca

SEQ ID NO: 5334 - RNA, 17 nt, Homo sapiens
aggaugucugcaccuuc

SEQ ID NO: 5335 - RNA, 17 nt, Homo sapiens
augucugcaccuucugc

SEQ ID NO: 5336 - RNA, 17 nt, Homo sapiens
gucugcaccuucugcag

SEQ ID NO: 5337 - RNA, 17 nt, Homo sapiens
ucugcaccuucugcagc

SEQ ID NO: 5338 - RNA, 17 nt, Homo sapiens
gcaccuucugcagccag

SEQ ID NO: 5339 - RNA, 17 nt, Homo sapiens
ccuucugcagccaguca

SEQ ID NO: 5340 - RNA, 17 nt, Homo sapiens
ucugcagccagucagaa

SEQ ID NO: 5341 - RNA, 17 nt, Homo sapiens
cugcagccagucagaag

SEQ ID NO: 5342 - RNA, 17 nt, Homo sapiens
agccagucagaagcugg

SEQ ID NO: 5343 - RNA, 17 nt, Homo sapiens
ucagaagcuggagaggc

SEQ ID NO: 5344 - RNA, 17 nt, Homo sapiens
ggagaggcaacagugga

SEQ ID NO: 5345 - RNA, 17 nt, Homo sapiens
gaggcaacaguggauug

SEQ ID NO: 5346 - RNA, 17 nt, Homo sapiens
uggauugcugcuucuug

SEQ ID NO: 5347 - RNA, 17 nt, Homo sapiens
auugcugcuucuugggg

SEQ ID NO: 5348 - RNA, 17 nt, Homo sapiens
gcugcuucuuggggaga

SEQ ID NO: 5349 - RNA, 17 nt, Homo sapiens
gaguaugcuuccuuuua

SEQ ID NO: 5350 - RNA, 17 nt, Homo sapiens
uaugcuuccuuuuaucc

SEQ ID NO: 5351 - RNA, 17 nt, Homo sapiens
augcuuccuuuuaucca

SEQ ID NO: 5352 - RNA, 17 nt, Homo sapiens
cuuuuauccauguaauu

SEQ ID NO: 5353 - RNA, 17 nt, Homo sapiens
uuuuauccauguaauuu

SEQ ID NO: 5354 - RNA, 17 nt, Homo sapiens
aauuuaacuguagaacc

SEQ ID NO: 5355 - RNA, 17 nt, Homo sapiens
uguagaaccugagcucu

SEQ ID NO: 5356 - RNA, 17 nt, Homo sapiens
guagaaccugagcucua

SEQ ID NO: 5357 - RNA, 17 nt, Homo sapiens
accugagcucuaaguaa

SEQ ID NO: 5358 - RNA, 17 nt, Homo sapiens
cugagcucuaaguaacc

SEQ ID NO: 5359 - RNA, 17 nt, Homo sapiens
uaaguaaccgaagaaug

SEQ ID NO: 5360 - RNA, 17 nt, Homo sapiens
auguaugccucuguucu

SEQ ID NO: 5361 - RNA, 17 nt, Homo sapiens
uguaugccucuguucuu

SEQ ID NO: 5362 - RNA, 17 nt, Homo sapiens
uaugccucuguucuuau

SEQ ID NO: 5363 - RNA, 17 nt, Homo sapiens
cucuguucuuaugugcc

SEQ ID NO: 5364 - RNA, 17 nt, Homo sapiens
uuaugugccacauccuu

SEQ ID NO: 5365 - RNA, 17 nt, Homo sapiens
uaugugccacauccuug

SEQ ID NO: 5366 - RNA, 17 nt, Homo sapiens
ugugccacauccuuguu

SEQ ID NO: 5367 - RNA, 17 nt, Homo sapiens
gccacauccuuguuuaa

SEQ ID NO: 5368 - RNA, 17 nt, Homo sapiens
ccacauccuuguuuaaa

SEQ ID NO: 5369 - RNA, 17 nt, Homo sapiens
uuaaaggcucucuguau

SEQ ID NO: 5370 - RNA, 17 nt, Homo sapiens
aaaggcucucuguauga

SEQ ID NO: 5371 - RNA, 17 nt, Homo sapiens
aggcucucuguaugaag

SEQ ID NO: 5372 - RNA, 17 nt, Homo sapiens
gaugggaccgucaucag

SEQ ID NO: 5373 - RNA, 17 nt, Homo sapiens
ggaccgucaucagcaca

SEQ ID NO: 5374 - RNA, 17 nt, Homo sapiens
ccgucaucagcacauuc

SEQ ID NO: 5375 - RNA, 17 nt, Homo sapiens
ucaucagcacauucccu

SEQ ID NO: 5376 - RNA, 17 nt, Homo sapiens
aucagcacauucccuag

SEQ ID NO: 5377 - RNA, 17 nt, Homo sapiens
gcacauucccuagugag

SEQ ID NO: 5378 - RNA, 17 nt, Homo sapiens
cacauucccuagugagc

SEQ ID NO: 5379 - RNA, 17 nt, Homo sapiens
acauucccuagugagcc

SEQ ID NO: 5380 - RNA, 17 nt, Homo sapiens
uagugagccuacuggcu

SEQ ID NO: 5381 - RNA, 17 nt, Homo sapiens
agugagccuacuggcuc

SEQ ID NO: 5382 - RNA, 17 nt, Homo sapiens
gagccuacuggcuccug

SEQ ID NO: 5383 - RNA, 17 nt, Homo sapiens
cuacuggcuccuggcag

SEQ ID NO: 5384 - RNA, 17 nt, Homo sapiens
acuggcuccuggcagcg

SEQ ID NO: 5385 - RNA, 17 nt, Homo sapiens
cuggcuccuggcagcgg

SEQ ID NO: 5386 - RNA, 17 nt, Homo sapiens
cuccuggcagcggcuuu

SEQ ID NO: 5387 - RNA, 17 nt, Homo sapiens
gcagcggcuuuugugga

SEQ ID NO: 5388 - RNA, 17 nt, Homo sapiens
uggaagacucacuagcc

SEQ ID NO: 5389 - RNA, 17 nt, Homo sapiens
gaagacucacuagccag

SEQ ID NO: 5390 - RNA, 17 nt, Homo sapiens
agacucacuagccagaa

SEQ ID NO: 5391 - RNA, 17 nt, Homo sapiens
ucacuagccagaagaga

SEQ ID NO: 5392 - RNA, 17 nt, Homo sapiens
cacuagccagaagagag

SEQ ID NO: 5393 - RNA, 17 nt, Homo sapiens
agugggacaguccucuc

SEQ ID NO: 5394 - RNA, 17 nt, Homo sapiens
ggacaguccucuccacc

SEQ ID NO: 5395 - RNA, 17 nt, Homo sapiens
gacaguccucuccacca

SEQ ID NO: 5396 - RNA, 17 nt, Homo sapiens
caguccucuccaccaag

SEQ ID NO: 5397 - RNA, 17 nt, Homo sapiens
guccucuccaccaagau

SEQ ID NO: 5398 - RNA, 17 nt, Homo sapiens
uccucuccaccaagauc

SEQ ID NO: 5399 - RNA, 17 nt, Homo sapiens
cucuccaccaagaucua

SEQ ID NO: 5400 - RNA, 17 nt, Homo sapiens
ucuccaccaagaucuaa

SEQ ID NO: 5401 - RNA, 17 nt, Homo sapiens
ccaagaucuaaauccaa

SEQ ID NO: 5402 - RNA, 17 nt, Homo sapiens
ucuaaauccaaacaaaa

SEQ ID NO: 5403 - RNA, 17 nt, Homo sapiens
cuaaauccaaacaaaag

SEQ ID NO: 5404 - RNA, 17 nt, Homo sapiens
auccaaacaaaagcagg

SEQ ID NO: 5405 - RNA, 17 nt, Homo sapiens
acaaaagcaggcuagag

SEQ ID NO: 5406 - RNA, 17 nt, Homo sapiens
aagcaggcuagagccag

SEQ ID NO: 5407 - RNA, 17 nt, Homo sapiens
gcuagagccagaagaga

SEQ ID NO: 5408 - RNA, 17 nt, Homo sapiens
cuagagccagaagagag

SEQ ID NO: 5409 - RNA, 17 nt, Homo sapiens
gagaggacaaaucuuug

SEQ ID NO: 5410 - RNA, 17 nt, Homo sapiens
gacaaaucuuuguuguu

SEQ ID NO: 5411 - RNA, 17 nt, Homo sapiens
uguuguuccucuucuuu

SEQ ID NO: 5412 - RNA, 17 nt, Homo sapiens
guuguuccucuucuuua

SEQ ID NO: 5413 - RNA, 17 nt, Homo sapiens
uguuccucuucuuuaca

SEQ ID NO: 5414 - RNA, 17 nt, Homo sapiens
uccucuucuuuacacau

SEQ ID NO: 5415 - RNA, 17 nt, Homo sapiens
uucuuuacacauacgca

SEQ ID NO: 5416 - RNA, 17 nt, Homo sapiens
cuuuacacauacgcaaa

SEQ ID NO: 5417 - RNA, 17 nt, Homo sapiens
acauacgcaaaccaccu

SEQ ID NO: 5418 - RNA, 17 nt, Homo sapiens
acgcaaaccaccuguga

SEQ ID NO: 5419 - RNA, 17 nt, Homo sapiens
cgcaaaccaccugugac

SEQ ID NO: 5420 - RNA, 17 nt, Homo sapiens
caaaccaccugugacag

SEQ ID NO: 5421 - RNA, 17 nt, Homo sapiens
aaaccaccugugacagc

SEQ ID NO: 5422 - RNA, 17 nt, Homo sapiens
ccugugacagcuggcaa

SEQ ID NO: 5423 - RNA, 17 nt, Homo sapiens
gugacagcuggcaauuu

SEQ ID NO: 5424 - RNA, 17 nt, Homo sapiens
cagcuggcaauuuuaua

SEQ ID NO: 5425 - RNA, 17 nt, Homo sapiens
uauaaaucagguaacug

SEQ ID NO: 5426 - RNA, 17 nt, Homo sapiens
cagguaacuggaaggag

SEQ ID NO: 5427 - RNA, 17 nt, Homo sapiens
gguuaaacucagaaaaa

SEQ ID NO: 5428 - RNA, 17 nt, Homo sapiens
uuaaacucagaaaaaag

SEQ ID NO: 5429 - RNA, 17 nt, Homo sapiens
aagaagaccucagucaa

SEQ ID NO: 5430 - RNA, 17 nt, Homo sapiens
agaagaccucagucaau

SEQ ID NO: 5431 - RNA, 17 nt, Homo sapiens
aagaccucagucaauuc

SEQ ID NO: 5432 - RNA, 17 nt, Homo sapiens
ccucagucaauucucua

SEQ ID NO: 5433 - RNA, 17 nt, Homo sapiens
gucaauucucuacuuuu

SEQ ID NO: 5434 - RNA, 17 nt, Homo sapiens
caauucucuacuuuuuu

SEQ ID NO: 5435 - RNA, 17 nt, Homo sapiens
uucucuacuuuuuuuuu

SEQ ID NO: 5436 - RNA, 17 nt, Homo sapiens
uuuuuuuccaaaucaga

SEQ ID NO: 5437 - RNA, 17 nt, Homo sapiens
uuuuuuccaaaucagau

SEQ ID NO: 5438 - RNA, 17 nt, Homo sapiens
uccaaaucagauaauag

SEQ ID NO: 5439 - RNA, 17 nt, Homo sapiens
auaauagcccagcaaau

SEQ ID NO: 5440 - RNA, 17 nt, Homo sapiens
uaauagcccagcaaaua

SEQ ID NO: 5441 - RNA, 17 nt, Homo sapiens
aauagcccagcaaauag

SEQ ID NO: 5442 - RNA, 17 nt, Homo sapiens
agcccagcaaauaguga

SEQ ID NO: 5443 - RNA, 17 nt, Homo sapiens
gugauaacaaauaaaac

SEQ ID NO: 5444 - RNA, 17 nt, Homo sapiens
aauaaaaccuuagcugu

SEQ ID NO: 5445 - RNA, 17 nt, Homo sapiens
auaaaaccuuagcuguu

SEQ ID NO: 5446 - RNA, 17 nt, Homo sapiens
accuuagcuguucaugu

SEQ ID NO: 5447 - RNA, 17 nt, Homo sapiens
agcuguucaugucuuga

SEQ ID NO: 5448 - RNA, 17 nt, Homo sapiens
uucaugucuugauuuca

SEQ ID NO: 5449 - RNA, 17 nt, Homo sapiens
uugauuucaauaauuaa

SEQ ID NO: 5450 - RNA, 17 nt, Homo sapiens
auuaauucuuaaucauu

SEQ ID NO: 5451 - RNA, 17 nt, Homo sapiens
ucuuaaucauuaagaga

SEQ ID NO: 5452 - RNA, 17 nt, Homo sapiens
uaagagaccauaauaaa

SEQ ID NO: 5453 - RNA, 17 nt, Homo sapiens
aagagaccauaauaaau

SEQ ID NO: 5454 - RNA, 17 nt, Homo sapiens
auaaauacuccuuuuca

SEQ ID NO: 5455 - RNA, 17 nt, Homo sapiens
aaauacuccuuuucaag

SEQ ID NO: 5456 - RNA, 17 nt, Homo sapiens
aauacuccuuuucaaga

SEQ ID NO: 5457 - RNA, 17 nt, Homo sapiens
uccuuuucaagagaaaa

SEQ ID NO: 5458 - RNA, 17 nt, Homo sapiens
agaaaagcaaaaccauu

SEQ ID NO: 5459 - RNA, 17 nt, Homo sapiens
agcaaaaccauuagaau

SEQ ID NO: 5460 - RNA, 17 nt, Homo sapiens
gcaaaaccauuagaauu

SEQ ID NO: 5461 - RNA, 17 nt, Homo sapiens
auuguuacucagcuccu

SEQ ID NO: 5462 - RNA, 17 nt, Homo sapiens
uguuacucagcuccuuc

SEQ ID NO: 5463 - RNA, 17 nt, Homo sapiens
uacucagcuccuucaaa

SEQ ID NO: 5464 - RNA, 17 nt, Homo sapiens
cucagcuccuucaaacu

SEQ ID NO: 5465 - RNA, 17 nt, Homo sapiens
ucagcuccuucaaacuc

SEQ ID NO: 5466 - RNA, 17 nt, Homo sapiens
gcuccuucaaacucagg

SEQ ID NO: 5467 - RNA, 17 nt, Homo sapiens
cuucaaacucagguuug

SEQ ID NO: 5468 - RNA, 17 nt, Homo sapiens
ucaaacucagguuugua

SEQ ID NO: 5469 - RNA, 17 nt, Homo sapiens
uuuguagcauacaugag

SEQ ID NO: 5470 - RNA, 17 nt, Homo sapiens
uagcauacaugagucca

SEQ ID NO: 5471 - RNA, 17 nt, Homo sapiens
caugaguccauccauca

SEQ ID NO: 5472 - RNA, 17 nt, Homo sapiens
augaguccauccaucag

SEQ ID NO: 5473 - RNA, 17 nt, Homo sapiens
aguccauccaucaguca

SEQ ID NO: 5474 - RNA, 17 nt, Homo sapiens
guccauccaucagucaa

SEQ ID NO: 5475 - RNA, 17 nt, Homo sapiens
cauccaucagucaaaga

SEQ ID NO: 5476 - RNA, 17 nt, Homo sapiens
caucagucaaagaaugg

SEQ ID NO: 5477 - RNA, 17 nt, Homo sapiens
aaugguuccaucuggag

SEQ ID NO: 5478 - RNA, 17 nt, Homo sapiens
augguuccaucuggagu

SEQ ID NO: 5479 - RNA, 17 nt, Homo sapiens
guuccaucuggagucuu

SEQ ID NO: 5480 - RNA, 17 nt, Homo sapiens
cuggagucuuaauguag

SEQ ID NO: 5481 - RNA, 17 nt, Artificial Sequence
  Description of Artificial Sequence:  Nucleic Acid
auggagacuuguaauaa

SEQ ID NO: 5482 - RNA, 17 nt, Homo sapiens
uaaugagcuaguuacaa

SEQ ID NO: 5483 - RNA, 17 nt, Homo sapiens
cuaguuacaaagugcuu

SEQ ID NO: 5484 - RNA, 17 nt, Homo sapiens
caaagugcuuguucauu

SEQ ID NO: 5485 - RNA, 17 nt, Homo sapiens
gcuuguucauuaaaaua

SEQ ID NO: 5486 - RNA, 17 nt, Homo sapiens
aaaauagcacugaaaau

SEQ ID NO: 5487 - RNA, 17 nt, Homo sapiens
aauagcacugaaaauug

SEQ ID NO: 5488 - RNA, 17 nt, Homo sapiens
auugaaacaugaauuaa

SEQ ID NO: 5489 - RNA, 17 nt, Homo sapiens
gaauuaacugauaauau

SEQ ID NO: 5490 - RNA, 17 nt, Homo sapiens
uaauauuccaaucauuu

SEQ ID NO: 5491 - RNA, 17 nt, Homo sapiens
aauauuccaaucauuug

SEQ ID NO: 5492 - RNA, 17 nt, Homo sapiens
uuccaaucauuugccau

SEQ ID NO: 5493 - RNA, 17 nt, Homo sapiens
ucauuugccauuuauga

SEQ ID NO: 5494 - RNA, 17 nt, Homo sapiens
cauuugccauuuaugac

SEQ ID NO: 5495 - RNA, 17 nt, Homo sapiens
uuuaugacaaaaauggu

SEQ ID NO: 5496 - RNA, 17 nt, Homo sapiens
ugguuggcacuaacaaa

SEQ ID NO: 5497 - RNA, 17 nt, Homo sapiens
guuggcacuaacaaaga

SEQ ID NO: 5498 - RNA, 17 nt, Homo sapiens
gcacuaacaaagaacga

SEQ ID NO: 5499 - RNA, 17 nt, Homo sapiens
gaacgagcacuuccuuu

SEQ ID NO: 5500 - RNA, 17 nt, Homo sapiens
acgagcacuuccuuuca

SEQ ID NO: 5501 - RNA, 17 nt, Homo sapiens
agcacuuccuuucagag

SEQ ID NO: 5502 - RNA, 17 nt, Homo sapiens
gcacuuccuuucagagu

SEQ ID NO: 5503 - RNA, 17 nt, Homo sapiens
uuccuuucagaguuucu

SEQ ID NO: 5504 - RNA, 17 nt, Homo sapiens
agaguuucugagauaau

SEQ ID NO: 5505 - RNA, 17 nt, Homo sapiens
cguggaacagucugggu

SEQ ID NO: 5506 - RNA, 17 nt, Homo sapiens
gaacagucuggguggaa

SEQ ID NO: 5507 - RNA, 17 nt, Homo sapiens
aauggggcugaaaccau

SEQ ID NO: 5508 - RNA, 17 nt, Homo sapiens
gcugaaaccaugugcaa

SEQ ID NO: 5509 - RNA, 17 nt, Homo sapiens
cugaaaccaugugcaag

SEQ ID NO: 5510 - RNA, 17 nt, Homo sapiens
ccaugugcaagucugug

SEQ ID NO: 5511 - RNA, 17 nt, Homo sapiens
ugcaagucugugucuug

SEQ ID NO: 5512 - RNA, 17 nt, Homo sapiens
ucugugucuugucaguc

SEQ ID NO: 5513 - RNA, 17 nt, Homo sapiens
gucuugucaguccaaga

SEQ ID NO: 5514 - RNA, 17 nt, Homo sapiens
ugucaguccaagaagug

SEQ ID NO: 5515 - RNA, 17 nt, Homo sapiens
gucaguccaagaaguga

SEQ ID NO: 5516 - RNA, 17 nt, Homo sapiens
gaagugacaccgagaug

SEQ ID NO: 5517 - RNA, 17 nt, Homo sapiens
agugacaccgagauguu

SEQ ID NO: 5518 - RNA, 17 nt, Homo sapiens
uuagggacccgugccuu

SEQ ID NO: 5519 - RNA, 17 nt, Homo sapiens
uagggacccgugccuug

SEQ ID NO: 5520 - RNA, 17 nt, Homo sapiens
acccgugccuuguuucc

SEQ ID NO: 5521 - RNA, 17 nt, Homo sapiens
cccgugccuuguuuccu

SEQ ID NO: 5522 - RNA, 17 nt, Homo sapiens
cuuguuuccuagcccac

SEQ ID NO: 5523 - RNA, 17 nt, Homo sapiens
uuguuuccuagcccaca

SEQ ID NO: 5524 - RNA, 17 nt, Homo sapiens
uuccuagcccacaagaa

SEQ ID NO: 5525 - RNA, 17 nt, Homo sapiens
uccuagcccacaagaau

SEQ ID NO: 5526 - RNA, 17 nt, Homo sapiens
ccuagcccacaagaaug

SEQ ID NO: 5527 - RNA, 17 nt, Homo sapiens
uagcccacaagaaugca

SEQ ID NO: 5528 - RNA, 17 nt, Homo sapiens
aagaaugcaaacaucaa

SEQ ID NO: 5529 - RNA, 17 nt, Homo sapiens
augcaaacaucaaacag

SEQ ID NO: 5530 - RNA, 17 nt, Homo sapiens
caaacaucaaacagaua

SEQ ID NO: 5531 - RNA, 17 nt, Homo sapiens
caucaaacagauacucg

SEQ ID NO: 5532 - RNA, 17 nt, Homo sapiens
acagauacucgcuagcc

SEQ ID NO: 5533 - RNA, 17 nt, Homo sapiens
auacucgcuagccucau

SEQ ID NO: 5534 - RNA, 17 nt, Homo sapiens
ucgcuagccucauuuaa

SEQ ID NO: 5535 - RNA, 17 nt, Homo sapiens
cgcuagccucauuuaaa

SEQ ID NO: 5536 - RNA, 17 nt, Homo sapiens
cuagccucauuuaaauu

SEQ ID NO: 5537 - RNA, 17 nt, Homo sapiens
aggagugcaucuuuggc

SEQ ID NO: 5538 - RNA, 17 nt, Homo sapiens
agugcaucuuuggccga

SEQ ID NO: 5539 - RNA, 17 nt, Homo sapiens
ucuuuggccgacagugg

SEQ ID NO: 5540 - RNA, 17 nt, Homo sapiens
uggccgacaguggugua

SEQ ID NO: 5541 - RNA, 17 nt, Homo sapiens
gguguaacugugugugu

SEQ ID NO: 5542 - RNA, 17 nt, Homo sapiens
uuuugugcauaacuauu

SEQ ID NO: 5543 - RNA, 17 nt, Homo sapiens
ugcauaacuauuuaagg

SEQ ID NO: 5544 - RNA, 17 nt, Homo sapiens
aaggaaacuggaauuuu

SEQ ID NO: 5545 - RNA, 17 nt, Homo sapiens
aaaguuacuuuuauaca

SEQ ID NO: 5546 - RNA, 17 nt, Homo sapiens
uuuuauacaaaccaaga

SEQ ID NO: 5547 - RNA, 17 nt, Homo sapiens
auacaaaccaagaauau

SEQ ID NO: 5548 - RNA, 17 nt, Homo sapiens
uacaaaccaagaauaua

SEQ ID NO: 5549 - RNA, 17 nt, Homo sapiens
auauaugcuacagauau

SEQ ID NO: 5550 - RNA, 17 nt, Homo sapiens
uaugcuacagauauaag

SEQ ID NO: 5551 - RNA, 17 nt, Homo sapiens
uauaagacagacauggu

SEQ ID NO: 5552 - RNA, 17 nt, Homo sapiens
agacagacaugguuugg

SEQ ID NO: 5553 - RNA, 17 nt, Homo sapiens
guuugguccuauauuuc

SEQ ID NO: 5554 - RNA, 17 nt, Homo sapiens
uuugguccuauauuucu

SEQ ID NO: 5555 - RNA, 17 nt, Homo sapiens
uauauuucuagucauga

SEQ ID NO: 5556 - RNA, 17 nt, Homo sapiens
uucuagucaugaugaau

SEQ ID NO: 5557 - RNA, 17 nt, Homo sapiens
uuguauaccaucuucau

SEQ ID NO: 5558 - RNA, 17 nt, Homo sapiens
uguauaccaucuucaua

SEQ ID NO: 5559 - RNA, 17 nt, Homo sapiens
auaccaucuucauauaa

SEQ ID NO: 5560 - RNA, 17 nt, Homo sapiens
ccaucuucauauaauau

SEQ ID NO: 5561 - RNA, 17 nt, Homo sapiens
uaauauacuuaaaaaua

SEQ ID NO: 5562 - RNA, 17 nt, Homo sapiens
aauauuucuuaauuggg

SEQ ID NO: 5563 - RNA, 17 nt, Homo sapiens
aaucguaccaacuuaau

SEQ ID NO: 5564 - RNA, 17 nt, Homo sapiens
aucguaccaacuuaauu

SEQ ID NO: 5565 - RNA, 17 nt, Homo sapiens
guaccaacuuaauugau

SEQ ID NO: 5566 - RNA, 17 nt, Homo sapiens
ugauaaacuuggcaacu

SEQ ID NO: 5567 - RNA, 17 nt, Homo sapiens
aacuuggcaacugcuuu

SEQ ID NO: 5568 - RNA, 17 nt, Homo sapiens
uuggcaacugcuuuuau

SEQ ID NO: 5569 - RNA, 17 nt, Homo sapiens
gcaacugcuuuuauguu

SEQ ID NO: 5570 - RNA, 17 nt, Homo sapiens
uuauguucugucuccuu

SEQ ID NO: 5571 - RNA, 17 nt, Homo sapiens
guucugucuccuuccau

SEQ ID NO: 5572 - RNA, 17 nt, Homo sapiens
ucugucuccuuccauaa

SEQ ID NO: 5573 - RNA, 17 nt, Homo sapiens
cugucuccuuccauaaa

SEQ ID NO: 5574 - RNA, 17 nt, Homo sapiens
ucuccuuccauaaauuu

SEQ ID NO: 5575 - RNA, 17 nt, Homo sapiens
cuccuuccauaaauuuu

SEQ ID NO: 5576 - RNA, 17 nt, Homo sapiens
aauuuuucaaaauacua

SEQ ID NO: 5577 - RNA, 17 nt, Homo sapiens
caaaauacuaauucaac

SEQ ID NO: 5578 - RNA, 17 nt, Homo sapiens
acuaauucaacaaagaa

SEQ ID NO: 5579 - RNA, 17 nt, Homo sapiens
aauucaacaaagaaaaa

SEQ ID NO: 5580 - RNA, 17 nt, Homo sapiens
gaaaaagcucuuuuuuu

SEQ ID NO: 5581 - RNA, 17 nt, Homo sapiens
aaaagcucuuuuuuuuc

SEQ ID NO: 5582 - RNA, 17 nt, Homo sapiens
uuuuuuuccuaaaauaa

SEQ ID NO: 5583 - RNA, 17 nt, Homo sapiens
uuuuuuccuaaaauaaa

SEQ ID NO: 5584 - RNA, 17 nt, Homo sapiens
aaauaaacucaaauuua

SEQ ID NO: 5585 - RNA, 17 nt, Homo sapiens
auaaacucaaauuuauc

SEQ ID NO: 5586 - RNA, 17 nt, Homo sapiens
aauuuauccuuguuuag

SEQ ID NO: 5587 - RNA, 17 nt, Homo sapiens
auuuauccuuguuuaga

SEQ ID NO: 5588 - RNA, 17 nt, Homo sapiens
uuuagagcagagaaaaa

SEQ ID NO: 5589 - RNA, 17 nt, Homo sapiens
agaaaaacuuugaaaug

SEQ ID NO: 5590 - RNA, 17 nt, Homo sapiens
aaauggucucaaaaaau

SEQ ID NO: 5591 - RNA, 17 nt, Homo sapiens
auggucucaaaaaauug

SEQ ID NO: 5592 - RNA, 17 nt, Homo sapiens
aaaauugcuaaauauuu

SEQ ID NO: 5593 - RNA, 17 nt, Homo sapiens
auauuuucaauggaaaa

SEQ ID NO: 5594 - RNA, 17 nt, Homo sapiens
uggaaaacuaaauguua

SEQ ID NO: 5595 - RNA, 17 nt, Homo sapiens
aguuuagcugauuguau

SEQ ID NO: 5596 - RNA, 17 nt, Homo sapiens
uuucgaaccuuucacuu

SEQ ID NO: 5597 - RNA, 17 nt, Homo sapiens
uucgaaccuuucacuuu

SEQ ID NO: 5598 - RNA, 17 nt, Homo sapiens
aaccuuucacuuuuugu

SEQ ID NO: 5599 - RNA, 17 nt, Homo sapiens
ccuuucacuuuuuguuu

SEQ ID NO: 5600 - RNA, 17 nt, Homo sapiens
uguuuuaccuauuucac

SEQ ID NO: 5601 - RNA, 17 nt, Homo sapiens
guuuuaccuauuucaca

SEQ ID NO: 5602 - RNA, 17 nt, Homo sapiens
ccuauuucacaacugug

SEQ ID NO: 5603 - RNA, 17 nt, Homo sapiens
uauuucacaacugugua

SEQ ID NO: 5604 - RNA, 17 nt, Homo sapiens
uucacaacuguguaaau

SEQ ID NO: 5605 - RNA, 17 nt, Homo sapiens
uaaauugccaauaauuc

SEQ ID NO: 5606 - RNA, 17 nt, Homo sapiens
aaauugccaauaauucc

SEQ ID NO: 5607 - RNA, 17 nt, Homo sapiens
aauaauuccuguccaug

SEQ ID NO: 5608 - RNA, 17 nt, Homo sapiens
auaauuccuguccauga

SEQ ID NO: 5609 - RNA, 17 nt, Homo sapiens
uuccuguccaugaaaau

SEQ ID NO: 5610 - RNA, 17 nt, Homo sapiens
uccuguccaugaaaaug

SEQ ID NO: 5611 - RNA, 17 nt, Homo sapiens
gaaaaugcaaauuaucc

SEQ ID NO: 5612 - RNA, 17 nt, Homo sapiens
aaauuauccaguguaga

SEQ ID NO: 5613 - RNA, 17 nt, Homo sapiens
aauuauccaguguagau

SEQ ID NO: 5614 - RNA, 17 nt, Homo sapiens
uauuugaccaucacccu

SEQ ID NO: 5615 - RNA, 17 nt, Homo sapiens
auuugaccaucacccua

SEQ ID NO: 5616 - RNA, 17 nt, Homo sapiens
ugaccaucacccuaugg

SEQ ID NO: 5617 - RNA, 17 nt, Homo sapiens
accaucacccuauggau

SEQ ID NO: 5618 - RNA, 17 nt, Homo sapiens
ccaucacccuauggaua

SEQ ID NO: 5619 - RNA, 17 nt, Homo sapiens
caucacccuauggauau

SEQ ID NO: 5620 - RNA, 17 nt, Homo sapiens
auauuggcuaguuuugc

SEQ ID NO: 5621 - RNA, 17 nt, Homo sapiens
aguuuugccuuuauuaa

SEQ ID NO: 5622 - RNA, 17 nt, Homo sapiens
guuuugccuuuauuaag

SEQ ID NO: 5623 - RNA, 17 nt, Homo sapiens
uauuaagcaaauucauu

SEQ ID NO: 5624 - RNA, 17 nt, Homo sapiens
gcaaauucauuucagcc

SEQ ID NO: 5625 - RNA, 17 nt, Homo sapiens
uucauuucagccugaau

SEQ ID NO: 5626 - RNA, 17 nt, Homo sapiens
auuucagccugaauguc

SEQ ID NO: 5627 - RNA, 17 nt, Homo sapiens
uuucagccugaaugucu

SEQ ID NO: 5628 - RNA, 17 nt, Homo sapiens
ugaaugucugccuauau

SEQ ID NO: 5629 - RNA, 17 nt, Homo sapiens
augucugccuauauauu

SEQ ID NO: 5630 - RNA, 17 nt, Homo sapiens
ugucugccuauauauuc

SEQ ID NO: 5631 - RNA, 17 nt, Homo sapiens
auauauucucugcucuu

SEQ ID NO: 5632 - RNA, 17 nt, Homo sapiens
auauucucugcucuuug

SEQ ID NO: 5633 - RNA, 17 nt, Homo sapiens
uucucugcucuuuguau

SEQ ID NO: 5634 - RNA, 17 nt, Homo sapiens
cucugcucuuuguauuc

SEQ ID NO: 5635 - RNA, 17 nt, Homo sapiens
uuguauucuccuuugaa

SEQ ID NO: 5636 - RNA, 17 nt, Homo sapiens
guauucuccuuugaacc

SEQ ID NO: 5637 - RNA, 17 nt, Homo sapiens
uauucuccuuugaaccc

SEQ ID NO: 5638 - RNA, 17 nt, Homo sapiens
cuuugaacccguuaaaa

SEQ ID NO: 5639 - RNA, 17 nt, Homo sapiens
uuugaacccguuaaaac

SEQ ID NO: 5640 - RNA, 17 nt, Homo sapiens
guuaaaacauccugugg

SEQ ID NO: 5641 - RNA, 17 nt, Homo sapiens
aaaacauccuguggcac

SEQ ID NO: 5642 - RNA, 17 nt, Homo sapiens
aaacauccuguggcacu

SEQ ID NO: 5643 - RNA, 16 nt, Homo sapiens
gggcucgggugcagcg

SEQ ID NO: 5644 - RNA, 16 nt, Homo sapiens
gccuggcggcgaggau

SEQ ID NO: 5645 - RNA, 16 nt, Homo sapiens
ggaagugguugucucc

SEQ ID NO: 5646 - RNA, 16 nt, Homo sapiens
ggcuggagccgcgaga

SEQ ID NO: 5647 - RNA, 16 nt, Homo sapiens
cuggagccgcgagacg

SEQ ID NO: 5648 - RNA, 16 nt, Homo sapiens
cgagacgggcgcucag

SEQ ID NO: 5649 - RNA, 16 nt, Homo sapiens
cgcucagggcgcgggg

SEQ ID NO: 5650 - RNA, 16 nt, Homo sapiens
cggcggcggcgaacga

SEQ ID NO: 5651 - RNA, 16 nt, Homo sapiens
ggcggcgaacgagagg

SEQ ID NO: 5652 - RNA, 16 nt, Homo sapiens
ccgggggagcgcgggc

SEQ ID NO: 5653 - RNA, 16 nt, Homo sapiens
ggcaccgggcgagcag

SEQ ID NO: 5654 - RNA, 16 nt, Homo sapiens
cgagcaggccgcgucg

SEQ ID NO: 5655 - RNA, 16 nt, Homo sapiens
aggccgcgucgcgcuc

SEQ ID NO: 5656 - RNA, 16 nt, Homo sapiens
gccgcgucgcgcucac

SEQ ID NO: 5657 - RNA, 16 nt, Homo sapiens
ccgggguccugcugug

SEQ ID NO: 5658 - RNA, 16 nt, Homo sapiens
ggguccugcugugcgc

SEQ ID NO: 5659 - RNA, 16 nt, Homo sapiens
guccugcugugcgcgc

SEQ ID NO: 5660 - RNA, 16 nt, Homo sapiens
ccugcugugcgcgcug

SEQ ID NO: 5661 - RNA, 16 nt, Homo sapiens
ugcugugcgcgcugcu

SEQ ID NO: 5662 - RNA, 16 nt, Homo sapiens
ugugcgcgcugcucag

SEQ ID NO: 5663 - RNA, 16 nt, Homo sapiens
cugcucagcugucugc

SEQ ID NO: 5664 - RNA, 16 nt, Homo sapiens
ucagcugucugcuucu

SEQ ID NO: 5665 - RNA, 16 nt, Homo sapiens
aaaagauccugaacug

SEQ ID NO: 5666 - RNA, 16 nt, Homo sapiens
auccugaacugaguuu

SEQ ID NO: 5667 - RNA, 16 nt, Homo sapiens
agcacaucaugcaagc

SEQ ID NO: 5668 - RNA, 16 nt, Homo sapiens
gccagacacugcaucu

SEQ ID NO: 5669 - RNA, 16 nt, Homo sapiens
caucuccaaugcaggg

SEQ ID NO: 5670 - RNA, 16 nt, Homo sapiens
aauggucuuugccuga

SEQ ID NO: 5671 - RNA, 16 nt, Homo sapiens
gucuuugccugaaaug

SEQ ID NO: 5672 - RNA, 16 nt, Homo sapiens
cugaaauggugaguaa

SEQ ID NO: 5673 - RNA, 16 nt, Homo sapiens
uaaggaaagcgaaagg

SEQ ID NO: 5674 - RNA, 16 nt, Homo sapiens
gcgaaaggcugagcau

SEQ ID NO: 5675 - RNA, 16 nt, Homo sapiens
aacuaaaucugccugu

SEQ ID NO: 5676 - RNA, 16 nt, Homo sapiens
aaaucugccuguggaa

SEQ ID NO: 5677 - RNA, 16 nt, Homo sapiens
aaacaauucugcagua

SEQ ID NO: 5678 - RNA, 16 nt, Homo sapiens
cuuuaaccuugaacac

SEQ ID NO: 5679 - RNA, 16 nt, Homo sapiens
uucuacagcugcaaau

SEQ ID NO: 5680 - RNA, 16 nt, Homo sapiens
auaucuagcuguaccu

SEQ ID NO: 5681 - RNA, 16 nt, Homo sapiens
aacagaaucugcaauc

SEQ ID NO: 5682 - RNA, 16 nt, Homo sapiens
auuuauuagugauaca

SEQ ID NO: 5683 - RNA, 16 nt, Homo sapiens
ucguagagauguacag

SEQ ID NO: 5684 - RNA, 16 nt, Homo sapiens
gauguacagugaaauc

SEQ ID NO: 5685 - RNA, 16 nt, Homo sapiens
ugaaauccccgaaauu

SEQ ID NO: 5686 - RNA, 16 nt, Homo sapiens
uuauacacaugacuga

SEQ ID NO: 5687 - RNA, 16 nt, Homo sapiens
acacaugacugaagga

SEQ ID NO: 5688 - RNA, 16 nt, Homo sapiens
gucauucccugccggg

SEQ ID NO: 5689 - RNA, 16 nt, Homo sapiens
uaacaucacuguuacu

SEQ ID NO: 5690 - RNA, 16 nt, Homo sapiens
guuuccacuugacacu

SEQ ID NO: 5691 - RNA, 16 nt, Homo sapiens
uugacacuuugauccc

SEQ ID NO: 5692 - RNA, 16 nt, Homo sapiens
uuugaucccugaugga

SEQ ID NO: 5693 - RNA, 16 nt, Homo sapiens
gauggaaaacgcauaa

SEQ ID NO: 5694 - RNA, 16 nt, Homo sapiens
cauaucaaaugcaacg

SEQ ID NO: 5695 - RNA, 16 nt, Homo sapiens
uagggcuucugaccug

SEQ ID NO: 5696 - RNA, 16 nt, Homo sapiens
cuucugaccugugaag

SEQ ID NO: 5697 - RNA, 16 nt, Homo sapiens
ucugaccugugaagca

SEQ ID NO: 5698 - RNA, 16 nt, Homo sapiens
augggcauuuguauaa

SEQ ID NO: 5699 - RNA, 16 nt, Homo sapiens
cucacacaucgacaaa

SEQ ID NO: 5700 - RNA, 16 nt, Homo sapiens
aaucauagauguccaa

SEQ ID NO: 5701 - RNA, 16 nt, Homo sapiens
agcacaccacgcccag

SEQ ID NO: 5702 - RNA, 16 nt, Homo sapiens
ccauacucuuguccuc

SEQ ID NO: 5703 - RNA, 16 nt, Homo sapiens
guccucaauuguacug

SEQ ID NO: 5704 - RNA, 16 nt, Homo sapiens
caauuguacugcuacc

SEQ ID NO: 5705 - RNA, 16 nt, Homo sapiens
ccacucccuugaacac

SEQ ID NO: 5706 - RNA, 16 nt, Homo sapiens
ccuugaacacgagagu

SEQ ID NO: 5707 - RNA, 16 nt, Homo sapiens
gaguucaaaugaccug

SEQ ID NO: 5708 - RNA, 16 nt, Homo sapiens
gaguuacccugaugaa

SEQ ID NO: 5709 - RNA, 16 nt, Homo sapiens
uuacccugaugaaaaa

SEQ ID NO: 5710 - RNA, 16 nt, Homo sapiens
uccguaaggcgacgaa

SEQ ID NO: 5711 - RNA, 16 nt, Homo sapiens
guaaggcgacgaauug

SEQ ID NO: 5712 - RNA, 16 nt, Homo sapiens
gcgacgaauugaccaa

SEQ ID NO: 5713 - RNA, 16 nt, Homo sapiens
caauucccaugccaac

SEQ ID NO: 5714 - RNA, 16 nt, Homo sapiens
auucuacaguguucuu

SEQ ID NO: 5715 - RNA, 16 nt, Homo sapiens
ucuuacuauugacaaa

SEQ ID NO: 5716 - RNA, 16 nt, Homo sapiens
uugacaaaaugcagaa

SEQ ID NO: 5717 - RNA, 16 nt, Homo sapiens
cuuuauacuugucgug

SEQ ID NO: 5718 - RNA, 16 nt, Homo sapiens
uacuugucguguaagg

SEQ ID NO: 5719 - RNA, 16 nt, Homo sapiens
auucaaaucuguuaac

SEQ ID NO: 5720 - RNA, 16 nt, Homo sapiens
acaccucagugcauau

SEQ ID NO: 5721 - RNA, 16 nt, Homo sapiens
gcauauauaugauaaa

SEQ ID NO: 5722 - RNA, 16 nt, Homo sapiens
auucaucacugugaaa

SEQ ID NO: 5723 - RNA, 16 nt, Homo sapiens
ucaucacugugaaaca

SEQ ID NO: 5724 - RNA, 16 nt, Homo sapiens
gugaaacaucgaaaac

SEQ ID NO: 5725 - RNA, 16 nt, Homo sapiens
aacagcaggugcuuga

SEQ ID NO: 5726 - RNA, 16 nt, Homo sapiens
gcaggugcuugaaacc

SEQ ID NO: 5727 - RNA, 16 nt, Homo sapiens
ggcucucuaugaaagu

SEQ ID NO: 5728 - RNA, 16 nt, Homo sapiens
cuaugaaagugaaggc

SEQ ID NO: 5729 - RNA, 16 nt, Homo sapiens
cauuucccucgccgga

SEQ ID NO: 5730 - RNA, 16 nt, Homo sapiens
gccggaaguuguaugg

SEQ ID NO: 5731 - RNA, 16 nt, Homo sapiens
uggguuaccugcgacu

SEQ ID NO: 5732 - RNA, 16 nt, Homo sapiens
gguuaccugcgacuga

SEQ ID NO: 5733 - RNA, 16 nt, Homo sapiens
accugcgacugagaaa

SEQ ID NO: 5734 - RNA, 16 nt, Homo sapiens
ugagaaaucugcucgc

SEQ ID NO: 5735 - RNA, 16 nt, Homo sapiens
aaaucugcucgcuauu

SEQ ID NO: 5736 - RNA, 16 nt, Homo sapiens
cucgcuauuugacucg

SEQ ID NO: 5737 - RNA, 16 nt, Homo sapiens
ggacguaacugaagag

SEQ ID NO: 5738 - RNA, 16 nt, Homo sapiens
ugaagaggaugcaggg

SEQ ID NO: 5739 - RNA, 16 nt, Homo sapiens
auacaaucuugcugag

SEQ ID NO: 5740 - RNA, 16 nt, Homo sapiens
caaucuugcugagcau

SEQ ID NO: 5741 - RNA, 16 nt, Homo sapiens
acagucaaauguguuu

SEQ ID NO: 5742 - RNA, 16 nt, Homo sapiens
agucaaauguguuuaa

SEQ ID NO: 5743 - RNA, 16 nt, Homo sapiens
aaaccucacugccacu

SEQ ID NO: 5744 - RNA, 16 nt, Homo sapiens
cacucuaauugucaau

SEQ ID NO: 5745 - RNA, 16 nt, Homo sapiens
aauugucaaugugaaa

SEQ ID NO: 5746 - RNA, 16 nt, Homo sapiens
uugucaaugugaaacc

SEQ ID NO: 5747 - RNA, 16 nt, Homo sapiens
ccagauuuacgaaaag

SEQ ID NO: 5748 - RNA, 16 nt, Homo sapiens
aaaaggccgugucauc

SEQ ID NO: 5749 - RNA, 16 nt, Homo sapiens
gacaaauccugacuug

SEQ ID NO: 5750 - RNA, 16 nt, Homo sapiens
auccugacuuguaccg

SEQ ID NO: 5751 - RNA, 16 nt, Homo sapiens
gacuuguaccgcauau

SEQ ID NO: 5752 - RNA, 16 nt, Homo sapiens
uggcaccccuguaacc

SEQ ID NO: 5753 - RNA, 16 nt, Homo sapiens
uaaucauuccgaagca

SEQ ID NO: 5754 - RNA, 16 nt, Homo sapiens
gaagcaaggugugacu

SEQ ID NO: 5755 - RNA, 16 nt, Homo sapiens
agcaaggugugacuuu

SEQ ID NO: 5756 - RNA, 16 nt, Homo sapiens
ugugacuuuuguucca

SEQ ID NO: 5757 - RNA, 16 nt, Homo sapiens
uuccaauaaugaagag

SEQ ID NO: 5758 - RNA, 16 nt, Homo sapiens
uauccuggaugcugac

SEQ ID NO: 5759 - RNA, 16 nt, Homo sapiens
ccuggaugcugacagc

SEQ ID NO: 5760 - RNA, 16 nt, Homo sapiens
aaacagaauugagagc

SEQ ID NO: 5761 - RNA, 16 nt, Homo sapiens
aucacucagcgcaugg

SEQ ID NO: 5762 - RNA, 16 nt, Homo sapiens
caccuugguuguggcu

SEQ ID NO: 5763 - RNA, 16 nt, Homo sapiens
gguuguggcugacucu

SEQ ID NO: 5764 - RNA, 16 nt, Homo sapiens
aucuacauuugcauag

SEQ ID NO: 5765 - RNA, 16 nt, Homo sapiens
aguugggacuguggga

SEQ ID NO: 5766 - RNA, 16 nt, Homo sapiens
uaucacagaugugcca

SEQ ID NO: 5767 - RNA, 16 nt, Homo sapiens
ucacagaugugccaaa

SEQ ID NO: 5768 - RNA, 16 nt, Homo sapiens
uggguuucauguuaac

SEQ ID NO: 5769 - RNA, 16 nt, Homo sapiens
uggaaaaaaugccgac

SEQ ID NO: 5770 - RNA, 16 nt, Homo sapiens
aaaaaaugccgacgga

SEQ ID NO: 5771 - RNA, 16 nt, Homo sapiens
gagaggaccugaaacu

SEQ ID NO: 5772 - RNA, 16 nt, Homo sapiens
accugaaacugucuug

SEQ ID NO: 5773 - RNA, 16 nt, Homo sapiens
aaacugucuugcacag

SEQ ID NO: 5774 - RNA, 16 nt, Homo sapiens
ggauuuuacugcggac

SEQ ID NO: 5775 - RNA, 16 nt, Homo sapiens
acagaacaaugcacua

SEQ ID NO: 5776 - RNA, 16 nt, Homo sapiens
uuaccaucaugaaugu

SEQ ID NO: 5777 - RNA, 16 nt, Homo sapiens
caucaugaauguuucc

SEQ ID NO: 5778 - RNA, 16 nt, Homo sapiens
auguuucccugcaaga

SEQ ID NO: 5779 - RNA, 16 nt, Homo sapiens
aggcaccuaugccugc

SEQ ID NO: 5780 - RNA, 16 nt, Homo sapiens
accuaugccugcagag

SEQ ID NO: 5781 - RNA, 16 nt, Homo sapiens
agccaggaauguauac

SEQ ID NO: 5782 - RNA, 16 nt, Homo sapiens
cauaccuccugcgaaa

SEQ ID NO: 5783 - RNA, 16 nt, Homo sapiens
uaccuccugcgaaacc

SEQ ID NO: 5784 - RNA, 16 nt, Homo sapiens
aaaccucagugaucac

SEQ ID NO: 5785 - RNA, 16 nt, Homo sapiens
acuuuagacugucaug

SEQ ID NO: 5786 - RNA, 16 nt, Homo sapiens
agacugucaugcuaau

SEQ ID NO: 5787 - RNA, 16 nt, Homo sapiens
ugcuaauggugucccc

SEQ ID NO: 5788 - RNA, 16 nt, Homo sapiens
ugguguccccgagccu

SEQ ID NO: 5789 - RNA, 16 nt, Homo sapiens
gaagcagcacgcuguu

SEQ ID NO: 5790 - RNA, 16 nt, Homo sapiens
gcagcacgcuguuuau

SEQ ID NO: 5791 - RNA, 16 nt, Homo sapiens
gcuguuuauugaaaga

SEQ ID NO: 5792 - RNA, 16 nt, Homo sapiens
agaagaggaugaaggu

SEQ ID NO: 5793 - RNA, 16 nt, Homo sapiens
ggaugaaggugucuau

SEQ ID NO: 5794 - RNA, 16 nt, Homo sapiens
gucuaucacugcaaag

SEQ ID NO: 5795 - RNA, 16 nt, Homo sapiens
gaagggcucuguggaa

SEQ ID NO: 5796 - RNA, 16 nt, Homo sapiens
auaccucacuguucaa

SEQ ID NO: 5797 - RNA, 16 nt, Homo sapiens
aucuggagcugaucac

SEQ ID NO: 5798 - RNA, 16 nt, Homo sapiens
acucuaacaugcaccu

SEQ ID NO: 5799 - RNA, 16 nt, Homo sapiens
acaugcaccugugugg

SEQ ID NO: 5800 - RNA, 16 nt, Homo sapiens
augcaccuguguggcu

SEQ ID NO: 5801 - RNA, 16 nt, Homo sapiens
cuguguggcugcgacu

SEQ ID NO: 5802 - RNA, 16 nt, Homo sapiens
guguggcugcgacucu

SEQ ID NO: 5803 - RNA, 16 nt, Homo sapiens
cuccuuauccgaaaaa

SEQ ID NO: 5804 - RNA, 16 nt, Homo sapiens
uccgaaaaaugaaaag

SEQ ID NO: 5805 - RNA, 16 nt, Homo sapiens
gucuucuucugaaaua

SEQ ID NO: 5806 - RNA, 16 nt, Homo sapiens
aauaaagacugacuac

SEQ ID NO: 5807 - RNA, 16 nt, Homo sapiens
ggacccagaugaaguu

SEQ ID NO: 5808 - RNA, 16 nt, Homo sapiens
uccuuuggaugagcag

SEQ ID NO: 5809 - RNA, 16 nt, Homo sapiens
gaugagcagugugagc

SEQ ID NO: 5810 - RNA, 16 nt, Homo sapiens
ugagcagugugagcgg

SEQ ID NO: 5811 - RNA, 16 nt, Homo sapiens
gcucccuuaugaugcc

SEQ ID NO: 5812 - RNA, 16 nt, Homo sapiens
cccuuaugaugccagc

SEQ ID NO: 5813 - RNA, 16 nt, Homo sapiens
gugggaguuugcccgg

SEQ ID NO: 5814 - RNA, 16 nt, Homo sapiens
ucaccuacgugccgga

SEQ ID NO: 5815 - RNA, 16 nt, Homo sapiens
gugccggacuguggcu

SEQ ID NO: 5816 - RNA, 16 nt, Homo sapiens
gacuguggcugugaaa

SEQ ID NO: 5817 - RNA, 16 nt, Homo sapiens
cuguggcugugaaaau

SEQ ID NO: 5818 - RNA, 16 nt, Homo sapiens
cugugaaaaugcugaa

SEQ ID NO: 5819 - RNA, 16 nt, Homo sapiens
ugaaaaugcugaaaga

SEQ ID NO: 5820 - RNA, 16 nt, Homo sapiens
cacggccagcgaguac

SEQ ID NO: 5821 - RNA, 16 nt, Homo sapiens
acaaagcucugaugac

SEQ ID NO: 5822 - RNA, 16 nt, Homo sapiens
aagcucugaugacuga

SEQ ID NO: 5823 - RNA, 16 nt, Homo sapiens
ucugaugacugagcua

SEQ ID NO: 5824 - RNA, 16 nt, Homo sapiens
uaaaaaucuugaccca

SEQ ID NO: 5825 - RNA, 16 nt, Homo sapiens
gccaccaucugaacgu

SEQ ID NO: 5826 - RNA, 16 nt, Homo sapiens
ugguuaaccugcuggg

SEQ ID NO: 5827 - RNA, 16 nt, Homo sapiens
cugggagccugcacca

SEQ ID NO: 5828 - RNA, 16 nt, Homo sapiens
gagggccucugauggu

SEQ ID NO: 5829 - RNA, 16 nt, Homo sapiens
cucugauggugauugu

SEQ ID NO: 5830 - RNA, 16 nt, Homo sapiens
gauggugauuguugaa

SEQ ID NO: 5831 - RNA, 16 nt, Homo sapiens
ggugauuguugaauac

SEQ ID NO: 5832 - RNA, 16 nt, Homo sapiens
guugaauacugcaaau

SEQ ID NO: 5833 - RNA, 16 nt, Homo sapiens
gagcaaacgugacuua

SEQ ID NO: 5834 - RNA, 16 nt, Homo sapiens
caacaaggaugcagca

SEQ ID NO: 5835 - RNA, 16 nt, Homo sapiens
caccagcagcgaaagc

SEQ ID NO: 5836 - RNA, 16 nt, Homo sapiens
cgaaagcuuugcgagc

SEQ ID NO: 5837 - RNA, 16 nt, Homo sapiens
aaagcuuugcgagcuc

SEQ ID NO: 5838 - RNA, 16 nt, Homo sapiens
auaaaagucugaguga

SEQ ID NO: 5839 - RNA, 16 nt, Homo sapiens
aagucugagugauguu

SEQ ID NO: 5840 - RNA, 16 nt, Homo sapiens
ucugagugauguugag

SEQ ID NO: 5841 - RNA, 16 nt, Homo sapiens
gagugauguugaggaa

SEQ ID NO: 5842 - RNA, 16 nt, Homo sapiens
ggaggauucugacggu

SEQ ID NO: 5843 - RNA, 16 nt, Homo sapiens
uggaagaucugauuuc

SEQ ID NO: 5844 - RNA, 16 nt, Homo sapiens
uggaguuccugucuuc

SEQ ID NO: 5845 - RNA, 16 nt, Homo sapiens
uccagaaagugcauuc

SEQ ID NO: 5846 - RNA, 16 nt, Homo sapiens
accuggcagcgagaaa

SEQ ID NO: 5847 - RNA, 16 nt, Homo sapiens
ucuuuuaucugagaac

SEQ ID NO: 5848 - RNA, 16 nt, Homo sapiens
acaacguggugaagau

SEQ ID NO: 5849 - RNA, 16 nt, Homo sapiens
gugaagauuugugauu

SEQ ID NO: 5850 - RNA, 16 nt, Homo sapiens
gaagauuugugauuuu

SEQ ID NO: 5851 - RNA, 16 nt, Homo sapiens
uuuuggccuugcccgg

SEQ ID NO: 5852 - RNA, 16 nt, Homo sapiens
uaagaaccccgauuau

SEQ ID NO: 5853 - RNA, 16 nt, Homo sapiens
ccccgauuaugugaga

SEQ ID NO: 5854 - RNA, 16 nt, Homo sapiens
ccgauuaugugagaaa

SEQ ID NO: 5855 - RNA, 16 nt, Homo sapiens
ggagauacucgacuuc

SEQ ID NO: 5856 - RNA, 16 nt, Homo sapiens
gacuuccucugaaaug

SEQ ID NO: 5857 - RNA, 16 nt, Homo sapiens
gauggcucccgaaucu

SEQ ID NO: 5858 - RNA, 16 nt, Homo sapiens
aucuaucuuugacaaa

SEQ ID NO: 5859 - RNA, 16 nt, Homo sapiens
caccaagagcgacgug

SEQ ID NO: 5860 - RNA, 16 nt, Homo sapiens
agagcgacgugugguc

SEQ ID NO: 5861 - RNA, 16 nt, Homo sapiens
acggaguauugcugug

SEQ ID NO: 5862 - RNA, 16 nt, Homo sapiens
gaguauugcuguggga

SEQ ID NO: 5863 - RNA, 16 nt, Homo sapiens
acaaauggaugaggac

SEQ ID NO: 5864 - RNA, 16 nt, Homo sapiens
gaggacuuuugcaguc

SEQ ID NO: 5865 - RNA, 16 nt, Homo sapiens
uuuugcagucgccuga

SEQ ID NO: 5866 - RNA, 16 nt, Homo sapiens
gcagucgccugaggga

SEQ ID NO: 5867 - RNA, 16 nt, Homo sapiens
gggaaggcaugaggau

SEQ ID NO: 5868 - RNA, 16 nt, Homo sapiens
gcaugaggaugagagc

SEQ ID NO: 5869 - RNA, 16 nt, Homo sapiens
gagagcuccugaguac

SEQ ID NO: 5870 - RNA, 16 nt, Homo sapiens
cucuacuccugaaauc

SEQ ID NO: 5871 - RNA, 16 nt, Homo sapiens
aucagaucaugcugga

SEQ ID NO: 5872 - RNA, 16 nt, Homo sapiens
augcuggacugcuggc

SEQ ID NO: 5873 - RNA, 16 nt, Homo sapiens
gccaagauuugcagaa

SEQ ID NO: 5874 - RNA, 16 nt, Homo sapiens
ugcagaacuuguggaa

SEQ ID NO: 5875 - RNA, 16 nt, Homo sapiens
aaaacuaggugauuug

SEQ ID NO: 5876 - RNA, 16 nt, Homo sapiens
uaggugauuugcuuca

SEQ ID NO: 5877 - RNA, 16 nt, Homo sapiens
ucaagcaaauguacaa

SEQ ID NO: 5878 - RNA, 16 nt, Homo sapiens
cccaaucaaugccaua

SEQ ID NO: 5879 - RNA, 16 nt, Homo sapiens
augccauacugacagg

SEQ ID NO: 5880 - RNA, 16 nt, Homo sapiens
cucaacuccugccuuc

SEQ ID NO: 5881 - RNA, 16 nt, Homo sapiens
ugccuucucugaggac

SEQ ID NO: 5882 - RNA, 16 nt, Homo sapiens
uuucagcuccgaaguu

SEQ ID NO: 5883 - RNA, 16 nt, Homo sapiens
aggaagcucugaugau

SEQ ID NO: 5884 - RNA, 16 nt, Homo sapiens
aagcucugaugauguc

SEQ ID NO: 5885 - RNA, 16 nt, Homo sapiens
cucugaugaugucaga

SEQ ID NO: 5886 - RNA, 16 nt, Homo sapiens
ugucagauauguaaau

SEQ ID NO: 5887 - RNA, 16 nt, Homo sapiens
auauguaaaugcuuuc

SEQ ID NO: 5888 - RNA, 16 nt, Homo sapiens
ucaaguucaugagccu

SEQ ID NO: 5889 - RNA, 16 nt, Homo sapiens
caaaaccuuugaagaa

SEQ ID NO: 5890 - RNA, 16 nt, Homo sapiens
aacuuuuaccgaaugc

SEQ ID NO: 5891 - RNA, 16 nt, Homo sapiens
uuuaccgaaugccacc

SEQ ID NO: 5892 - RNA, 16 nt, Homo sapiens
ccaccuccauguuuga

SEQ ID NO: 5893 - RNA, 16 nt, Homo sapiens
cuccauguuugaugac

SEQ ID NO: 5894 - RNA, 16 nt, Homo sapiens
cauguuugaugacuac

SEQ ID NO: 5895 - RNA, 16 nt, Homo sapiens
cuaccagggcgacagc

SEQ ID NO: 5896 - RNA, 16 nt, Homo sapiens
gcagcacucuguuggc

SEQ ID NO: 5897 - RNA, 16 nt, Homo sapiens
ccucucccaugcugaa

SEQ ID NO: 5898 - RNA, 16 nt, Homo sapiens
cucccaugcugaagcg

SEQ ID NO: 5899 - RNA, 16 nt, Homo sapiens
augcugaagcgcuuca

SEQ ID NO: 5900 - RNA, 16 nt, Homo sapiens
caccuggacugacagc

SEQ ID NO: 5901 - RNA, 16 nt, Homo sapiens
ccaaggccucgcucaa

SEQ ID NO: 5902 - RNA, 16 nt, Homo sapiens
gcucaagauugacuug

SEQ ID NO: 5903 - RNA, 16 nt, Homo sapiens
agauugacuugagagu

SEQ ID NO: 5904 - RNA, 16 nt, Homo sapiens
agucggggcugucuga

SEQ ID NO: 5905 - RNA, 16 nt, Homo sapiens
ggggcugucugauguc

SEQ ID NO: 5906 - RNA, 16 nt, Homo sapiens
gcugucugaugucagc

SEQ ID NO: 5907 - RNA, 16 nt, Homo sapiens
cccaguuucugccauu

SEQ ID NO: 5908 - RNA, 16 nt, Homo sapiens
cauuccagcugugggc

SEQ ID NO: 5909 - RNA, 16 nt, Homo sapiens
gcacgucagcgaaggc

SEQ ID NO: 5910 - RNA, 16 nt, Homo sapiens
gaaggcaagcgcaggu

SEQ ID NO: 5911 - RNA, 16 nt, Homo sapiens
guucaccuacgaccac

SEQ ID NO: 5912 - RNA, 16 nt, Homo sapiens
cuacgaccacgcugag

SEQ ID NO: 5913 - RNA, 16 nt, Homo sapiens
cgaccacgcugagcug

SEQ ID NO: 5914 - RNA, 16 nt, Homo sapiens
aaggaaaaucgcgugc

SEQ ID NO: 5915 - RNA, 16 nt, Homo sapiens
aaaaucgcgugcugcu

SEQ ID NO: 5916 - RNA, 16 nt, Homo sapiens
aucgcgugcugcuccc

SEQ ID NO: 5917 - RNA, 16 nt, Homo sapiens
gcugcuccccgccccc

SEQ ID NO: 5918 - RNA, 16 nt, Homo sapiens
cggugguccuguacuc

SEQ ID NO: 5919 - RNA, 16 nt, Homo sapiens
ucuagaguuugacacg

SEQ ID NO: 5920 - RNA, 16 nt, Homo sapiens
aguuugacacgaagcc

SEQ ID NO: 5921 - RNA, 16 nt, Homo sapiens
agaagcacauguguau

SEQ ID NO: 5922 - RNA, 16 nt, Homo sapiens
aagcacauguguauuu

SEQ ID NO: 5923 - RNA, 16 nt, Homo sapiens
acuagcuuuugccagu

SEQ ID NO: 5924 - RNA, 16 nt, Homo sapiens
ccaguauuaugcauau

SEQ ID NO: 5925 - RNA, 16 nt, Homo sapiens
ggagccagcugcuuuu

SEQ ID NO: 5926 - RNA, 16 nt, Homo sapiens
gcugcuuuuugugauu

SEQ ID NO: 5927 - RNA, 16 nt, Homo sapiens
ugcuuuuugugauuuu

SEQ ID NO: 5928 - RNA, 16 nt, Homo sapiens
uuuuaauagugcuuuu

SEQ ID NO: 5929 - RNA, 16 nt, Homo sapiens
uuuuuuuuuugacuaa

SEQ ID NO: 5930 - RNA, 16 nt, Homo sapiens
uaacaagaauguaacu

SEQ ID NO: 5931 - RNA, 16 nt, Homo sapiens
gagaaauagugacaag

SEQ ID NO: 5932 - RNA, 16 nt, Homo sapiens
agugacaagugaagaa

SEQ ID NO: 5933 - RNA, 16 nt, Homo sapiens
gaacacuacugcuaaa

SEQ ID NO: 5934 - RNA, 16 nt, Homo sapiens
aaauccucauguuacu

SEQ ID NO: 5935 - RNA, 16 nt, Homo sapiens
guuacucaguguuaga

SEQ ID NO: 5936 - RNA, 16 nt, Homo sapiens
uaaacccaaugacuuc

SEQ ID NO: 5937 - RNA, 16 nt, Homo sapiens
ugacuucccugcucca

SEQ ID NO: 5938 - RNA, 16 nt, Homo sapiens
uccaacccccgccacc

SEQ ID NO: 5939 - RNA, 16 nt, Homo sapiens
cucagggcacgcagga

SEQ ID NO: 5940 - RNA, 16 nt, Homo sapiens
ggaccaguuugauuga

SEQ ID NO: 5941 - RNA, 16 nt, Homo sapiens
caguuugauugaggag

SEQ ID NO: 5942 - RNA, 16 nt, Homo sapiens
uugaggagcugcacug

SEQ ID NO: 5943 - RNA, 16 nt, Homo sapiens
gagcugcacugaucac

SEQ ID NO: 5944 - RNA, 16 nt, Homo sapiens
aucacccaaugcauca

SEQ ID NO: 5945 - RNA, 16 nt, Homo sapiens
ggccagcccugcagcc

SEQ ID NO: 5946 - RNA, 16 nt, Homo sapiens
uggcuggccugagcaa

SEQ ID NO: 5947 - RNA, 16 nt, Homo sapiens
ccuaagacaugugagg

SEQ ID NO: 5948 - RNA, 16 nt, Homo sapiens
uaagacaugugaggag

SEQ ID NO: 5949 - RNA, 16 nt, Homo sapiens
gagaaggcaugagaaa

SEQ ID NO: 5950 - RNA, 16 nt, Homo sapiens
gaaagaauuugagacg

SEQ ID NO: 5951 - RNA, 16 nt, Homo sapiens
aauuugagacgcacca

SEQ ID NO: 5952 - RNA, 16 nt, Homo sapiens
gacgcaccaugugggc

SEQ ID NO: 5953 - RNA, 16 nt, Homo sapiens
gcucagcaaugccauu

SEQ ID NO: 5954 - RNA, 16 nt, Homo sapiens
ucccagcucugacccu

SEQ ID NO: 5955 - RNA, 16 nt, Homo sapiens
uucuacauuugagggc

SEQ ID NO: 5956 - RNA, 16 nt, Homo sapiens
gauggacagcgaugag

SEQ ID NO: 5957 - RNA, 16 nt, Homo sapiens
ggacagcgaugagggg

SEQ ID NO: 5958 - RNA, 16 nt, Homo sapiens
gugguucuauguccau

SEQ ID NO: 5959 - RNA, 16 nt, Homo sapiens
uucguggcauguuuug

SEQ ID NO: 5960 - RNA, 16 nt, Homo sapiens
ggcauguuuugauuug

SEQ ID NO: 5961 - RNA, 16 nt, Homo sapiens
guuuugauuuguagca

SEQ ID NO: 5962 - RNA, 16 nt, Homo sapiens
uuguagcacugagggu

SEQ ID NO: 5963 - RNA, 16 nt, Homo sapiens
acucaacucugagccc

SEQ ID NO: 5964 - RNA, 16 nt, Homo sapiens
cuaguaagaugcacug

SEQ ID NO: 5965 - RNA, 16 nt, Homo sapiens
aagaugcacugaaaac

SEQ ID NO: 5966 - RNA, 16 nt, Homo sapiens
gaguuagguugucucc

SEQ ID NO: 5967 - RNA, 16 nt, Homo sapiens
uccaggccaugauggc

SEQ ID NO: 5968 - RNA, 16 nt, Homo sapiens
gccuuacacugaaaau

SEQ ID NO: 5969 - RNA, 16 nt, Homo sapiens
cacugaaaaugucaca

SEQ ID NO: 5970 - RNA, 16 nt, Homo sapiens
guauuauucuguuuug

SEQ ID NO: 5971 - RNA, 16 nt, Homo sapiens
auucuguuuugcacag

SEQ ID NO: 5972 - RNA, 16 nt, Homo sapiens
acaguuaguugugaaa

SEQ ID NO: 5973 - RNA, 16 nt, Homo sapiens
aguuaguugugaaaga

SEQ ID NO: 5974 - RNA, 16 nt, Homo sapiens
aaagaaagcugagaag

SEQ ID NO: 5975 - RNA, 16 nt, Homo sapiens
ugagaagaaugaaaau

SEQ ID NO: 5976 - RNA, 16 nt, Homo sapiens
gaaugaaaaugcaguc

SEQ ID NO: 5977 - RNA, 16 nt, Homo sapiens
augcaguccugaggag

SEQ ID NO: 5978 - RNA, 16 nt, Homo sapiens
auaucaaaacgagggc

SEQ ID NO: 5979 - RNA, 16 nt, Homo sapiens
aacgagggcugaugga

SEQ ID NO: 5980 - RNA, 16 nt, Homo sapiens
acacuaaucugaaagg

SEQ ID NO: 5981 - RNA, 16 nt, Homo sapiens
cugaaaggauguggaa

SEQ ID NO: 5982 - RNA, 16 nt, Homo sapiens
auuagcuggcgcauau

SEQ ID NO: 5983 - RNA, 16 nt, Homo sapiens
uaagcuccuugaguaa

SEQ ID NO: 5984 - RNA, 16 nt, Homo sapiens
aaggugguauguaauu

SEQ ID NO: 5985 - RNA, 16 nt, Homo sapiens
uguaauuuaugcaagg

SEQ ID NO: 5986 - RNA, 16 nt, Homo sapiens
auuaguuaaugagcca

SEQ ID NO: 5987 - RNA, 16 nt, Homo sapiens
auuuucaacugcuuug

SEQ ID NO: 5988 - RNA, 16 nt, Homo sapiens
caacugcuuugaaacu

SEQ ID NO: 5989 - RNA, 16 nt, Homo sapiens
uuugaaacuugccugg

SEQ ID NO: 5990 - RNA, 16 nt, Homo sapiens
ccuggggucugagcau

SEQ ID NO: 5991 - RNA, 16 nt, Homo sapiens
gucugagcaugauggg

SEQ ID NO: 5992 - RNA, 16 nt, Homo sapiens
aggaaagggcgccuac

SEQ ID NO: 5993 - RNA, 16 nt, Homo sapiens
gccuuggaucgcuaag

SEQ ID NO: 5994 - RNA, 16 nt, Homo sapiens
agcuggcucuguuuga

SEQ ID NO: 5995 - RNA, 16 nt, Homo sapiens
ggcucuguuugaugcu

SEQ ID NO: 5996 - RNA, 16 nt, Homo sapiens
ucuguuugaugcuauu

SEQ ID NO: 5997 - RNA, 16 nt, Homo sapiens
ugcuauuuaugcaagu

SEQ ID NO: 5998 - RNA, 16 nt, Homo sapiens
uagggucuauguauuu

SEQ ID NO: 5999 - RNA, 16 nt, Homo sapiens
uauuuaggaugcgccu

SEQ ID NO: 6000 - RNA, 16 nt, Homo sapiens
uuuaggaugcgccuac

SEQ ID NO: 6001 - RNA, 16 nt, Homo sapiens
uauuuaggaugucugc

SEQ ID NO: 6002 - RNA, 16 nt, Homo sapiens
uaggaugucugcaccu

SEQ ID NO: 6003 - RNA, 16 nt, Homo sapiens
ugcaccuucugcagcc

SEQ ID NO: 6004 - RNA, 16 nt, Homo sapiens
acaguggauugcugcu

SEQ ID NO: 6005 - RNA, 16 nt, Homo sapiens
guggauugcugcuucu

SEQ ID NO: 6006 - RNA, 16 nt, Homo sapiens
agaagaguaugcuucc

SEQ ID NO: 6007 - RNA, 16 nt, Homo sapiens
uuuuauccauguaauu

SEQ ID NO: 6008 - RNA, 16 nt, Homo sapiens
uaauuuaacuguagaa

SEQ ID NO: 6009 - RNA, 16 nt, Homo sapiens
uguagaaccugagcuc

SEQ ID NO: 6010 - RNA, 16 nt, Homo sapiens
cuaaguaaccgaagaa

SEQ ID NO: 6011 - RNA, 16 nt, Homo sapiens
accgaagaauguaugc

SEQ ID NO: 6012 - RNA, 16 nt, Homo sapiens
aagaauguaugccucu

SEQ ID NO: 6013 - RNA, 16 nt, Homo sapiens
guaugccucuguucuu

SEQ ID NO: 6014 - RNA, 16 nt, Homo sapiens
cuguucuuaugugcca

SEQ ID NO: 6015 - RNA, 16 nt, Homo sapiens
guucuuaugugccaca

SEQ ID NO: 6016 - RNA, 16 nt, Homo sapiens
ccacauccuuguuuaa

SEQ ID NO: 6017 - RNA, 16 nt, Homo sapiens
aaggcucucuguauga

SEQ ID NO: 6018 - RNA, 16 nt, Homo sapiens
cucucuguaugaagag

SEQ ID NO: 6019 - RNA, 16 nt, Homo sapiens
auucccuagugagccu

SEQ ID NO: 6020 - RNA, 16 nt, Homo sapiens
agcggcuuuuguggaa

SEQ ID NO: 6021 - RNA, 16 nt, Homo sapiens
acaaaucuuuguuguu

SEQ ID NO: 6022 - RNA, 16 nt, Homo sapiens
aaucuuuguuguuccu

SEQ ID NO: 6023 - RNA, 16 nt, Homo sapiens
uuacacauacgcaaac

SEQ ID NO: 6024 - RNA, 16 nt, Homo sapiens
caaaccaccugugaca

SEQ ID NO: 6025 - RNA, 16 nt, Homo sapiens
aaccaccugugacagc

SEQ ID NO: 6026 - RNA, 16 nt, Homo sapiens
agcaaauagugauaac

SEQ ID NO: 6027 - RNA, 16 nt, Homo sapiens
aaccuuagcuguucau

SEQ ID NO: 6028 - RNA, 16 nt, Homo sapiens
agcuguucaugucuug

SEQ ID NO: 6029 - RNA, 16 nt, Homo sapiens
uucaugucuugauuuc

SEQ ID NO: 6030 - RNA, 16 nt, Homo sapiens
cauuagaauuguuacu

SEQ ID NO: 6031 - RNA, 16 nt, Homo sapiens
acucagguuuguagca

SEQ ID NO: 6032 - RNA, 16 nt, Homo sapiens
uagcauacaugagucc

SEQ ID NO: 6033 - RNA, 16 nt, Homo sapiens
gagucuuaauguagaa

SEQ ID NO: 6034 - RNA, 16 nt, Homo sapiens
auggagacuuguaaua

SEQ ID NO: 6035 - RNA, 16 nt, Homo sapiens
uuguaauaaugagcua

SEQ ID NO: 6036 - RNA, 16 nt, Homo sapiens
guuacaaagugcuugu

SEQ ID NO: 6037 - RNA, 16 nt, Homo sapiens
caaagugcuuguucau

SEQ ID NO: 6038 - RNA, 16 nt, Homo sapiens
aaauagcacugaaaau

SEQ ID NO: 6039 - RNA, 16 nt, Homo sapiens
acugaaaauugaaaca

SEQ ID NO: 6040 - RNA, 16 nt, Homo sapiens
auugaaacaugaauua

SEQ ID NO: 6041 - RNA, 16 nt, Homo sapiens
ugaauuaacugauaau

SEQ ID NO: 6042 - RNA, 16 nt, Homo sapiens
ccaaucauuugccauu

SEQ ID NO: 6043 - RNA, 16 nt, Homo sapiens
ugccauuuaugacaaa

SEQ ID NO: 6044 - RNA, 16 nt, Homo sapiens
aacaaagaacgagcac

SEQ ID NO: 6045 - RNA, 16 nt, Homo sapiens
cagaguuucugagaua

SEQ ID NO: 6046 - RNA, 16 nt, Homo sapiens
cugagauaauguacgu

SEQ ID NO: 6047 - RNA, 16 nt, Homo sapiens
gaauggggcugaaacc

SEQ ID NO: 6048 - RNA, 16 nt, Homo sapiens
cugaaaccaugugcaa

SEQ ID NO: 6049 - RNA, 16 nt, Homo sapiens
gaaaccaugugcaagu

SEQ ID NO: 6050 - RNA, 16 nt, Homo sapiens
gugcaagucugugucu

SEQ ID NO: 6051 - RNA, 16 nt, Homo sapiens
gcaagucugugucuug

SEQ ID NO: 6052 - RNA, 16 nt, Homo sapiens
ucugugucuugucagu

SEQ ID NO: 6053 - RNA, 16 nt, Homo sapiens
uccaagaagugacacc

SEQ ID NO: 6054 - RNA, 16 nt, Homo sapiens
aagugacaccgagaug

SEQ ID NO: 6055 - RNA, 16 nt, Homo sapiens
acaccgagauguuaau

SEQ ID NO: 6056 - RNA, 16 nt, Homo sapiens
agggacccgugccuug

SEQ ID NO: 6057 - RNA, 16 nt, Homo sapiens
cccgugccuuguuucc

SEQ ID NO: 6058 - RNA, 16 nt, Homo sapiens
ccacaagaaugcaaac

SEQ ID NO: 6059 - RNA, 16 nt, Homo sapiens
acagauacucgcuagc

SEQ ID NO: 6060 - RNA, 16 nt, Homo sapiens
cauuuaaauugauuaa

SEQ ID NO: 6061 - RNA, 16 nt, Homo sapiens
aaggaggagugcaucu

SEQ ID NO: 6062 - RNA, 16 nt, Homo sapiens
aucuuuggccgacagu

SEQ ID NO: 6063 - RNA, 16 nt, Homo sapiens
cgacagugguguaacu

SEQ ID NO: 6064 - RNA, 16 nt, Homo sapiens
ugguguaacugugugu

SEQ ID NO: 6065 - RNA, 16 nt, Homo sapiens
guguaacugugugugu

SEQ ID NO: 6066 - RNA, 16 nt, Homo sapiens
guaacugugugugugu

SEQ ID NO: 6067 - RNA, 16 nt, Homo sapiens
aacugugugugugugu

SEQ ID NO: 6068 - RNA, 16 nt, Homo sapiens
cugugugugugugugu

SEQ ID NO: 6069 - RNA, 16 nt, Homo sapiens
gugugugugugugugu

SEQ ID NO: 6070 - RNA, 16 nt, Homo sapiens
gugugugugugugugg

SEQ ID NO: 6071 - RNA, 16 nt, Homo sapiens
gugugugugugugggu

SEQ ID NO: 6072 - RNA, 16 nt, Homo sapiens
gugugugggugugggu

SEQ ID NO: 6073 - RNA, 16 nt, Homo sapiens
ggguguggguguaugu

SEQ ID NO: 6074 - RNA, 16 nt, Homo sapiens
guggguguaugugugu

SEQ ID NO: 6075 - RNA, 16 nt, Homo sapiens
ggguguauguguguuu

SEQ ID NO: 6076 - RNA, 16 nt, Homo sapiens
guguauguguguuuug

SEQ ID NO: 6077 - RNA, 16 nt, Homo sapiens
uguguguuuugugcau

SEQ ID NO: 6078 - RNA, 16 nt, Homo sapiens
uguguuuugugcauaa

SEQ ID NO: 6079 - RNA, 16 nt, Homo sapiens
aagaauauaugcuaca

SEQ ID NO: 6080 - RNA, 16 nt, Homo sapiens
uucuagucaugaugaa

SEQ ID NO: 6081 - RNA, 16 nt, Homo sapiens
uagucaugaugaaugu

SEQ ID NO: 6082 - RNA, 16 nt, Homo sapiens
caugaugaauguauuu

SEQ ID NO: 6083 - RNA, 16 nt, Homo sapiens
aauguauuuuguauac

SEQ ID NO: 6084 - RNA, 16 nt, Homo sapiens
auugggauuuguaauc

SEQ ID NO: 6085 - RNA, 16 nt, Homo sapiens
caacuuaauugauaaa

SEQ ID NO: 6086 - RNA, 16 nt, Homo sapiens
cuuggcaacugcuuuu

SEQ ID NO: 6087 - RNA, 16 nt, Homo sapiens
cugcuuuuauguucug

SEQ ID NO: 6088 - RNA, 16 nt, Homo sapiens
uuuauguucugucucc

SEQ ID NO: 6089 - RNA, 16 nt, Homo sapiens
auuuauccuuguuuag

SEQ ID NO: 6090 - RNA, 16 nt, Homo sapiens
gaaaaacuuugaaaug

SEQ ID NO: 6091 - RNA, 16 nt, Homo sapiens
ucaaaaaauugcuaaa

SEQ ID NO: 6092 - RNA, 16 nt, Homo sapiens
aaaacuaaauguuagu

SEQ ID NO: 6093 - RNA, 16 nt, Homo sapiens
uaguuuagcugauugu

SEQ ID NO: 6094 - RNA, 16 nt, Homo sapiens
uuagcugauuguaugg

SEQ ID NO: 6095 - RNA, 16 nt, Homo sapiens
ugggguuuucgaaccu

SEQ ID NO: 6096 - RNA, 16 nt, Homo sapiens
uucacuuuuuguuugu

SEQ ID NO: 6097 - RNA, 16 nt, Homo sapiens
cuuuuuguuuguuuua

SEQ ID NO: 6098 - RNA, 16 nt, Homo sapiens
uuucacaacuguguaa

SEQ ID NO: 6099 - RNA, 16 nt, Homo sapiens
ucacaacuguguaaau

SEQ ID NO: 6100 - RNA, 16 nt, Homo sapiens
uguguaaauugccaau

SEQ ID NO: 6101 - RNA, 16 nt, Homo sapiens
aauaauuccuguccau

SEQ ID NO: 6102 - RNA, 16 nt, Homo sapiens
uccuguccaugaaaau

SEQ ID NO: 6103 - RNA, 16 nt, Homo sapiens
ccaugaaaaugcaaau

SEQ ID NO: 6104 - RNA, 16 nt, Homo sapiens
auuauccaguguagau

SEQ ID NO: 6105 - RNA, 16 nt, Homo sapiens
agauauauuugaccau

SEQ ID NO: 6106 - RNA, 16 nt, Homo sapiens
ggcuaguuuugccuuu

SEQ ID NO: 6107 - RNA, 16 nt, Homo sapiens
auuucagccugaaugu

SEQ ID NO: 6108 - RNA, 16 nt, Homo sapiens
cagccugaaugucugc

SEQ ID NO: 6109 - RNA, 16 nt, Homo sapiens
cugaaugucugccuau

SEQ ID NO: 6110 - RNA, 16 nt, Homo sapiens
uauauucucugcucuu

SEQ ID NO: 6111 - RNA, 16 nt, Homo sapiens
ucugcucuuuguauuc

SEQ ID NO: 6112 - RNA, 16 nt, Homo sapiens
auucuccuuugaaccc

SEQ ID NO: 6113 - RNA, 16 nt, Homo sapiens
aaaacauccuguggca

SEQ ID NO: 6114 - RNA, 17 nt, Homo sapiens
caaggugcugcuggccg

SEQ ID NO: 6115 - RNA, 17 nt, Homo sapiens
ggugcugcuggccgucg

SEQ ID NO: 6116 - RNA, 17 nt, Homo sapiens
cugcuggccgucgcccu

SEQ ID NO: 6117 - RNA, 17 nt, Homo sapiens
gccgucgcccuguggcu

SEQ ID NO: 6118 - RNA, 17 nt, Homo sapiens
ccgucgcccuguggcuc

SEQ ID NO: 6119 - RNA, 17 nt, Homo sapiens
cgucgcccuguggcucu

SEQ ID NO: 6120 - RNA, 17 nt, Homo sapiens
ccuguggcucugcgugg

SEQ ID NO: 6121 - RNA, 17 nt, Homo sapiens
uguggcucugcguggag

SEQ ID NO: 6122 - RNA, 17 nt, Homo sapiens
guggagacccgggccgc

SEQ ID NO: 6123 - RNA, 17 nt, Homo sapiens
uggagacccgggccgcc

SEQ ID NO: 6124 - RNA, 17 nt, Homo sapiens
acccgggccgccucugu

SEQ ID NO: 6125 - RNA, 17 nt, Homo sapiens
cgggccgccucuguggg

SEQ ID NO: 6126 - RNA, 17 nt, Homo sapiens
gggccgccucugugggu

SEQ ID NO: 6127 - RNA, 17 nt, Homo sapiens
gccgccucuguggguuu

SEQ ID NO: 6128 - RNA, 17 nt, Homo sapiens
ggguuugccuaguguuu

SEQ ID NO: 6129 - RNA, 17 nt, Homo sapiens
gguuugccuaguguuuc

SEQ ID NO: 6130 - RNA, 17 nt, Homo sapiens
aguguuucucuugaucu

SEQ ID NO: 6131 - RNA, 17 nt, Homo sapiens
uguuucucuugaucugc

SEQ ID NO: 6132 - RNA, 17 nt, Homo sapiens
ucuugaucugcccaggc

SEQ ID NO: 6133 - RNA, 17 nt, Homo sapiens
ugaucugcccaggcuca

SEQ ID NO: 6134 - RNA, 17 nt, Homo sapiens
gaucugcccaggcucag

SEQ ID NO: 6135 - RNA, 17 nt, Homo sapiens
aucugcccaggcucagc

SEQ ID NO: 6136 - RNA, 17 nt, Homo sapiens
gcccaggcucagcauac

SEQ ID NO: 6137 - RNA, 17 nt, Homo sapiens
ccaggcucagcauacaa

SEQ ID NO: 6138 - RNA, 17 nt, Homo sapiens
ggcucagcauacaaaaa

SEQ ID NO: 6139 - RNA, 17 nt, Homo sapiens
cagcauacaaaaagaca

SEQ ID NO: 6140 - RNA, 17 nt, Homo sapiens
aaaaagacauacuuaca

SEQ ID NO: 6141 - RNA, 17 nt, Homo sapiens
agacauacuuacaauua

SEQ ID NO: 6142 - RNA, 17 nt, Homo sapiens
auacuuacaauuaaggc

SEQ ID NO: 6143 - RNA, 17 nt, Homo sapiens
auuaaggcuaauacaac

SEQ ID NO: 6144 - RNA, 17 nt, Homo sapiens
gcuaauacaacucuuca

SEQ ID NO: 6145 - RNA, 17 nt, Homo sapiens
aauacaacucuucaaau

SEQ ID NO: 6146 - RNA, 17 nt, Homo sapiens
uacaacucuucaaauua

SEQ ID NO: 6147 - RNA, 17 nt, Homo sapiens
aacucuucaaauuacuu

SEQ ID NO: 6148 - RNA, 17 nt, Homo sapiens
caaauuacuugcagggg

SEQ ID NO: 6149 - RNA, 17 nt, Homo sapiens
uuacuugcaggggacag

SEQ ID NO: 6150 - RNA, 17 nt, Homo sapiens
caggggacagagggacu

SEQ ID NO: 6151 - RNA, 17 nt, Homo sapiens
agagggacuuggacugg

SEQ ID NO: 6152 - RNA, 17 nt, Homo sapiens
acuuggacuggcuuugg

SEQ ID NO: 6153 - RNA, 17 nt, Homo sapiens
ggacuggcuuuggccca

SEQ ID NO: 6154 - RNA, 17 nt, Homo sapiens
gcuuuggcccaauaauc

SEQ ID NO: 6155 - RNA, 17 nt, Homo sapiens
cuuuggcccaauaauca

SEQ ID NO: 6156 - RNA, 17 nt, Homo sapiens
uuuggcccaauaaucag

SEQ ID NO: 6157 - RNA, 17 nt, Homo sapiens
caauaaucagaguggca

SEQ ID NO: 6158 - RNA, 17 nt, Homo sapiens
agaguggcagugagcaa

SEQ ID NO: 6159 - RNA, 17 nt, Homo sapiens
cagugagcaaagggugg

SEQ ID NO: 6160 - RNA, 17 nt, Homo sapiens
gaggugacugagugcag

SEQ ID NO: 6161 - RNA, 17 nt, Homo sapiens
cugagugcagcgauggc

SEQ ID NO: 6162 - RNA, 17 nt, Homo sapiens
gcgauggccucuucugu

SEQ ID NO: 6163 - RNA, 17 nt, Homo sapiens
cgauggccucuucugua

SEQ ID NO: 6164 - RNA, 17 nt, Homo sapiens
auggccucuucuguaag

SEQ ID NO: 6165 - RNA, 17 nt, Homo sapiens
gccucuucuguaagaca

SEQ ID NO: 6166 - RNA, 17 nt, Homo sapiens
uguaagacacucacaau

SEQ ID NO: 6167 - RNA, 17 nt, Homo sapiens
uaagacacucacaauuc

SEQ ID NO: 6168 - RNA, 17 nt, Homo sapiens
agacacucacaauucca

SEQ ID NO: 6169 - RNA, 17 nt, Homo sapiens
acacucacaauuccaaa

SEQ ID NO: 6170 - RNA, 17 nt, Homo sapiens
cacaauuccaaaaguga

SEQ ID NO: 6171 - RNA, 17 nt, Homo sapiens
acaauuccaaaagugau

SEQ ID NO: 6172 - RNA, 17 nt, Homo sapiens
gaaaugacacuggagcc

SEQ ID NO: 6173 - RNA, 17 nt, Homo sapiens
aaugacacuggagccua

SEQ ID NO: 6174 - RNA, 17 nt, Homo sapiens
acuggagccuacaagug

SEQ ID NO: 6175 - RNA, 17 nt, Homo sapiens
cuggagccuacaagugc

SEQ ID NO: 6176 - RNA, 17 nt, Homo sapiens
gagccuacaagugcuuc

SEQ ID NO: 6177 - RNA, 17 nt, Homo sapiens
acaagugcuucuaccgg

SEQ ID NO: 6178 - RNA, 17 nt, Homo sapiens
agugcuucuaccgggaa

SEQ ID NO: 6179 - RNA, 17 nt, Homo sapiens
gcuucuaccgggaaacu

SEQ ID NO: 6180 - RNA, 17 nt, Homo sapiens
cgggaaacugacuuggc

SEQ ID NO: 6181 - RNA, 17 nt, Homo sapiens
aaacugacuuggccucg

SEQ ID NO: 6182 - RNA, 17 nt, Homo sapiens
gacuuggccucggucau

SEQ ID NO: 6183 - RNA, 17 nt, Homo sapiens
acuuggccucggucauu

SEQ ID NO: 6184 - RNA, 17 nt, Homo sapiens
ccucggucauuuauguc

SEQ ID NO: 6185 - RNA, 17 nt, Homo sapiens
uuuaugucuauguucaa

SEQ ID NO: 6186 - RNA, 17 nt, Homo sapiens
cuauguucaagauuaca

SEQ ID NO: 6187 - RNA, 17 nt, Homo sapiens
aagauuacagaucucca

SEQ ID NO: 6188 - RNA, 17 nt, Homo sapiens
uacagaucuccauuuau

SEQ ID NO: 6189 - RNA, 17 nt, Homo sapiens
cagaucuccauuuauug

SEQ ID NO: 6190 - RNA, 17 nt, Homo sapiens
agaucuccauuuauugc

SEQ ID NO: 6191 - RNA, 17 nt, Homo sapiens
uuuauugcuucuguuag

SEQ ID NO: 6192 - RNA, 17 nt, Homo sapiens
auugcuucuguuaguga

SEQ ID NO: 6193 - RNA, 17 nt, Homo sapiens
uuagugaccaacaugga

SEQ ID NO: 6194 - RNA, 17 nt, Homo sapiens
uagugaccaacauggag

SEQ ID NO: 6195 - RNA, 17 nt, Homo sapiens
ugaccaacauggagucg

SEQ ID NO: 6196 - RNA, 17 nt, Homo sapiens
ucguguacauuacugag

SEQ ID NO: 6197 - RNA, 17 nt, Homo sapiens
uacauuacugagaacaa

SEQ ID NO: 6198 - RNA, 17 nt, Homo sapiens
cugagaacaaaaacaaa

SEQ ID NO: 6199 - RNA, 17 nt, Homo sapiens
acaaaaacaaaacugug

SEQ ID NO: 6200 - RNA, 17 nt, Homo sapiens
aacaaaacuguggugau

SEQ ID NO: 6201 - RNA, 17 nt, Homo sapiens
ggugauuccaugucucg

SEQ ID NO: 6202 - RNA, 17 nt, Homo sapiens
gugauuccaugucucgg

SEQ ID NO: 6203 - RNA, 17 nt, Homo sapiens
uccaugucucgggucca

SEQ ID NO: 6204 - RNA, 17 nt, Homo sapiens
cucggguccauuucaaa

SEQ ID NO: 6205 - RNA, 17 nt, Homo sapiens
ucggguccauuucaaau

SEQ ID NO: 6206 - RNA, 17 nt, Homo sapiens
uccauuucaaaucucaa

SEQ ID NO: 6207 - RNA, 17 nt, Homo sapiens
uucaaaucucaacgugu

SEQ ID NO: 6208 - RNA, 17 nt, Homo sapiens
caaaucucaacguguca

SEQ ID NO: 6209 - RNA, 17 nt, Homo sapiens
aacgugucacuuugugc

SEQ ID NO: 6210 - RNA, 17 nt, Homo sapiens
cgugucacuuugugcaa

SEQ ID NO: 6211 - RNA, 17 nt, Homo sapiens
cuuugugcaagauaccc

SEQ ID NO: 6212 - RNA, 17 nt, Homo sapiens
caagauacccagaaaag

SEQ ID NO: 6213 - RNA, 17 nt, Homo sapiens
aagauacccagaaaaga

SEQ ID NO: 6214 - RNA, 17 nt, Homo sapiens
agauacccagaaaagag

SEQ ID NO: 6215 - RNA, 17 nt, Homo sapiens
auuuguuccugauggua

SEQ ID NO: 6216 - RNA, 17 nt, Homo sapiens
uuuguuccugaugguaa

SEQ ID NO: 6217 - RNA, 17 nt, Homo sapiens
augguaacagaauuucc

SEQ ID NO: 6218 - RNA, 17 nt, Homo sapiens
agaauuuccugggacag

SEQ ID NO: 6219 - RNA, 17 nt, Homo sapiens
gaauuuccugggacagc

SEQ ID NO: 6220 - RNA, 17 nt, Homo sapiens
ccugggacagcaagaag

SEQ ID NO: 6221 - RNA, 17 nt, Homo sapiens
gggacagcaagaagggc

SEQ ID NO: 6222 - RNA, 17 nt, Homo sapiens
agaagggcuuuacuauu

SEQ ID NO: 6223 - RNA, 17 nt, Homo sapiens
ggcuuuacuauucccag

SEQ ID NO: 6224 - RNA, 17 nt, Homo sapiens
uacuauucccagcuaca

SEQ ID NO: 6225 - RNA, 17 nt, Homo sapiens
acuauucccagcuacau

SEQ ID NO: 6226 - RNA, 17 nt, Homo sapiens
cuauucccagcuacaug

SEQ ID NO: 6227 - RNA, 17 nt, Homo sapiens
uucccagcuacaugauc

SEQ ID NO: 6228 - RNA, 17 nt, Homo sapiens
ccagcuacaugaucagc

SEQ ID NO: 6229 - RNA, 17 nt, Homo sapiens
acaugaucagcuaugcu

SEQ ID NO: 6230 - RNA, 17 nt, Homo sapiens
ugaucagcuaugcuggc

SEQ ID NO: 6231 - RNA, 17 nt, Homo sapiens
agcuaugcuggcauggu

SEQ ID NO: 6232 - RNA, 17 nt, Homo sapiens
augcuggcauggucuuc

SEQ ID NO: 6233 - RNA, 17 nt, Homo sapiens
gcauggucuucugugaa

SEQ ID NO: 6234 - RNA, 17 nt, Homo sapiens
uggucuucugugaagca

SEQ ID NO: 6235 - RNA, 17 nt, Homo sapiens
ugugaagcaaaaauuaa

SEQ ID NO: 6236 - RNA, 17 nt, Homo sapiens
aaaguuaccagucuauu

SEQ ID NO: 6237 - RNA, 17 nt, Homo sapiens
aaguuaccagucuauua

SEQ ID NO: 6238 - RNA, 17 nt, Homo sapiens
uaccagucuauuaugua

SEQ ID NO: 6239 - RNA, 17 nt, Homo sapiens
uuauguacauaguuguc

SEQ ID NO: 6240 - RNA, 17 nt, Homo sapiens
ugugguucugaguccgu

SEQ ID NO: 6241 - RNA, 17 nt, Homo sapiens
ucugaguccgucucaug

SEQ ID NO: 6242 - RNA, 17 nt, Homo sapiens
aguccgucucauggaau

SEQ ID NO: 6243 - RNA, 17 nt, Homo sapiens
uccgucucauggaauug

SEQ ID NO: 6244 - RNA, 17 nt, Homo sapiens
aauugaacuaucuguug

SEQ ID NO: 6245 - RNA, 17 nt, Homo sapiens
gaacuaucuguuggaga

SEQ ID NO: 6246 - RNA, 17 nt, Homo sapiens
agaaaagcuugucuuaa

SEQ ID NO: 6247 - RNA, 17 nt, Homo sapiens
agcuugucuuaaauugu

SEQ ID NO: 6248 - RNA, 17 nt, Homo sapiens
aauuguacagcaagaac

SEQ ID NO: 6249 - RNA, 17 nt, Homo sapiens
uguacagcaagaacuga

SEQ ID NO: 6250 - RNA, 17 nt, Homo sapiens
gcaagaacugaacuaaa

SEQ ID NO: 6251 - RNA, 17 nt, Homo sapiens
aacugaacuaaaugugg

SEQ ID NO: 6252 - RNA, 17 nt, Homo sapiens
ggauugacuucaacugg

SEQ ID NO: 6253 - RNA, 17 nt, Homo sapiens
uugacuucaacugggaa

SEQ ID NO: 6254 - RNA, 17 nt, Homo sapiens
acuucaacugggaauac

SEQ ID NO: 6255 - RNA, 17 nt, Homo sapiens
gggaauacccuucuucg

SEQ ID NO: 6256 - RNA, 17 nt, Homo sapiens
ggaauacccuucuucga

SEQ ID NO: 6257 - RNA, 17 nt, Homo sapiens
gaauacccuucuucgaa

SEQ ID NO: 6258 - RNA, 17 nt, Homo sapiens
uacccuucuucgaagca

SEQ ID NO: 6259 - RNA, 17 nt, Homo sapiens
uucgaagcaucagcaua

SEQ ID NO: 6260 - RNA, 17 nt, Homo sapiens
gaagcaucagcauaaga

SEQ ID NO: 6261 - RNA, 17 nt, Homo sapiens
gcaucagcauaagaaac

SEQ ID NO: 6262 - RNA, 17 nt, Homo sapiens
uaagaaacuuguaaacc

SEQ ID NO: 6263 - RNA, 17 nt, Homo sapiens
uuguaaaccgagaccua

SEQ ID NO: 6264 - RNA, 17 nt, Homo sapiens
accgagaccuaaaaacc

SEQ ID NO: 6265 - RNA, 17 nt, Homo sapiens
ccgagaccuaaaaaccc

SEQ ID NO: 6266 - RNA, 17 nt, Homo sapiens
cuaaaaacccagucugg

SEQ ID NO: 6267 - RNA, 17 nt, Homo sapiens
uaaaaacccagucuggg

SEQ ID NO: 6268 - RNA, 17 nt, Homo sapiens
aaaaacccagucuggga

SEQ ID NO: 6269 - RNA, 17 nt, Homo sapiens
acccagucugggaguga

SEQ ID NO: 6270 - RNA, 17 nt, Homo sapiens
uuuugagcaccuuaacu

SEQ ID NO: 6271 - RNA, 17 nt, Homo sapiens
uugagcaccuuaacuau

SEQ ID NO: 6272 - RNA, 17 nt, Homo sapiens
ugagcaccuuaacuaua

SEQ ID NO: 6273 - RNA, 17 nt, Homo sapiens
accuuaacuauagaugg

SEQ ID NO: 6274 - RNA, 17 nt, Homo sapiens
gguguaacccggaguga

SEQ ID NO: 6275 - RNA, 17 nt, Homo sapiens
guguaacccggagugac

SEQ ID NO: 6276 - RNA, 17 nt, Homo sapiens
ggagugaccaaggauug

SEQ ID NO: 6277 - RNA, 17 nt, Homo sapiens
gagugaccaaggauugu

SEQ ID NO: 6278 - RNA, 17 nt, Homo sapiens
gauuguacaccugugca

SEQ ID NO: 6279 - RNA, 17 nt, Homo sapiens
uuguacaccugugcagc

SEQ ID NO: 6280 - RNA, 17 nt, Homo sapiens
uguacaccugugcagca

SEQ ID NO: 6281 - RNA, 17 nt, Homo sapiens
accugugcagcauccag

SEQ ID NO: 6282 - RNA, 17 nt, Homo sapiens
ugugcagcauccagugg

SEQ ID NO: 6283 - RNA, 17 nt, Homo sapiens
gcagcauccagugggcu

SEQ ID NO: 6284 - RNA, 17 nt, Homo sapiens
cagcauccagugggcug

SEQ ID NO: 6285 - RNA, 17 nt, Homo sapiens
cagugggcugaugacca

SEQ ID NO: 6286 - RNA, 17 nt, Homo sapiens
cugaugaccaagaagaa

SEQ ID NO: 6287 - RNA, 17 nt, Homo sapiens
ugaugaccaagaagaac

SEQ ID NO: 6288 - RNA, 17 nt, Homo sapiens
agaagaacagcacauuu

SEQ ID NO: 6289 - RNA, 17 nt, Homo sapiens
agaacagcacauuuguc

SEQ ID NO: 6290 - RNA, 17 nt, Homo sapiens
aacagcacauuugucag

SEQ ID NO: 6291 - RNA, 17 nt, Homo sapiens
cauuugucaggguccau

SEQ ID NO: 6292 - RNA, 17 nt, Homo sapiens
ucaggguccaugaaaaa

SEQ ID NO: 6293 - RNA, 17 nt, Homo sapiens
caggguccaugaaaaac

SEQ ID NO: 6294 - RNA, 17 nt, Homo sapiens
ugaaaaaccuuuuguug

SEQ ID NO: 6295 - RNA, 17 nt, Homo sapiens
gaaaaaccuuuuguugc

SEQ ID NO: 6296 - RNA, 17 nt, Homo sapiens
uuuguugcuuuuggaag

SEQ ID NO: 6297 - RNA, 17 nt, Homo sapiens
gaaguggcauggaaucu

SEQ ID NO: 6298 - RNA, 17 nt, Homo sapiens
auggaaucucuggugga

SEQ ID NO: 6299 - RNA, 17 nt, Homo sapiens
ggaaucucugguggaag

SEQ ID NO: 6300 - RNA, 17 nt, Homo sapiens
guggaagccacgguggg

SEQ ID NO: 6301 - RNA, 17 nt, Homo sapiens
uggaagccacggugggg

SEQ ID NO: 6302 - RNA, 17 nt, Homo sapiens
agcgugucagaaucccu

SEQ ID NO: 6303 - RNA, 17 nt, Homo sapiens
ucagaaucccugcgaag

SEQ ID NO: 6304 - RNA, 17 nt, Homo sapiens
cagaaucccugcgaagu

SEQ ID NO: 6305 - RNA, 17 nt, Homo sapiens
agaaucccugcgaagua

SEQ ID NO: 6306 - RNA, 17 nt, Homo sapiens
cgaaguaccuugguuac

SEQ ID NO: 6307 - RNA, 17 nt, Homo sapiens
gaaguaccuugguuacc

SEQ ID NO: 6308 - RNA, 17 nt, Homo sapiens
uugguuacccaccccca

SEQ ID NO: 6309 - RNA, 17 nt, Homo sapiens
ugguuacccacccccag

SEQ ID NO: 6310 - RNA, 17 nt, Homo sapiens
gguuacccacccccaga

SEQ ID NO: 6311 - RNA, 17 nt, Homo sapiens
uuacccacccccagaaa

SEQ ID NO: 6312 - RNA, 17 nt, Homo sapiens
uacccacccccagaaau

SEQ ID NO: 6313 - RNA, 17 nt, Homo sapiens
acccacccccagaaaua

SEQ ID NO: 6314 - RNA, 17 nt, Homo sapiens
cccacccccagaaauaa

SEQ ID NO: 6315 - RNA, 17 nt, Homo sapiens
ccacccccagaaauaaa

SEQ ID NO: 6316 - RNA, 17 nt, Homo sapiens
uggaauaccccuugagu

SEQ ID NO: 6317 - RNA, 17 nt, Homo sapiens
ggaauaccccuugaguc

SEQ ID NO: 6318 - RNA, 17 nt, Homo sapiens
gaauaccccuugagucc

SEQ ID NO: 6319 - RNA, 17 nt, Homo sapiens
aauaccccuugagucca

SEQ ID NO: 6320 - RNA, 17 nt, Homo sapiens
cuugaguccaaucacac

SEQ ID NO: 6321 - RNA, 17 nt, Homo sapiens
uugaguccaaucacaca

SEQ ID NO: 6322 - RNA, 17 nt, Homo sapiens
guccaaucacacaauua

SEQ ID NO: 6323 - RNA, 17 nt, Homo sapiens
ccaaucacacaauuaaa

SEQ ID NO: 6324 - RNA, 17 nt, Homo sapiens
aaucacacaauuaaagc

SEQ ID NO: 6325 - RNA, 17 nt, Homo sapiens
agcggggcauguacuga

SEQ ID NO: 6326 - RNA, 17 nt, Homo sapiens
gcauguacugacgauua

SEQ ID NO: 6327 - RNA, 17 nt, Homo sapiens
aaagagacacaggaaau

SEQ ID NO: 6328 - RNA, 17 nt, Homo sapiens
agagacacaggaaauua

SEQ ID NO: 6329 - RNA, 17 nt, Homo sapiens
gaaauuacacugucauc

SEQ ID NO: 6330 - RNA, 17 nt, Homo sapiens
aauuacacugucauccu

SEQ ID NO: 6331 - RNA, 17 nt, Homo sapiens
acacugucauccuuacc

SEQ ID NO: 6332 - RNA, 17 nt, Homo sapiens
cugucauccuuaccaau

SEQ ID NO: 6333 - RNA, 17 nt, Homo sapiens
ugucauccuuaccaauc

SEQ ID NO: 6334 - RNA, 17 nt, Homo sapiens
auccuuaccaaucccau

SEQ ID NO: 6335 - RNA, 17 nt, Homo sapiens
uccuuaccaaucccauu

SEQ ID NO: 6336 - RNA, 17 nt, Homo sapiens
uaccaaucccauuucaa

SEQ ID NO: 6337 - RNA, 17 nt, Homo sapiens
accaaucccauuucaaa

SEQ ID NO: 6338 - RNA, 17 nt, Homo sapiens
ccaaucccauuucaaag

SEQ ID NO: 6339 - RNA, 17 nt, Homo sapiens
cccauuucaaaggagaa

SEQ ID NO: 6340 - RNA, 17 nt, Homo sapiens
ggagaagcagagccaug

SEQ ID NO: 6341 - RNA, 17 nt, Homo sapiens
agcagagccaugugguc

SEQ ID NO: 6342 - RNA, 17 nt, Homo sapiens
gcagagccauguggucu

SEQ ID NO: 6343 - RNA, 17 nt, Homo sapiens
auguggucucucugguu

SEQ ID NO: 6344 - RNA, 17 nt, Homo sapiens
guggucucucugguugu

SEQ ID NO: 6345 - RNA, 17 nt, Homo sapiens
ggucucucugguugugu

SEQ ID NO: 6346 - RNA, 17 nt, Homo sapiens
uguaugucccaccccag

SEQ ID NO: 6347 - RNA, 17 nt, Homo sapiens
guaugucccaccccaga

SEQ ID NO: 6348 - RNA, 17 nt, Homo sapiens
uaugucccaccccagau

SEQ ID NO: 6349 - RNA, 17 nt, Homo sapiens
ugucccaccccagauug

SEQ ID NO: 6350 - RNA, 17 nt, Homo sapiens
gucccaccccagauugg

SEQ ID NO: 6351 - RNA, 17 nt, Homo sapiens
ucccaccccagauuggu

SEQ ID NO: 6352 - RNA, 17 nt, Homo sapiens
cccaccccagauuggug

SEQ ID NO: 6353 - RNA, 17 nt, Homo sapiens
gagaaaucucuaaucuc

SEQ ID NO: 6354 - RNA, 17 nt, Homo sapiens
gaaaucucuaaucucuc

SEQ ID NO: 6355 - RNA, 17 nt, Homo sapiens
cucuaaucucuccugug

SEQ ID NO: 6356 - RNA, 17 nt, Homo sapiens
cuaaucucuccugugga

SEQ ID NO: 6357 - RNA, 17 nt, Homo sapiens
aaucucuccuguggauu

SEQ ID NO: 6358 - RNA, 17 nt, Homo sapiens
aucucuccuguggauuc

SEQ ID NO: 6359 - RNA, 17 nt, Homo sapiens
guggauuccuaccagua

SEQ ID NO: 6360 - RNA, 17 nt, Homo sapiens
uggauuccuaccaguac

SEQ ID NO: 6361 - RNA, 17 nt, Homo sapiens
auuccuaccaguacggc

SEQ ID NO: 6362 - RNA, 17 nt, Homo sapiens
uuccuaccaguacggca

SEQ ID NO: 6363 - RNA, 17 nt, Homo sapiens
aguacggcaccacucaa

SEQ ID NO: 6364 - RNA, 17 nt, Homo sapiens
uacggcaccacucaaac

SEQ ID NO: 6365 - RNA, 17 nt, Homo sapiens
acggcaccacucaaacg

SEQ ID NO: 6366 - RNA, 17 nt, Homo sapiens
ggcaccacucaaacgcu

SEQ ID NO: 6367 - RNA, 17 nt, Homo sapiens
caccacucaaacgcuga

SEQ ID NO: 6368 - RNA, 17 nt, Homo sapiens
ucaaacgcugacaugua

SEQ ID NO: 6369 - RNA, 17 nt, Homo sapiens
acgcugacauguacggu

SEQ ID NO: 6370 - RNA, 17 nt, Homo sapiens
guacggucuaugccauu

SEQ ID NO: 6371 - RNA, 17 nt, Homo sapiens
gucuaugccauuccucc

SEQ ID NO: 6372 - RNA, 17 nt, Homo sapiens
ucuaugccauuccuccc

SEQ ID NO: 6373 - RNA, 17 nt, Homo sapiens
ugccauuccucccccgc

SEQ ID NO: 6374 - RNA, 17 nt, Homo sapiens
gccauuccucccccgca

SEQ ID NO: 6375 - RNA, 17 nt, Homo sapiens
cauuccucccccgcauc

SEQ ID NO: 6376 - RNA, 17 nt, Homo sapiens
auuccucccccgcauca

SEQ ID NO: 6377 - RNA, 17 nt, Homo sapiens
uuccucccccgcaucac

SEQ ID NO: 6378 - RNA, 17 nt, Homo sapiens
uccucccccgcaucaca

SEQ ID NO: 6379 - RNA, 17 nt, Homo sapiens
ucccccgcaucacaucc

SEQ ID NO: 6380 - RNA, 17 nt, Homo sapiens
cccgcaucacauccacu

SEQ ID NO: 6381 - RNA, 17 nt, Homo sapiens
cgcaucacauccacugg

SEQ ID NO: 6382 - RNA, 17 nt, Homo sapiens
aucacauccacugguau

SEQ ID NO: 6383 - RNA, 17 nt, Homo sapiens
ucacauccacugguauu

SEQ ID NO: 6384 - RNA, 17 nt, Homo sapiens
acauccacugguauugg

SEQ ID NO: 6385 - RNA, 17 nt, Homo sapiens
guauuggcaguuggagg

SEQ ID NO: 6386 - RNA, 17 nt, Homo sapiens
gagugcgccaacgagcc

SEQ ID NO: 6387 - RNA, 17 nt, Homo sapiens
agugcgccaacgagccc

SEQ ID NO: 6388 - RNA, 17 nt, Homo sapiens
caacgagcccagccaag

SEQ ID NO: 6389 - RNA, 17 nt, Homo sapiens
aacgagcccagccaagc

SEQ ID NO: 6390 - RNA, 17 nt, Homo sapiens
acgagcccagccaagcu

SEQ ID NO: 6391 - RNA, 17 nt, Homo sapiens
agcccagccaagcuguc

SEQ ID NO: 6392 - RNA, 17 nt, Homo sapiens
gcccagccaagcugucu

SEQ ID NO: 6393 - RNA, 17 nt, Homo sapiens
agccaagcugucucagu

SEQ ID NO: 6394 - RNA, 17 nt, Homo sapiens
aagcugucucagugaca

SEQ ID NO: 6395 - RNA, 17 nt, Homo sapiens
gcugucucagugacaaa

SEQ ID NO: 6396 - RNA, 17 nt, Homo sapiens
ucagugacaaacccaua

SEQ ID NO: 6397 - RNA, 17 nt, Homo sapiens
ugacaaacccauacccu

SEQ ID NO: 6398 - RNA, 17 nt, Homo sapiens
gacaaacccauacccuu

SEQ ID NO: 6399 - RNA, 17 nt, Homo sapiens
acaaacccauacccuug

SEQ ID NO: 6400 - RNA, 17 nt, Homo sapiens
acccauacccuugugaa

SEQ ID NO: 6401 - RNA, 17 nt, Homo sapiens
cccauacccuugugaag

SEQ ID NO: 6402 - RNA, 17 nt, Homo sapiens
ccauacccuugugaaga

SEQ ID NO: 6403 - RNA, 17 nt, Homo sapiens
uggaggacuuccaggga

SEQ ID NO: 6404 - RNA, 17 nt, Homo sapiens
aggacuuccagggagga

SEQ ID NO: 6405 - RNA, 17 nt, Homo sapiens
ggacuuccagggaggaa

SEQ ID NO: 6406 - RNA, 17 nt, Homo sapiens
uaaaaaucaauuugcuc

SEQ ID NO: 6407 - RNA, 17 nt, Homo sapiens
caauuugcucuaauuga

SEQ ID NO: 6408 - RNA, 17 nt, Homo sapiens
auuugcucuaauugaag

SEQ ID NO: 6409 - RNA, 17 nt, Homo sapiens
gaaaaaacaaaacugua

SEQ ID NO: 6410 - RNA, 17 nt, Homo sapiens
aacaaaacuguaaguac

SEQ ID NO: 6411 - RNA, 17 nt, Homo sapiens
guaaguacccuuguuau

SEQ ID NO: 6412 - RNA, 17 nt, Homo sapiens
uaaguacccuuguuauc

SEQ ID NO: 6413 - RNA, 17 nt, Homo sapiens
aaguacccuuguuaucc

SEQ ID NO: 6414 - RNA, 17 nt, Homo sapiens
uuguuauccaagcggca

SEQ ID NO: 6415 - RNA, 17 nt, Homo sapiens
uguuauccaagcggcaa

SEQ ID NO: 6416 - RNA, 17 nt, Homo sapiens
caagcggcaaauguguc

SEQ ID NO: 6417 - RNA, 17 nt, Homo sapiens
aaugugucagcuuugua

SEQ ID NO: 6418 - RNA, 17 nt, Homo sapiens
gugucagcuuuguacaa

SEQ ID NO: 6419 - RNA, 17 nt, Homo sapiens
cuuuguacaaaugugaa

SEQ ID NO: 6420 - RNA, 17 nt, Homo sapiens
aagcggucaacaaaguc

SEQ ID NO: 6421 - RNA, 17 nt, Homo sapiens
cggucaacaaagucggg

SEQ ID NO: 6422 - RNA, 17 nt, Homo sapiens
gggugaucuccuuccac

SEQ ID NO: 6423 - RNA, 17 nt, Homo sapiens
gugaucuccuuccacgu

SEQ ID NO: 6424 - RNA, 17 nt, Homo sapiens
ugaucuccuuccacgug

SEQ ID NO: 6425 - RNA, 17 nt, Homo sapiens
ucuccuuccacgugacc

SEQ ID NO: 6426 - RNA, 17 nt, Homo sapiens
cuccuuccacgugacca

SEQ ID NO: 6427 - RNA, 17 nt, Homo sapiens
cacgugaccaggggucc

SEQ ID NO: 6428 - RNA, 17 nt, Homo sapiens
acgugaccagggguccu

SEQ ID NO: 6429 - RNA, 17 nt, Homo sapiens
cagggguccugaaauua

SEQ ID NO: 6430 - RNA, 17 nt, Homo sapiens
agggguccugaaauuac

SEQ ID NO: 6431 - RNA, 17 nt, Homo sapiens
gaaauuacuuugcaacc

SEQ ID NO: 6432 - RNA, 17 nt, Homo sapiens
uacuuugcaaccugaca

SEQ ID NO: 6433 - RNA, 17 nt, Homo sapiens
uuugcaaccugacaugc

SEQ ID NO: 6434 - RNA, 17 nt, Homo sapiens
uugcaaccugacaugca

SEQ ID NO: 6435 - RNA, 17 nt, Homo sapiens
aaccugacaugcagccc

SEQ ID NO: 6436 - RNA, 17 nt, Homo sapiens
ugacaugcagcccacug

SEQ ID NO: 6437 - RNA, 17 nt, Homo sapiens
caugcagcccacugagc

SEQ ID NO: 6438 - RNA, 17 nt, Homo sapiens
augcagcccacugagca

SEQ ID NO: 6439 - RNA, 17 nt, Homo sapiens
ugcagcccacugagcag

SEQ ID NO: 6440 - RNA, 17 nt, Homo sapiens
cagcccacugagcagga

SEQ ID NO: 6441 - RNA, 17 nt, Homo sapiens
cacugagcaggagagcg

SEQ ID NO: 6442 - RNA, 17 nt, Homo sapiens
agcgugucuuuguggug

SEQ ID NO: 6443 - RNA, 17 nt, Homo sapiens
uguggugcacugcagac

SEQ ID NO: 6444 - RNA, 17 nt, Homo sapiens
uggugcacugcagacag

SEQ ID NO: 6445 - RNA, 17 nt, Homo sapiens
ugcacugcagacagauc

SEQ ID NO: 6446 - RNA, 17 nt, Homo sapiens
cugcagacagaucuacg

SEQ ID NO: 6447 - RNA, 17 nt, Homo sapiens
gacagaucuacguuuga

SEQ ID NO: 6448 - RNA, 17 nt, Homo sapiens
uugagaaccucacaugg

SEQ ID NO: 6449 - RNA, 17 nt, Homo sapiens
ugagaaccucacauggu

SEQ ID NO: 6450 - RNA, 17 nt, Homo sapiens
agaaccucacaugguac

SEQ ID NO: 6451 - RNA, 17 nt, Homo sapiens
aaccucacaugguacaa

SEQ ID NO: 6452 - RNA, 17 nt, Homo sapiens
caugguacaagcuuggc

SEQ ID NO: 6453 - RNA, 17 nt, Homo sapiens
guacaagcuuggcccac

SEQ ID NO: 6454 - RNA, 17 nt, Homo sapiens
agcuuggcccacagccu

SEQ ID NO: 6455 - RNA, 17 nt, Homo sapiens
gcuuggcccacagccuc

SEQ ID NO: 6456 - RNA, 17 nt, Homo sapiens
cuuggcccacagccucu

SEQ ID NO: 6457 - RNA, 17 nt, Homo sapiens
uggcccacagccucugc

SEQ ID NO: 6458 - RNA, 17 nt, Homo sapiens
cccacagccucugccaa

SEQ ID NO: 6459 - RNA, 17 nt, Homo sapiens
ccacagccucugccaau

SEQ ID NO: 6460 - RNA, 17 nt, Homo sapiens
acagccucugccaaucc

SEQ ID NO: 6461 - RNA, 17 nt, Homo sapiens
gccucugccaauccaug

SEQ ID NO: 6462 - RNA, 17 nt, Homo sapiens
ccucugccaauccaugu

SEQ ID NO: 6463 - RNA, 17 nt, Homo sapiens
ugccaauccauguggga

SEQ ID NO: 6464 - RNA, 17 nt, Homo sapiens
gccaauccaugugggag

SEQ ID NO: 6465 - RNA, 17 nt, Homo sapiens
agaguugcccacaccug

SEQ ID NO: 6466 - RNA, 17 nt, Homo sapiens
gaguugcccacaccugu

SEQ ID NO: 6467 - RNA, 17 nt, Homo sapiens
aguugcccacaccuguu

SEQ ID NO: 6468 - RNA, 17 nt, Homo sapiens
uugcccacaccuguuug

SEQ ID NO: 6469 - RNA, 17 nt, Homo sapiens
gcccacaccuguuugca

SEQ ID NO: 6470 - RNA, 17 nt, Homo sapiens
cccacaccuguuugcaa

SEQ ID NO: 6471 - RNA, 17 nt, Homo sapiens
cuguuugcaagaacuug

SEQ ID NO: 6472 - RNA, 17 nt, Homo sapiens
gcaagaacuuggauacu

SEQ ID NO: 6473 - RNA, 17 nt, Homo sapiens
uuggauacucuuuggaa

SEQ ID NO: 6474 - RNA, 17 nt, Homo sapiens
ggauacucuuuggaaau

SEQ ID NO: 6475 - RNA, 17 nt, Homo sapiens
uugaaugccaccauguu

SEQ ID NO: 6476 - RNA, 17 nt, Homo sapiens
ugaaugccaccauguuc

SEQ ID NO: 6477 - RNA, 17 nt, Homo sapiens
aaugccaccauguucuc

SEQ ID NO: 6478 - RNA, 17 nt, Homo sapiens
augccaccauguucucu

SEQ ID NO: 6479 - RNA, 17 nt, Homo sapiens
ccauguucucuaauagc

SEQ ID NO: 6480 - RNA, 17 nt, Homo sapiens
auguucucuaauagcac

SEQ ID NO: 6481 - RNA, 17 nt, Homo sapiens
cuaauagcacaaaugac

SEQ ID NO: 6482 - RNA, 17 nt, Homo sapiens
aauagcacaaaugacau

SEQ ID NO: 6483 - RNA, 17 nt, Homo sapiens
caaaugacauuuugauc

SEQ ID NO: 6484 - RNA, 17 nt, Homo sapiens
uuuugaucauggagcuu

SEQ ID NO: 6485 - RNA, 17 nt, Homo sapiens
cauggagcuuaagaaug

SEQ ID NO: 6486 - RNA, 17 nt, Homo sapiens
aagaaugcauccuugca

SEQ ID NO: 6487 - RNA, 17 nt, Homo sapiens
aaugcauccuugcagga

SEQ ID NO: 6488 - RNA, 17 nt, Homo sapiens
augcauccuugcaggac

SEQ ID NO: 6489 - RNA, 17 nt, Homo sapiens
auccuugcaggaccaag

SEQ ID NO: 6490 - RNA, 17 nt, Homo sapiens
ugcaggaccaaggagac

SEQ ID NO: 6491 - RNA, 17 nt, Homo sapiens
gcaggaccaaggagacu

SEQ ID NO: 6492 - RNA, 17 nt, Homo sapiens
aaggagacuaugucugc

SEQ ID NO: 6493 - RNA, 17 nt, Homo sapiens
acuaugucugccuugcu

SEQ ID NO: 6494 - RNA, 17 nt, Homo sapiens
augucugccuugcucaa

SEQ ID NO: 6495 - RNA, 17 nt, Homo sapiens
ugucugccuugcucaag

SEQ ID NO: 6496 - RNA, 17 nt, Homo sapiens
ugccuugcucaagacag

SEQ ID NO: 6497 - RNA, 17 nt, Homo sapiens
ccuugcucaagacagga

SEQ ID NO: 6498 - RNA, 17 nt, Homo sapiens
cucaagacaggaagacc

SEQ ID NO: 6499 - RNA, 17 nt, Homo sapiens
aggaagaccaagaaaag

SEQ ID NO: 6500 - RNA, 17 nt, Homo sapiens
ggaagaccaagaaaaga

SEQ ID NO: 6501 - RNA, 17 nt, Homo sapiens
gaaaagacauugcgugg

SEQ ID NO: 6502 - RNA, 17 nt, Homo sapiens
gcguggucaggcagcuc

SEQ ID NO: 6503 - RNA, 17 nt, Homo sapiens
ggucaggcagcucacag

SEQ ID NO: 6504 - RNA, 17 nt, Homo sapiens
caggcagcucacagucc

SEQ ID NO: 6505 - RNA, 17 nt, Homo sapiens
ggcagcucacaguccua

SEQ ID NO: 6506 - RNA, 17 nt, Homo sapiens
cagcucacaguccuaga

SEQ ID NO: 6507 - RNA, 17 nt, Homo sapiens
ucacaguccuagagcgu

SEQ ID NO: 6508 - RNA, 17 nt, Homo sapiens
cacaguccuagagcgug

SEQ ID NO: 6509 - RNA, 17 nt, Homo sapiens
cguguggcacccacgau

SEQ ID NO: 6510 - RNA, 17 nt, Homo sapiens
uguggcacccacgauca

SEQ ID NO: 6511 - RNA, 17 nt, Homo sapiens
guggcacccacgaucac

SEQ ID NO: 6512 - RNA, 17 nt, Homo sapiens
uggcacccacgaucaca

SEQ ID NO: 6513 - RNA, 17 nt, Homo sapiens
ccacgaucacaggaaac

SEQ ID NO: 6514 - RNA, 17 nt, Homo sapiens
acgaucacaggaaaccu

SEQ ID NO: 6515 - RNA, 17 nt, Homo sapiens
caggaaaccuggagaau

SEQ ID NO: 6516 - RNA, 17 nt, Homo sapiens
aggaaaccuggagaauc

SEQ ID NO: 6517 - RNA, 17 nt, Homo sapiens
ggagaaucagacgacaa

SEQ ID NO: 6518 - RNA, 17 nt, Homo sapiens
cagacgacaaguauugg

SEQ ID NO: 6519 - RNA, 17 nt, Homo sapiens
gggaaagcaucgaaguc

SEQ ID NO: 6520 - RNA, 17 nt, Homo sapiens
ucgaagucucaugcacg

SEQ ID NO: 6521 - RNA, 17 nt, Homo sapiens
gaagucucaugcacggc

SEQ ID NO: 6522 - RNA, 17 nt, Homo sapiens
ucucaugcacggcaucu

SEQ ID NO: 6523 - RNA, 17 nt, Homo sapiens
ugcacggcaucugggaa

SEQ ID NO: 6524 - RNA, 17 nt, Homo sapiens
acggcaucugggaaucc

SEQ ID NO: 6525 - RNA, 17 nt, Homo sapiens
ugggaaucccccuccac

SEQ ID NO: 6526 - RNA, 17 nt, Homo sapiens
gggaaucccccuccaca

SEQ ID NO: 6527 - RNA, 17 nt, Homo sapiens
ggaaucccccuccacag

SEQ ID NO: 6528 - RNA, 17 nt, Homo sapiens
gaaucccccuccacaga

SEQ ID NO: 6529 - RNA, 17 nt, Homo sapiens
aaucccccuccacagau

SEQ ID NO: 6530 - RNA, 17 nt, Homo sapiens
ucccccuccacagauca

SEQ ID NO: 6531 - RNA, 17 nt, Homo sapiens
cccccuccacagaucau

SEQ ID NO: 6532 - RNA, 17 nt, Homo sapiens
cccuccacagaucaugu

SEQ ID NO: 6533 - RNA, 17 nt, Homo sapiens
cacagaucaugugguuu

SEQ ID NO: 6534 - RNA, 17 nt, Homo sapiens
aaugagacccuuguaga

SEQ ID NO: 6535 - RNA, 17 nt, Homo sapiens
augagacccuuguagaa

SEQ ID NO: 6536 - RNA, 17 nt, Homo sapiens
ugagacccuuguagaag

SEQ ID NO: 6537 - RNA, 17 nt, Homo sapiens
uagaagacucaggcauu

SEQ ID NO: 6538 - RNA, 17 nt, Homo sapiens
gaagacucaggcauugu

SEQ ID NO: 6539 - RNA, 17 nt, Homo sapiens
acucaggcauuguauug

SEQ ID NO: 6540 - RNA, 17 nt, Homo sapiens
augggaaccggaaccuc

SEQ ID NO: 6541 - RNA, 17 nt, Homo sapiens
accggaaccucacuauc

SEQ ID NO: 6542 - RNA, 17 nt, Homo sapiens
ccggaaccucacuaucc

SEQ ID NO: 6543 - RNA, 17 nt, Homo sapiens
ggaaccucacuauccgc

SEQ ID NO: 6544 - RNA, 17 nt, Homo sapiens
aaccucacuauccgcag

SEQ ID NO: 6545 - RNA, 17 nt, Homo sapiens
ucacuauccgcagagug

SEQ ID NO: 6546 - RNA, 17 nt, Homo sapiens
cuauccgcagagugagg

SEQ ID NO: 6547 - RNA, 17 nt, Homo sapiens
acgaaggccucuacacc

SEQ ID NO: 6548 - RNA, 17 nt, Homo sapiens
cgaaggccucuacaccu

SEQ ID NO: 6549 - RNA, 17 nt, Homo sapiens
aaggccucuacaccugc

SEQ ID NO: 6550 - RNA, 17 nt, Homo sapiens
gccucuacaccugccag

SEQ ID NO: 6551 - RNA, 17 nt, Homo sapiens
cucuacaccugccaggc

SEQ ID NO: 6552 - RNA, 17 nt, Homo sapiens
ucuacaccugccaggca

SEQ ID NO: 6553 - RNA, 17 nt, Homo sapiens
acaccugccaggcaugc

SEQ ID NO: 6554 - RNA, 17 nt, Homo sapiens
caccugccaggcaugca

SEQ ID NO: 6555 - RNA, 17 nt, Homo sapiens
ugccaggcaugcagugu

SEQ ID NO: 6556 - RNA, 17 nt, Homo sapiens
aggcaugcaguguucuu

SEQ ID NO: 6557 - RNA, 17 nt, Homo sapiens
caguguucuuggcugug

SEQ ID NO: 6558 - RNA, 17 nt, Homo sapiens
uucuuggcugugcaaaa

SEQ ID NO: 6559 - RNA, 17 nt, Homo sapiens
ggcugugcaaaagugga

SEQ ID NO: 6560 - RNA, 17 nt, Homo sapiens
guggaggcauuuuucau

SEQ ID NO: 6561 - RNA, 17 nt, Homo sapiens
cauuuuucauaauagaa

SEQ ID NO: 6562 - RNA, 17 nt, Homo sapiens
gaaggugcccaggaaaa

SEQ ID NO: 6563 - RNA, 17 nt, Homo sapiens
aaggugcccaggaaaag

SEQ ID NO: 6564 - RNA, 17 nt, Homo sapiens
aggugcccaggaaaaga

SEQ ID NO: 6565 - RNA, 17 nt, Homo sapiens
agacgaacuuggaaauc

SEQ ID NO: 6566 - RNA, 17 nt, Homo sapiens
uggaaaucauuauucua

SEQ ID NO: 6567 - RNA, 17 nt, Homo sapiens
cauuauucuaguaggca

SEQ ID NO: 6568 - RNA, 17 nt, Homo sapiens
uaguaggcacgacggug

SEQ ID NO: 6569 - RNA, 17 nt, Homo sapiens
gugauugccauguucuu

SEQ ID NO: 6570 - RNA, 17 nt, Homo sapiens
ugauugccauguucuuc

SEQ ID NO: 6571 - RNA, 17 nt, Homo sapiens
ccauguucuucuggcua

SEQ ID NO: 6572 - RNA, 17 nt, Homo sapiens
uguucuucuggcuacuu

SEQ ID NO: 6573 - RNA, 17 nt, Homo sapiens
cuucuggcuacuucuug

SEQ ID NO: 6574 - RNA, 17 nt, Homo sapiens
cuggcuacuucuuguca

SEQ ID NO: 6575 - RNA, 17 nt, Homo sapiens
gcuacuucuugucauca

SEQ ID NO: 6576 - RNA, 17 nt, Homo sapiens
uucuugucaucauccua

SEQ ID NO: 6577 - RNA, 17 nt, Homo sapiens
uugucaucauccuaggg

SEQ ID NO: 6578 - RNA, 17 nt, Homo sapiens
ucaucauccuagggacc

SEQ ID NO: 6579 - RNA, 17 nt, Homo sapiens
caucauccuagggaccg

SEQ ID NO: 6580 - RNA, 17 nt, Homo sapiens
cuagggaccguuaagcg

SEQ ID NO: 6581 - RNA, 17 nt, Homo sapiens
aagcgggccaauggagg

SEQ ID NO: 6582 - RNA, 17 nt, Homo sapiens
agcgggccaauggaggg

SEQ ID NO: 6583 - RNA, 17 nt, Homo sapiens
aggggaacugaagacag

SEQ ID NO: 6584 - RNA, 17 nt, Homo sapiens
cugaagacaggcuacuu

SEQ ID NO: 6585 - RNA, 17 nt, Homo sapiens
agacaggcuacuugucc

SEQ ID NO: 6586 - RNA, 17 nt, Homo sapiens
caggcuacuuguccauc

SEQ ID NO: 6587 - RNA, 17 nt, Homo sapiens
uacuuguccaucgucau

SEQ ID NO: 6588 - RNA, 17 nt, Homo sapiens
acuuguccaucgucaug

SEQ ID NO: 6589 - RNA, 17 nt, Homo sapiens
ccaucgucauggaucca

SEQ ID NO: 6590 - RNA, 17 nt, Homo sapiens
cauggauccagaugaac

SEQ ID NO: 6591 - RNA, 17 nt, Homo sapiens
auggauccagaugaacu

SEQ ID NO: 6592 - RNA, 17 nt, Homo sapiens
agaugaacucccauugg

SEQ ID NO: 6593 - RNA, 17 nt, Homo sapiens
augaacucccauuggau

SEQ ID NO: 6594 - RNA, 17 nt, Homo sapiens
ugaacucccauuggaug

SEQ ID NO: 6595 - RNA, 17 nt, Homo sapiens
gaacucccauuggauga

SEQ ID NO: 6596 - RNA, 17 nt, Homo sapiens
ggaugaacauugugaac

SEQ ID NO: 6597 - RNA, 17 nt, Homo sapiens
ugaacgacugccuuaug

SEQ ID NO: 6598 - RNA, 17 nt, Homo sapiens
acgacugccuuaugaug

SEQ ID NO: 6599 - RNA, 17 nt, Homo sapiens
cgacugccuuaugaugc

SEQ ID NO: 6600 - RNA, 17 nt, Homo sapiens
uaugaugccagcaaaug

SEQ ID NO: 6601 - RNA, 17 nt, Homo sapiens
augaugccagcaaaugg

SEQ ID NO: 6602 - RNA, 17 nt, Homo sapiens
augccagcaaaugggaa

SEQ ID NO: 6603 - RNA, 17 nt, Homo sapiens
gggaauuccccagagac

SEQ ID NO: 6604 - RNA, 17 nt, Homo sapiens
ggaauuccccagagacc

SEQ ID NO: 6605 - RNA, 17 nt, Homo sapiens
gaauuccccagagaccg

SEQ ID NO: 6606 - RNA, 17 nt, Homo sapiens
aauuccccagagaccgg

SEQ ID NO: 6607 - RNA, 17 nt, Homo sapiens
ccagagaccggcugaac

SEQ ID NO: 6608 - RNA, 17 nt, Homo sapiens
agaccggcugaaccuag

SEQ ID NO: 6609 - RNA, 17 nt, Homo sapiens
ggcugaaccuagguaag

SEQ ID NO: 6610 - RNA, 17 nt, Homo sapiens
gcugaaccuagguaagc

SEQ ID NO: 6611 - RNA, 17 nt, Homo sapiens
agguaagccucuuggcc

SEQ ID NO: 6612 - RNA, 17 nt, Homo sapiens
gguaagccucuuggccg

SEQ ID NO: 6613 - RNA, 17 nt, Homo sapiens
uaagccucuuggccgug

SEQ ID NO: 6614 - RNA, 17 nt, Homo sapiens
cucuuggccguggugcc

SEQ ID NO: 6615 - RNA, 17 nt, Homo sapiens
cguggugccuuuggcca

SEQ ID NO: 6616 - RNA, 17 nt, Homo sapiens
guggugccuuuggccaa

SEQ ID NO: 6617 - RNA, 17 nt, Homo sapiens
ccuuuggccaagagauu

SEQ ID NO: 6618 - RNA, 17 nt, Homo sapiens
cuuuggccaagagauug

SEQ ID NO: 6619 - RNA, 17 nt, Homo sapiens
auugaagcagaugccuu

SEQ ID NO: 6620 - RNA, 17 nt, Homo sapiens
gcagaugccuuuggaau

SEQ ID NO: 6621 - RNA, 17 nt, Homo sapiens
cagaugccuuuggaauu

SEQ ID NO: 6622 - RNA, 17 nt, Homo sapiens
gaauugacaagacagca

SEQ ID NO: 6623 - RNA, 17 nt, Homo sapiens
gacaagacagcaacuug

SEQ ID NO: 6624 - RNA, 17 nt, Homo sapiens
aagacagcaacuugcag

SEQ ID NO: 6625 - RNA, 17 nt, Homo sapiens
acagcaacuugcaggac

SEQ ID NO: 6626 - RNA, 17 nt, Homo sapiens
caacuugcaggacagua

SEQ ID NO: 6627 - RNA, 17 nt, Homo sapiens
ugcaggacaguagcagu

SEQ ID NO: 6628 - RNA, 17 nt, Homo sapiens
acaguagcagucaaaau

SEQ ID NO: 6629 - RNA, 17 nt, Homo sapiens
uagcagucaaaauguug

SEQ ID NO: 6630 - RNA, 17 nt, Homo sapiens
gaaggagcaacacacag

SEQ ID NO: 6631 - RNA, 17 nt, Homo sapiens
ggagcaacacacaguga

SEQ ID NO: 6632 - RNA, 17 nt, Homo sapiens
agcaacacacagugagc

SEQ ID NO: 6633 - RNA, 17 nt, Homo sapiens
caacacacagugagcau

SEQ ID NO: 6634 - RNA, 17 nt, Homo sapiens
cagugagcaucgagcuc

SEQ ID NO: 6635 - RNA, 17 nt, Homo sapiens
caucgagcucucauguc

SEQ ID NO: 6636 - RNA, 17 nt, Homo sapiens
ucgagcucucaugucug

SEQ ID NO: 6637 - RNA, 17 nt, Homo sapiens
gagcucucaugucugaa

SEQ ID NO: 6638 - RNA, 17 nt, Homo sapiens
cucaugucugaacucaa

SEQ ID NO: 6639 - RNA, 17 nt, Homo sapiens
gucugaacucaagaucc

SEQ ID NO: 6640 - RNA, 17 nt, Homo sapiens
cugaacucaagauccuc

SEQ ID NO: 6641 - RNA, 17 nt, Homo sapiens
ucaagauccucauucau

SEQ ID NO: 6642 - RNA, 17 nt, Homo sapiens
caagauccucauucaua

SEQ ID NO: 6643 - RNA, 17 nt, Homo sapiens
agauccucauucauauu

SEQ ID NO: 6644 - RNA, 17 nt, Homo sapiens
ccucauucauauugguc

SEQ ID NO: 6645 - RNA, 17 nt, Homo sapiens
uauuggucaccaucuca

SEQ ID NO: 6646 - RNA, 17 nt, Homo sapiens
uuggucaccaucucaau

SEQ ID NO: 6647 - RNA, 17 nt, Homo sapiens
uggucaccaucucaaug

SEQ ID NO: 6648 - RNA, 17 nt, Homo sapiens
ucaccaucucaaugugg

SEQ ID NO: 6649 - RNA, 17 nt, Homo sapiens
accaucucaaugugguc

SEQ ID NO: 6650 - RNA, 17 nt, Homo sapiens
auguggucaaccuucua

SEQ ID NO: 6651 - RNA, 17 nt, Homo sapiens
uggucaaccuucuaggu

SEQ ID NO: 6652 - RNA, 17 nt, Homo sapiens
ggucaaccuucuaggug

SEQ ID NO: 6653 - RNA, 17 nt, Homo sapiens
caaccuucuaggugccu

SEQ ID NO: 6654 - RNA, 17 nt, Homo sapiens
cuaggugccuguaccaa

SEQ ID NO: 6655 - RNA, 17 nt, Homo sapiens
uaggugccuguaccaag

SEQ ID NO: 6656 - RNA, 17 nt, Homo sapiens
gccuguaccaagccagg

SEQ ID NO: 6657 - RNA, 17 nt, Homo sapiens
ccuguaccaagccagga

SEQ ID NO: 6658 - RNA, 17 nt, Homo sapiens
uaccaagccaggagggc

SEQ ID NO: 6659 - RNA, 17 nt, Homo sapiens
accaagccaggagggcc

SEQ ID NO: 6660 - RNA, 17 nt, Homo sapiens
aggagggccacucaugg

SEQ ID NO: 6661 - RNA, 17 nt, Homo sapiens
ggagggccacucauggu

SEQ ID NO: 6662 - RNA, 17 nt, Homo sapiens
agggccacucaugguga

SEQ ID NO: 6663 - RNA, 17 nt, Homo sapiens
ggccacucauggugauu

SEQ ID NO: 6664 - RNA, 17 nt, Homo sapiens
uggaauucugcaaauuu

SEQ ID NO: 6665 - RNA, 17 nt, Homo sapiens
aauucugcaaauuugga

SEQ ID NO: 6666 - RNA, 17 nt, Homo sapiens
uuggaaaccuguccacu

SEQ ID NO: 6667 - RNA, 17 nt, Homo sapiens
uggaaaccuguccacuu

SEQ ID NO: 6668 - RNA, 17 nt, Homo sapiens
aaccuguccacuuaccu

SEQ ID NO: 6669 - RNA, 17 nt, Homo sapiens
accuguccacuuaccug

SEQ ID NO: 6670 - RNA, 17 nt, Homo sapiens
cuguccacuuaccugag

SEQ ID NO: 6671 - RNA, 17 nt, Homo sapiens
ccacuuaccugaggagc

SEQ ID NO: 6672 - RNA, 17 nt, Homo sapiens
cacuuaccugaggagca

SEQ ID NO: 6673 - RNA, 17 nt, Homo sapiens
ugaggagcaagagaaau

SEQ ID NO: 6674 - RNA, 17 nt, Homo sapiens
aauuuguccccuacaag

SEQ ID NO: 6675 - RNA, 17 nt, Homo sapiens
auuuguccccuacaaga

SEQ ID NO: 6676 - RNA, 17 nt, Homo sapiens
uuuguccccuacaagac

SEQ ID NO: 6677 - RNA, 17 nt, Homo sapiens
uuguccccuacaagacc

SEQ ID NO: 6678 - RNA, 17 nt, Homo sapiens
uccccuacaagaccaaa

SEQ ID NO: 6679 - RNA, 17 nt, Homo sapiens
uacaagaccaaaggggc

SEQ ID NO: 6680 - RNA, 17 nt, Homo sapiens
acaagaccaaaggggca

SEQ ID NO: 6681 - RNA, 17 nt, Homo sapiens
aaaggggcacgauuccg

SEQ ID NO: 6682 - RNA, 17 nt, Homo sapiens
cacgauuccgucaaggg

SEQ ID NO: 6683 - RNA, 17 nt, Homo sapiens
auuccgucaagggaaag

SEQ ID NO: 6684 - RNA, 17 nt, Homo sapiens
ggaaagacuacguugga

SEQ ID NO: 6685 - RNA, 17 nt, Homo sapiens
guuggagcaaucccugu

SEQ ID NO: 6686 - RNA, 17 nt, Homo sapiens
gagcaaucccuguggau

SEQ ID NO: 6687 - RNA, 17 nt, Homo sapiens
agcaaucccuguggauc

SEQ ID NO: 6688 - RNA, 17 nt, Homo sapiens
gcaaucccuguggaucu

SEQ ID NO: 6689 - RNA, 17 nt, Homo sapiens
uguggaucugaaacggc

SEQ ID NO: 6690 - RNA, 17 nt, Homo sapiens
aacggcgcuuggacagc

SEQ ID NO: 6691 - RNA, 17 nt, Homo sapiens
gcuuggacagcaucacc

SEQ ID NO: 6692 - RNA, 17 nt, Homo sapiens
uggacagcaucaccagu

SEQ ID NO: 6693 - RNA, 17 nt, Homo sapiens
acagcaucaccaguagc

SEQ ID NO: 6694 - RNA, 17 nt, Homo sapiens
agcaucaccaguagcca

SEQ ID NO: 6695 - RNA, 17 nt, Homo sapiens
gcaucaccaguagccag

SEQ ID NO: 6696 - RNA, 17 nt, Homo sapiens
ccaguagccagagcuca

SEQ ID NO: 6697 - RNA, 17 nt, Homo sapiens
caguagccagagcucag

SEQ ID NO: 6698 - RNA, 17 nt, Homo sapiens
gccagagcucagccagc

SEQ ID NO: 6699 - RNA, 17 nt, Homo sapiens
cagagcucagccagcuc

SEQ ID NO: 6700 - RNA, 17 nt, Homo sapiens
agcucagccagcucugg

SEQ ID NO: 6701 - RNA, 17 nt, Homo sapiens
gcucagccagcucugga

SEQ ID NO: 6702 - RNA, 17 nt, Homo sapiens
cagccagcucuggauuu

SEQ ID NO: 6703 - RNA, 17 nt, Homo sapiens
gccagcucuggauuugu

SEQ ID NO: 6704 - RNA, 17 nt, Homo sapiens
gagaagucccucaguga

SEQ ID NO: 6705 - RNA, 17 nt, Homo sapiens
agaagucccucagugau

SEQ ID NO: 6706 - RNA, 17 nt, Homo sapiens
gaagucccucagugaug

SEQ ID NO: 6707 - RNA, 17 nt, Homo sapiens
agucccucagugaugua

SEQ ID NO: 6708 - RNA, 17 nt, Homo sapiens
gaggaagcuccugaaga

SEQ ID NO: 6709 - RNA, 17 nt, Homo sapiens
ggaagcuccugaagauc

SEQ ID NO: 6710 - RNA, 17 nt, Homo sapiens
gaagcuccugaagaucu

SEQ ID NO: 6711 - RNA, 17 nt, Homo sapiens
ugaagaucuguauaagg

SEQ ID NO: 6712 - RNA, 17 nt, Homo sapiens
auaaggacuuccugacc

SEQ ID NO: 6713 - RNA, 17 nt, Homo sapiens
aggacuuccugaccuug

SEQ ID NO: 6714 - RNA, 17 nt, Homo sapiens
ggacuuccugaccuugg

SEQ ID NO: 6715 - RNA, 17 nt, Homo sapiens
uuccugaccuuggagca

SEQ ID NO: 6716 - RNA, 17 nt, Homo sapiens
uccugaccuuggagcau

SEQ ID NO: 6717 - RNA, 17 nt, Homo sapiens
cuuggagcaucucaucu

SEQ ID NO: 6718 - RNA, 17 nt, Homo sapiens
ggagcaucucaucuguu

SEQ ID NO: 6719 - RNA, 17 nt, Homo sapiens
agcaucucaucuguuac

SEQ ID NO: 6720 - RNA, 17 nt, Homo sapiens
aucucaucuguuacagc

SEQ ID NO: 6721 - RNA, 17 nt, Homo sapiens
ucuguuacagcuuccaa

SEQ ID NO: 6722 - RNA, 17 nt, Homo sapiens
guuacagcuuccaagug

SEQ ID NO: 6723 - RNA, 17 nt, Homo sapiens
acagcuuccaaguggcu

SEQ ID NO: 6724 - RNA, 17 nt, Homo sapiens
cagcuuccaaguggcua

SEQ ID NO: 6725 - RNA, 17 nt, Homo sapiens
caaguggcuaagggcau

SEQ ID NO: 6726 - RNA, 17 nt, Homo sapiens
cuaagggcauggaguuc

SEQ ID NO: 6727 - RNA, 17 nt, Homo sapiens
uggaguucuuggcaucg

SEQ ID NO: 6728 - RNA, 17 nt, Homo sapiens
uucuuggcaucgcgaaa

SEQ ID NO: 6729 - RNA, 17 nt, Homo sapiens
aguguauccacagggac

SEQ ID NO: 6730 - RNA, 17 nt, Homo sapiens
guguauccacagggacc

SEQ ID NO: 6731 - RNA, 17 nt, Homo sapiens
guauccacagggaccug

SEQ ID NO: 6732 - RNA, 17 nt, Homo sapiens
acagggaccuggcggca

SEQ ID NO: 6733 - RNA, 17 nt, Homo sapiens
cagggaccuggcggcac

SEQ ID NO: 6734 - RNA, 17 nt, Homo sapiens
cuggcggcacgaaauau

SEQ ID NO: 6735 - RNA, 17 nt, Homo sapiens
gaaauauccucuuaucg

SEQ ID NO: 6736 - RNA, 17 nt, Homo sapiens
aaauauccucuuaucgg

SEQ ID NO: 6737 - RNA, 17 nt, Homo sapiens
auauccucuuaucggag

SEQ ID NO: 6738 - RNA, 17 nt, Homo sapiens
uuaaaaucugugacuuu

SEQ ID NO: 6739 - RNA, 17 nt, Homo sapiens
ucugugacuuuggcuug

SEQ ID NO: 6740 - RNA, 17 nt, Homo sapiens
acuuuggcuuggcccgg

SEQ ID NO: 6741 - RNA, 17 nt, Homo sapiens
ggcuuggcccgggauau

SEQ ID NO: 6742 - RNA, 17 nt, Homo sapiens
gcuuggcccgggauauu

SEQ ID NO: 6743 - RNA, 17 nt, Homo sapiens
uaaagauccagauuaug

SEQ ID NO: 6744 - RNA, 17 nt, Homo sapiens
aaagauccagauuaugu

SEQ ID NO: 6745 - RNA, 17 nt, Homo sapiens
auuaugucagaaaagga

SEQ ID NO: 6746 - RNA, 17 nt, Homo sapiens
ggagaugcucgccuccc

SEQ ID NO: 6747 - RNA, 17 nt, Homo sapiens
augcucgccucccuuug

SEQ ID NO: 6748 - RNA, 17 nt, Homo sapiens
ugcucgccucccuuuga

SEQ ID NO: 6749 - RNA, 17 nt, Homo sapiens
cucgccucccuuugaaa

SEQ ID NO: 6750 - RNA, 17 nt, Homo sapiens
ucgccucccuuugaaau

SEQ ID NO: 6751 - RNA, 17 nt, Homo sapiens
cgccucccuuugaaaug

SEQ ID NO: 6752 - RNA, 17 nt, Homo sapiens
uggauggccccagaaac

SEQ ID NO: 6753 - RNA, 17 nt, Homo sapiens
ggauggccccagaaaca

SEQ ID NO: 6754 - RNA, 17 nt, Homo sapiens
gauggccccagaaacaa

SEQ ID NO: 6755 - RNA, 17 nt, Homo sapiens
auggccccagaaacaau

SEQ ID NO: 6756 - RNA, 17 nt, Homo sapiens
ccagaaacaauuuuuga

SEQ ID NO: 6757 - RNA, 17 nt, Homo sapiens
uuuuugacagaguguac

SEQ ID NO: 6758 - RNA, 17 nt, Homo sapiens
gaguguacacaauccag

SEQ ID NO: 6759 - RNA, 17 nt, Homo sapiens
guguacacaauccagag

SEQ ID NO: 6760 - RNA, 17 nt, Homo sapiens
acacaauccagagugac

SEQ ID NO: 6761 - RNA, 17 nt, Homo sapiens
cacaauccagagugacg

SEQ ID NO: 6762 - RNA, 17 nt, Homo sapiens
gugacgucuggucuuuu

SEQ ID NO: 6763 - RNA, 17 nt, Homo sapiens
gucuggucuuuuggugu

SEQ ID NO: 6764 - RNA, 17 nt, Homo sapiens
uguuuugcugugggaaa

SEQ ID NO: 6765 - RNA, 17 nt, Homo sapiens
auauuuuccuuaggugc

SEQ ID NO: 6766 - RNA, 17 nt, Homo sapiens
uauuuuccuuaggugcu

SEQ ID NO: 6767 - RNA, 17 nt, Homo sapiens
uuaggugcuucuccaua

SEQ ID NO: 6768 - RNA, 17 nt, Homo sapiens
ggugcuucuccauaucc

SEQ ID NO: 6769 - RNA, 17 nt, Homo sapiens
ugcuucuccauauccug

SEQ ID NO: 6770 - RNA, 17 nt, Homo sapiens
gcuucuccauauccugg

SEQ ID NO: 6771 - RNA, 17 nt, Homo sapiens
uccauauccugggguaa

SEQ ID NO: 6772 - RNA, 17 nt, Homo sapiens
ccauauccugggguaaa

SEQ ID NO: 6773 - RNA, 17 nt, Homo sapiens
gaaggaacuagaaugag

SEQ ID NO: 6774 - RNA, 17 nt, Homo sapiens
augagggccccugauua

SEQ ID NO: 6775 - RNA, 17 nt, Homo sapiens
ugagggccccugauuau

SEQ ID NO: 6776 - RNA, 17 nt, Homo sapiens
gagggccccugauuaua

SEQ ID NO: 6777 - RNA, 17 nt, Homo sapiens
agggccccugauuauac

SEQ ID NO: 6778 - RNA, 17 nt, Homo sapiens
gauuauacuacaccaga

SEQ ID NO: 6779 - RNA, 17 nt, Homo sapiens
uauacuacaccagaaau

SEQ ID NO: 6780 - RNA, 17 nt, Homo sapiens
uacuacaccagaaaugu

SEQ ID NO: 6781 - RNA, 17 nt, Homo sapiens
acuacaccagaaaugua

SEQ ID NO: 6782 - RNA, 17 nt, Homo sapiens
aaauguaccagaccaug

SEQ ID NO: 6783 - RNA, 17 nt, Homo sapiens
aauguaccagaccaugc

SEQ ID NO: 6784 - RNA, 17 nt, Homo sapiens
uaccagaccaugcugga

SEQ ID NO: 6785 - RNA, 17 nt, Homo sapiens
accagaccaugcuggac

SEQ ID NO: 6786 - RNA, 17 nt, Homo sapiens
gaccaugcuggacugcu

SEQ ID NO: 6787 - RNA, 17 nt, Homo sapiens
uggacugcuggcacggg

SEQ ID NO: 6788 - RNA, 17 nt, Homo sapiens
cugcuggcacggggagc

SEQ ID NO: 6789 - RNA, 17 nt, Homo sapiens
cggggagcccagucaga

SEQ ID NO: 6790 - RNA, 17 nt, Homo sapiens
ggggagcccagucagag

SEQ ID NO: 6791 - RNA, 17 nt, Homo sapiens
gggagcccagucagaga

SEQ ID NO: 6792 - RNA, 17 nt, Homo sapiens
gcccagucagagaccca

SEQ ID NO: 6793 - RNA, 17 nt, Homo sapiens
ucagagacccacguuuu

SEQ ID NO: 6794 - RNA, 17 nt, Homo sapiens
cagagacccacguuuuc

SEQ ID NO: 6795 - RNA, 17 nt, Homo sapiens
agagacccacguuuuca

SEQ ID NO: 6796 - RNA, 17 nt, Homo sapiens
acguuuucagaguuggu

SEQ ID NO: 6797 - RNA, 17 nt, Homo sapiens
gguggaacauuugggaa

SEQ ID NO: 6798 - RNA, 17 nt, Homo sapiens
gggaaaucucuugcaag

SEQ ID NO: 6799 - RNA, 17 nt, Homo sapiens
gaaaucucuugcaagcu

SEQ ID NO: 6800 - RNA, 17 nt, Homo sapiens
ucucuugcaagcuaaug

SEQ ID NO: 6801 - RNA, 17 nt, Homo sapiens
uugcaagcuaaugcuca

SEQ ID NO: 6802 - RNA, 17 nt, Homo sapiens
gcuaaugcucagcagga

SEQ ID NO: 6803 - RNA, 17 nt, Homo sapiens
uaaugcucagcaggaug

SEQ ID NO: 6804 - RNA, 17 nt, Homo sapiens
ugcucagcaggauggca

SEQ ID NO: 6805 - RNA, 17 nt, Homo sapiens
aggauggcaaagacuac

SEQ ID NO: 6806 - RNA, 17 nt, Homo sapiens
gcaaagacuacauuguu

SEQ ID NO: 6807 - RNA, 17 nt, Homo sapiens
aagacuacauuguucuu

SEQ ID NO: 6808 - RNA, 17 nt, Homo sapiens
cauuguucuuccgauau

SEQ ID NO: 6809 - RNA, 17 nt, Homo sapiens
uguucuuccgauaucag

SEQ ID NO: 6810 - RNA, 17 nt, Homo sapiens
ccgauaucagagacuuu

SEQ ID NO: 6811 - RNA, 17 nt, Homo sapiens
ucagagacuuugagcau

SEQ ID NO: 6812 - RNA, 17 nt, Homo sapiens
cuuugagcauggaagag

SEQ ID NO: 6813 - RNA, 17 nt, Homo sapiens
gaggauucuggacucuc

SEQ ID NO: 6814 - RNA, 17 nt, Homo sapiens
uucuggacucucucugc

SEQ ID NO: 6815 - RNA, 17 nt, Homo sapiens
cuggacucucucugccu

SEQ ID NO: 6816 - RNA, 17 nt, Homo sapiens
ggacucucucugccuac

SEQ ID NO: 6817 - RNA, 17 nt, Homo sapiens
acucucucugccuaccu

SEQ ID NO: 6818 - RNA, 17 nt, Homo sapiens
cucucugccuaccucac

SEQ ID NO: 6819 - RNA, 17 nt, Homo sapiens
ucucugccuaccucacc

SEQ ID NO: 6820 - RNA, 17 nt, Homo sapiens
cugccuaccucaccugu

SEQ ID NO: 6821 - RNA, 17 nt, Homo sapiens
ugccuaccucaccuguu

SEQ ID NO: 6822 - RNA, 17 nt, Homo sapiens
ccuaccucaccuguuuc

SEQ ID NO: 6823 - RNA, 17 nt, Homo sapiens
uaccucaccuguuuccu

SEQ ID NO: 6824 - RNA, 17 nt, Homo sapiens
accucaccuguuuccug

SEQ ID NO: 6825 - RNA, 17 nt, Homo sapiens
ccuguuuccuguaugga

SEQ ID NO: 6826 - RNA, 17 nt, Homo sapiens
cuguuuccuguauggag

SEQ ID NO: 6827 - RNA, 17 nt, Homo sapiens
uaugugaccccaaauuc

SEQ ID NO: 6828 - RNA, 17 nt, Homo sapiens
augugaccccaaauucc

SEQ ID NO: 6829 - RNA, 17 nt, Homo sapiens
ugugaccccaaauucca

SEQ ID NO: 6830 - RNA, 17 nt, Homo sapiens
gugaccccaaauuccau

SEQ ID NO: 6831 - RNA, 17 nt, Homo sapiens
ccaaauuccauuaugac

SEQ ID NO: 6832 - RNA, 17 nt, Homo sapiens
caaauuccauuaugaca

SEQ ID NO: 6833 - RNA, 17 nt, Homo sapiens
auuaugacaacacagca

SEQ ID NO: 6834 - RNA, 17 nt, Homo sapiens
augacaacacagcagga

SEQ ID NO: 6835 - RNA, 17 nt, Homo sapiens
gacaacacagcaggaau

SEQ ID NO: 6836 - RNA, 17 nt, Homo sapiens
aacacagcaggaaucag

SEQ ID NO: 6837 - RNA, 17 nt, Homo sapiens
caggaaucagucaguau

SEQ ID NO: 6838 - RNA, 17 nt, Homo sapiens
aaucagucaguaucugc

SEQ ID NO: 6839 - RNA, 17 nt, Homo sapiens
ucaguaucugcagaaca

SEQ ID NO: 6840 - RNA, 17 nt, Homo sapiens
guaucugcagaacagua

SEQ ID NO: 6841 - RNA, 17 nt, Homo sapiens
ugcagaacaguaagcga

SEQ ID NO: 6842 - RNA, 17 nt, Homo sapiens
gaaagagccggccugug

SEQ ID NO: 6843 - RNA, 17 nt, Homo sapiens
gagccggccugugagug

SEQ ID NO: 6844 - RNA, 17 nt, Homo sapiens
agccggccugugagugu

SEQ ID NO: 6845 - RNA, 17 nt, Homo sapiens
guaaaaacauuugaaga

SEQ ID NO: 6846 - RNA, 17 nt, Homo sapiens
aagauaucccguuagaa

SEQ ID NO: 6847 - RNA, 17 nt, Homo sapiens
agauaucccguuagaag

SEQ ID NO: 6848 - RNA, 17 nt, Homo sapiens
agaagaaccagaaguaa

SEQ ID NO: 6849 - RNA, 17 nt, Homo sapiens
gaagaaccagaaguaaa

SEQ ID NO: 6850 - RNA, 17 nt, Homo sapiens
aaguaaucccagaugac

SEQ ID NO: 6851 - RNA, 17 nt, Homo sapiens
aguaaucccagaugaca

SEQ ID NO: 6852 - RNA, 17 nt, Homo sapiens
guaaucccagaugacaa

SEQ ID NO: 6853 - RNA, 17 nt, Homo sapiens
cagaugacaaccagacg

SEQ ID NO: 6854 - RNA, 17 nt, Homo sapiens
augacaaccagacggac

SEQ ID NO: 6855 - RNA, 17 nt, Homo sapiens
ugacaaccagacggaca

SEQ ID NO: 6856 - RNA, 17 nt, Homo sapiens
agacggacagugguaug

SEQ ID NO: 6857 - RNA, 17 nt, Homo sapiens
uaugguucuugccucag

SEQ ID NO: 6858 - RNA, 17 nt, Homo sapiens
guucuugccucagaaga

SEQ ID NO: 6859 - RNA, 17 nt, Homo sapiens
uucuugccucagaagag

SEQ ID NO: 6860 - RNA, 17 nt, Homo sapiens
cuugccucagaagagcu

SEQ ID NO: 6861 - RNA, 17 nt, Homo sapiens
agaagagcugaaaacuu

SEQ ID NO: 6862 - RNA, 17 nt, Homo sapiens
cugaaaacuuuggaaga

SEQ ID NO: 6863 - RNA, 17 nt, Homo sapiens
uggaagacagaaccaaa

SEQ ID NO: 6864 - RNA, 17 nt, Homo sapiens
gacagaaccaaauuauc

SEQ ID NO: 6865 - RNA, 17 nt, Homo sapiens
acagaaccaaauuaucu

SEQ ID NO: 6866 - RNA, 17 nt, Homo sapiens
aaauuaucuccaucuuu

SEQ ID NO: 6867 - RNA, 17 nt, Homo sapiens
auuaucuccaucuuuug

SEQ ID NO: 6868 - RNA, 17 nt, Homo sapiens
uuaucuccaucuuuugg

SEQ ID NO: 6869 - RNA, 17 nt, Homo sapiens
ucuccaucuuuuggugg

SEQ ID NO: 6870 - RNA, 17 nt, Homo sapiens
aauggugcccagcaaaa

SEQ ID NO: 6871 - RNA, 17 nt, Homo sapiens
auggugcccagcaaaag

SEQ ID NO: 6872 - RNA, 17 nt, Homo sapiens
uggugcccagcaaaagc

SEQ ID NO: 6873 - RNA, 17 nt, Homo sapiens
ugcccagcaaaagcagg

SEQ ID NO: 6874 - RNA, 17 nt, Homo sapiens
gcaaaagcagggagucu

SEQ ID NO: 6875 - RNA, 17 nt, Homo sapiens
agggagucuguggcauc

SEQ ID NO: 6876 - RNA, 17 nt, Homo sapiens
ucuguggcaucugaagg

SEQ ID NO: 6877 - RNA, 17 nt, Homo sapiens
guggcaucugaaggcuc

SEQ ID NO: 6878 - RNA, 17 nt, Homo sapiens
cugaaggcucaaaccag

SEQ ID NO: 6879 - RNA, 17 nt, Homo sapiens
gaaggcucaaaccagac

SEQ ID NO: 6880 - RNA, 17 nt, Homo sapiens
gcucaaaccagacaagc

SEQ ID NO: 6881 - RNA, 17 nt, Homo sapiens
cucaaaccagacaagcg

SEQ ID NO: 6882 - RNA, 17 nt, Homo sapiens
aaccagacaagcggcua

SEQ ID NO: 6883 - RNA, 17 nt, Homo sapiens
caagcggcuaccagucc

SEQ ID NO: 6884 - RNA, 17 nt, Homo sapiens
gcggcuaccaguccgga

SEQ ID NO: 6885 - RNA, 17 nt, Homo sapiens
cggcuaccaguccggau

SEQ ID NO: 6886 - RNA, 17 nt, Homo sapiens
uaccaguccggauauca

SEQ ID NO: 6887 - RNA, 17 nt, Homo sapiens
cggauaucacuccgaug

SEQ ID NO: 6888 - RNA, 17 nt, Homo sapiens
gauaucacuccgaugac

SEQ ID NO: 6889 - RNA, 17 nt, Homo sapiens
uaucacuccgaugacac

SEQ ID NO: 6890 - RNA, 17 nt, Homo sapiens
ccgaugacacagacacc

SEQ ID NO: 6891 - RNA, 17 nt, Homo sapiens
gaugacacagacaccac

SEQ ID NO: 6892 - RNA, 17 nt, Homo sapiens
acacagacaccaccgug

SEQ ID NO: 6893 - RNA, 17 nt, Homo sapiens
acagacaccaccgugua

SEQ ID NO: 6894 - RNA, 17 nt, Homo sapiens
cagacaccaccguguac

SEQ ID NO: 6895 - RNA, 17 nt, Homo sapiens
gacaccaccguguacuc

SEQ ID NO: 6896 - RNA, 17 nt, Homo sapiens
ccguguacuccagugag

SEQ ID NO: 6897 - RNA, 17 nt, Homo sapiens
guguacuccagugagga

SEQ ID NO: 6898 - RNA, 17 nt, Homo sapiens
uguacuccagugaggaa

SEQ ID NO: 6899 - RNA, 17 nt, Homo sapiens
gaggaagcagaacuuuu

SEQ ID NO: 6900 - RNA, 17 nt, Homo sapiens
agcagaacuuuuaaagc

SEQ ID NO: 6901 - RNA, 17 nt, Homo sapiens
uuuaaagcugauagaga

SEQ ID NO: 6902 - RNA, 17 nt, Homo sapiens
uggagugcaaaccggua

SEQ ID NO: 6903 - RNA, 17 nt, Homo sapiens
gugcaaaccgguagcac

SEQ ID NO: 6904 - RNA, 17 nt, Homo sapiens
ccgguagcacagcccag

SEQ ID NO: 6905 - RNA, 17 nt, Homo sapiens
gguagcacagcccagau

SEQ ID NO: 6906 - RNA, 17 nt, Homo sapiens
agcacagcccagauucu

SEQ ID NO: 6907 - RNA, 17 nt, Homo sapiens
gcacagcccagauucuc

SEQ ID NO: 6908 - RNA, 17 nt, Homo sapiens
cacagcccagauucucc

SEQ ID NO: 6909 - RNA, 17 nt, Homo sapiens
ccagauucuccagccug

SEQ ID NO: 6910 - RNA, 17 nt, Homo sapiens
agauucuccagccugac

SEQ ID NO: 6911 - RNA, 17 nt, Homo sapiens
gauucuccagccugaca

SEQ ID NO: 6912 - RNA, 17 nt, Homo sapiens
ucuccagccugacacgg

SEQ ID NO: 6913 - RNA, 17 nt, Homo sapiens
cuccagccugacacggg

SEQ ID NO: 6914 - RNA, 17 nt, Homo sapiens
agccugacacggggacc

SEQ ID NO: 6915 - RNA, 17 nt, Homo sapiens
acggggaccacacugag

SEQ ID NO: 6916 - RNA, 17 nt, Homo sapiens
cggggaccacacugagc

SEQ ID NO: 6917 - RNA, 17 nt, Homo sapiens
gggaccacacugagcuc

SEQ ID NO: 6918 - RNA, 17 nt, Homo sapiens
gaccacacugagcucuc

SEQ ID NO: 6919 - RNA, 17 nt, Homo sapiens
cacugagcucuccuccu

SEQ ID NO: 6920 - RNA, 17 nt, Homo sapiens
cugagcucuccuccugu

SEQ ID NO: 6921 - RNA, 17 nt, Homo sapiens
gagcucuccuccuguuu

SEQ ID NO: 6922 - RNA, 17 nt, Homo sapiens
agcucuccuccuguuua

SEQ ID NO: 6923 - RNA, 17 nt, Homo sapiens
cucuccuccuguuuaaa

SEQ ID NO: 6924 - RNA, 17 nt, Homo sapiens
ucuccuccuguuuaaaa

SEQ ID NO: 6925 - RNA, 17 nt, Homo sapiens
aaggaagcauccacacc

SEQ ID NO: 6926 - RNA, 17 nt, Homo sapiens
gaagcauccacacccca

SEQ ID NO: 6927 - RNA, 17 nt, Homo sapiens
aagcauccacaccccaa

SEQ ID NO: 6928 - RNA, 17 nt, Homo sapiens
gcauccacaccccaacu

SEQ ID NO: 6929 - RNA, 17 nt, Homo sapiens
auccacaccccaacucc

SEQ ID NO: 6930 - RNA, 17 nt, Homo sapiens
uccacaccccaacuccc

SEQ ID NO: 6931 - RNA, 17 nt, Homo sapiens
ccacaccccaacucccg

SEQ ID NO: 6932 - RNA, 17 nt, Homo sapiens
cacaccccaacucccgg

SEQ ID NO: 6933 - RNA, 17 nt, Homo sapiens
accccaacucccggaca

SEQ ID NO: 6934 - RNA, 17 nt, Homo sapiens
cccaacucccggacauc

SEQ ID NO: 6935 - RNA, 17 nt, Homo sapiens
ccaacucccggacauca

SEQ ID NO: 6936 - RNA, 17 nt, Homo sapiens
ucccggacaucacauga

SEQ ID NO: 6937 - RNA, 17 nt, Homo sapiens
cggacaucacaugagag

SEQ ID NO: 6938 - RNA, 17 nt, Homo sapiens
gacaucacaugagaggu

SEQ ID NO: 6939 - RNA, 17 nt, Homo sapiens
gagaggucugcucagau

SEQ ID NO: 6940 - RNA, 17 nt, Homo sapiens
aggucugcucagauuuu

SEQ ID NO: 6941 - RNA, 17 nt, Homo sapiens
gucugcucagauuuuga

SEQ ID NO: 6942 - RNA, 17 nt, Homo sapiens
uguuguucuuuccacca

SEQ ID NO: 6943 - RNA, 17 nt, Homo sapiens
guucuuuccaccagcag

SEQ ID NO: 6944 - RNA, 17 nt, Homo sapiens
uucuuuccaccagcagg

SEQ ID NO: 6945 - RNA, 17 nt, Homo sapiens
cuuuccaccagcaggaa

SEQ ID NO: 6946 - RNA, 17 nt, Homo sapiens
uuuccaccagcaggaag

SEQ ID NO: 6947 - RNA, 17 nt, Homo sapiens
ccaccagcaggaaguag

SEQ ID NO: 6948 - RNA, 17 nt, Homo sapiens
gaaguagccgcauuuga

SEQ ID NO: 6949 - RNA, 17 nt, Homo sapiens
guagccgcauuugauuu

SEQ ID NO: 6950 - RNA, 17 nt, Homo sapiens
ugauuuucauuucgaca

SEQ ID NO: 6951 - RNA, 17 nt, Homo sapiens
auuucgacaacagaaaa

SEQ ID NO: 6952 - RNA, 17 nt, Homo sapiens
ucgacaacagaaaaagg

SEQ ID NO: 6953 - RNA, 17 nt, Homo sapiens
aaaaggaccucggacug

SEQ ID NO: 6954 - RNA, 17 nt, Homo sapiens
aaaggaccucggacugc

SEQ ID NO: 6955 - RNA, 17 nt, Homo sapiens
ccucggacugcagggag

SEQ ID NO: 6956 - RNA, 17 nt, Homo sapiens
cggacugcagggagcca

SEQ ID NO: 6957 - RNA, 17 nt, Homo sapiens
cagggagccagcucuuc

SEQ ID NO: 6958 - RNA, 17 nt, Homo sapiens
agggagccagcucuucu

SEQ ID NO: 6959 - RNA, 17 nt, Homo sapiens
gagccagcucuucuagg

SEQ ID NO: 6960 - RNA, 17 nt, Homo sapiens
gccagcucuucuaggcu

SEQ ID NO: 6961 - RNA, 17 nt, Homo sapiens
agcucuucuaggcuugu

SEQ ID NO: 6962 - RNA, 16 nt, Homo sapiens
gcaaggugcugcuggc

SEQ ID NO: 6963 - RNA, 16 nt, Homo sapiens
gcuggccgucgcccug

SEQ ID NO: 6964 - RNA, 16 nt, Homo sapiens
cuguggcucugcgugg

SEQ ID NO: 6965 - RNA, 16 nt, Homo sapiens
gacccgggccgccucu

SEQ ID NO: 6966 - RNA, 16 nt, Homo sapiens
cuguggguuugccuag

SEQ ID NO: 6967 - RNA, 16 nt, Homo sapiens
uguuucucuugaucug

SEQ ID NO: 6968 - RNA, 16 nt, Homo sapiens
cucuugaucugcccag

SEQ ID NO: 6969 - RNA, 16 nt, Homo sapiens
caaauuacuugcaggg

SEQ ID NO: 6970 - RNA, 16 nt, Homo sapiens
gaguggcagugagcaa

SEQ ID NO: 6971 - RNA, 16 nt, Homo sapiens
ggguggaggugacuga

SEQ ID NO: 6972 - RNA, 16 nt, Homo sapiens
ggaggugacugagugc

SEQ ID NO: 6973 - RNA, 16 nt, Homo sapiens
gugacugagugcagcg

SEQ ID NO: 6974 - RNA, 16 nt, Homo sapiens
ugagugcagcgauggc

SEQ ID NO: 6975 - RNA, 16 nt, Homo sapiens
uuccaaaagugaucgg

SEQ ID NO: 6976 - RNA, 16 nt, Homo sapiens
gaucggaaaugacacu

SEQ ID NO: 6977 - RNA, 16 nt, Homo sapiens
gccuacaagugcuucu

SEQ ID NO: 6978 - RNA, 16 nt, Homo sapiens
ccgggaaacugacuug

SEQ ID NO: 6979 - RNA, 16 nt, Homo sapiens
uccauuuauugcuucu

SEQ ID NO: 6980 - RNA, 16 nt, Homo sapiens
uucuguuagugaccaa

SEQ ID NO: 6981 - RNA, 16 nt, Homo sapiens
guacauuacugagaac

SEQ ID NO: 6982 - RNA, 16 nt, Homo sapiens
aaacuguggugauucc

SEQ ID NO: 6983 - RNA, 16 nt, Homo sapiens
gucacuuugugcaaga

SEQ ID NO: 6984 - RNA, 16 nt, Homo sapiens
auuuguuccugauggu

SEQ ID NO: 6985 - RNA, 16 nt, Homo sapiens
ccagcuacaugaucag

SEQ ID NO: 6986 - RNA, 16 nt, Homo sapiens
gaucagcuaugcuggc

SEQ ID NO: 6987 - RNA, 16 nt, Homo sapiens
ggucuucugugaagca

SEQ ID NO: 6988 - RNA, 16 nt, Homo sapiens
aaaaauuaaugaugaa

SEQ ID NO: 6989 - RNA, 16 nt, Homo sapiens
aauuaaugaugaaagu

SEQ ID NO: 6990 - RNA, 16 nt, Homo sapiens
uaggauuuaugaugug

SEQ ID NO: 6991 - RNA, 16 nt, Homo sapiens
augugguucugagucc

SEQ ID NO: 6992 - RNA, 16 nt, Homo sapiens
ucauggaauugaacua

SEQ ID NO: 6993 - RNA, 16 nt, Homo sapiens
agcaagaacugaacua

SEQ ID NO: 6994 - RNA, 16 nt, Homo sapiens
uguggggauugacuuc

SEQ ID NO: 6995 - RNA, 16 nt, Homo sapiens
acccuucuucgaagca

SEQ ID NO: 6996 - RNA, 16 nt, Homo sapiens
cuuguaaaccgagacc

SEQ ID NO: 6997 - RNA, 16 nt, Homo sapiens
gucugggagugagaug

SEQ ID NO: 6998 - RNA, 16 nt, Homo sapiens
ggagugagaugaagaa

SEQ ID NO: 6999 - RNA, 16 nt, Homo sapiens
agaaauuuuugagcac

SEQ ID NO: 7000 - RNA, 16 nt, Homo sapiens
aacccggagugaccaa

SEQ ID NO: 7001 - RNA, 16 nt, Homo sapiens
guacaccugugcagca

SEQ ID NO: 7002 - RNA, 16 nt, Homo sapiens
ccagugggcugaugac

SEQ ID NO: 7003 - RNA, 16 nt, Homo sapiens
gugggcugaugaccaa

SEQ ID NO: 7004 - RNA, 16 nt, Homo sapiens
caggguccaugaaaaa

SEQ ID NO: 7005 - RNA, 16 nt, Homo sapiens
accuuuuguugcuuuu

SEQ ID NO: 7006 - RNA, 16 nt, Homo sapiens
cagaaucccugcgaag

SEQ ID NO: 7007 - RNA, 16 nt, Homo sapiens
gaaucccugcgaagua

SEQ ID NO: 7008 - RNA, 16 nt, Homo sapiens
aauaccccuugagucc

SEQ ID NO: 7009 - RNA, 16 nt, Homo sapiens
ggcauguacugacgau

SEQ ID NO: 7010 - RNA, 16 nt, Homo sapiens
auguacugacgauuau

SEQ ID NO: 7011 - RNA, 16 nt, Homo sapiens
uuauggaagugaguga

SEQ ID NO: 7012 - RNA, 16 nt, Homo sapiens
ggaagugagugaaaga

SEQ ID NO: 7013 - RNA, 16 nt, Homo sapiens
ccagauuggugagaaa

SEQ ID NO: 7014 - RNA, 16 nt, Homo sapiens
ccacucaaacgcugac

SEQ ID NO: 7015 - RNA, 16 nt, Homo sapiens
cucaaacgcugacaug

SEQ ID NO: 7016 - RNA, 16 nt, Homo sapiens
uacggucuaugccauu

SEQ ID NO: 7017 - RNA, 16 nt, Homo sapiens
uuccucccccgcauca

SEQ ID NO: 7018 - RNA, 16 nt, Homo sapiens
gaggaagagugcgcca

SEQ ID NO: 7019 - RNA, 16 nt, Homo sapiens
ggaagagugcgccaac

SEQ ID NO: 7020 - RNA, 16 nt, Homo sapiens
gugcgccaacgagccc

SEQ ID NO: 7021 - RNA, 16 nt, Homo sapiens
cugucucagugacaaa

SEQ ID NO: 7022 - RNA, 16 nt, Homo sapiens
auacccuugugaagaa

SEQ ID NO: 7023 - RNA, 16 nt, Homo sapiens
aaauaaaauugaaguu

SEQ ID NO: 7024 - RNA, 16 nt, Homo sapiens
aaaucaauuugcucua

SEQ ID NO: 7025 - RNA, 16 nt, Homo sapiens
ugcucuaauugaagga

SEQ ID NO: 7026 - RNA, 16 nt, Homo sapiens
guacaaaugugaagcg

SEQ ID NO: 7027 - RNA, 16 nt, Homo sapiens
gagagagggugaucuc

SEQ ID NO: 7028 - RNA, 16 nt, Homo sapiens
ccuuccacgugaccag

SEQ ID NO: 7029 - RNA, 16 nt, Homo sapiens
cagggguccugaaauu

SEQ ID NO: 7030 - RNA, 16 nt, Homo sapiens
aaauuacuuugcaacc

SEQ ID NO: 7031 - RNA, 16 nt, Homo sapiens
uuugcaaccugacaug

SEQ ID NO: 7032 - RNA, 16 nt, Homo sapiens
aaccugacaugcagcc

SEQ ID NO: 7033 - RNA, 16 nt, Homo sapiens
gcagcccacugagcag

SEQ ID NO: 7034 - RNA, 16 nt, Homo sapiens
ucuuuguggugcacug

SEQ ID NO: 7035 - RNA, 16 nt, Homo sapiens
guggugcacugcagac

SEQ ID NO: 7036 - RNA, 16 nt, Homo sapiens
aucuacguuugagaac

SEQ ID NO: 7037 - RNA, 16 nt, Homo sapiens
cacagccucugccaau

SEQ ID NO: 7038 - RNA, 16 nt, Homo sapiens
ugggagaguugcccac

SEQ ID NO: 7039 - RNA, 16 nt, Homo sapiens
acaccuguuugcaaga

SEQ ID NO: 7040 - RNA, 16 nt, Homo sapiens
uuuggaaauugaaugc

SEQ ID NO: 7041 - RNA, 16 nt, Homo sapiens
gaaauugaaugccacc

SEQ ID NO: 7042 - RNA, 16 nt, Homo sapiens
uagcacaaaugacauu

SEQ ID NO: 7043 - RNA, 16 nt, Homo sapiens
augacauuuugaucau

SEQ ID NO: 7044 - RNA, 16 nt, Homo sapiens
gcuuaagaaugcaucc

SEQ ID NO: 7045 - RNA, 16 nt, Homo sapiens
augcauccuugcagga

SEQ ID NO: 7046 - RNA, 16 nt, Homo sapiens
gacuaugucugccuug

SEQ ID NO: 7047 - RNA, 16 nt, Homo sapiens
ugucugccuugcucaa

SEQ ID NO: 7048 - RNA, 16 nt, Homo sapiens
aaaagacauugcgugg

SEQ ID NO: 7049 - RNA, 16 nt, Homo sapiens
uggcacccacgaucac

SEQ ID NO: 7050 - RNA, 16 nt, Homo sapiens
agaaucagacgacaag

SEQ ID NO: 7051 - RNA, 16 nt, Homo sapiens
ggaaagcaucgaaguc

SEQ ID NO: 7052 - RNA, 16 nt, Homo sapiens
gaagucucaugcacgg

SEQ ID NO: 7053 - RNA, 16 nt, Homo sapiens
uaaagauaaugagacc

SEQ ID NO: 7054 - RNA, 16 nt, Homo sapiens
gcauuguauugaagga

SEQ ID NO: 7055 - RNA, 16 nt, Homo sapiens
cucacuauccgcagag

SEQ ID NO: 7056 - RNA, 16 nt, Homo sapiens
uccgcagagugaggaa

SEQ ID NO: 7057 - RNA, 16 nt, Homo sapiens
gaaggaggacgaaggc

SEQ ID NO: 7058 - RNA, 16 nt, Homo sapiens
cucuacaccugccagg

SEQ ID NO: 7059 - RNA, 16 nt, Homo sapiens
ugccaggcaugcagug

SEQ ID NO: 7060 - RNA, 16 nt, Homo sapiens
ucuuggcugugcaaaa

SEQ ID NO: 7061 - RNA, 16 nt, Homo sapiens
aauagaaggugcccag

SEQ ID NO: 7062 - RNA, 16 nt, Homo sapiens
aggaaaagacgaacuu

SEQ ID NO: 7063 - RNA, 16 nt, Homo sapiens
uaguaggcacgacggu

SEQ ID NO: 7064 - RNA, 16 nt, Homo sapiens
gcacgacggugauugc

SEQ ID NO: 7065 - RNA, 16 nt, Homo sapiens
gacggugauugccaug

SEQ ID NO: 7066 - RNA, 16 nt, Homo sapiens
gaggggaacugaagac

SEQ ID NO: 7067 - RNA, 16 nt, Homo sapiens
ggauccagaugaacuc

SEQ ID NO: 7068 - RNA, 16 nt, Homo sapiens
cccauuggaugaacau

SEQ ID NO: 7069 - RNA, 16 nt, Homo sapiens
ugaacauugugaacga

SEQ ID NO: 7070 - RNA, 16 nt, Homo sapiens
cauugugaacgacugc

SEQ ID NO: 7071 - RNA, 16 nt, Homo sapiens
gugaacgacugccuua

SEQ ID NO: 7072 - RNA, 16 nt, Homo sapiens
acugccuuaugaugcc

SEQ ID NO: 7073 - RNA, 16 nt, Homo sapiens
gccuuaugaugccagc

SEQ ID NO: 7074 - RNA, 16 nt, Homo sapiens
gagaccggcugaaccu

SEQ ID NO: 7075 - RNA, 16 nt, Homo sapiens
uggccguggugccuuu

SEQ ID NO: 7076 - RNA, 16 nt, Homo sapiens
ccaagagauugaagca

SEQ ID NO: 7077 - RNA, 16 nt, Homo sapiens
ugaagcagaugccuuu

SEQ ID NO: 7078 - RNA, 16 nt, Homo sapiens
cuuuggaauugacaag

SEQ ID NO: 7079 - RNA, 16 nt, Homo sapiens
acagcaacuugcagga

SEQ ID NO: 7080 - RNA, 16 nt, Homo sapiens
ucaaaauguugaaaga

SEQ ID NO: 7081 - RNA, 16 nt, Homo sapiens
aacacacagugagcau

SEQ ID NO: 7082 - RNA, 16 nt, Homo sapiens
agugagcaucgagcuc

SEQ ID NO: 7083 - RNA, 16 nt, Homo sapiens
ucucaugucugaacuc

SEQ ID NO: 7084 - RNA, 16 nt, Homo sapiens
ccuucuaggugccugu

SEQ ID NO: 7085 - RNA, 16 nt, Homo sapiens
cacucauggugauugu

SEQ ID NO: 7086 - RNA, 16 nt, Homo sapiens
guggaauucugcaaau

SEQ ID NO: 7087 - RNA, 16 nt, Homo sapiens
ccacuuaccugaggag

SEQ ID NO: 7088 - RNA, 16 nt, Homo sapiens
caagagaaaugaauuu

SEQ ID NO: 7089 - RNA, 16 nt, Homo sapiens
aaaggggcacgauucc

SEQ ID NO: 7090 - RNA, 16 nt, Homo sapiens
cuguggaucugaaacg

SEQ ID NO: 7091 - RNA, 16 nt, Homo sapiens
cugaaacggcgcuugg

SEQ ID NO: 7092 - RNA, 16 nt, Homo sapiens
gucccucagugaugua

SEQ ID NO: 7093 - RNA, 16 nt, Homo sapiens
ggaagcuccugaagau

SEQ ID NO: 7094 - RNA, 16 nt, Homo sapiens
aggacuuccugaccuu

SEQ ID NO: 7095 - RNA, 16 nt, Homo sapiens
ucuuggcaucgcgaaa

SEQ ID NO: 7096 - RNA, 16 nt, Homo sapiens
uuggcaucgcgaaagu

SEQ ID NO: 7097 - RNA, 16 nt, Homo sapiens
cuggcggcacgaaaua

SEQ ID NO: 7098 - RNA, 16 nt, Homo sapiens
uaaaaucugugacuuu

SEQ ID NO: 7099 - RNA, 16 nt, Homo sapiens
aaaaggagaugcucgc

SEQ ID NO: 7100 - RNA, 16 nt, Homo sapiens
ggagaugcucgccucc

SEQ ID NO: 7101 - RNA, 16 nt, Homo sapiens
gccucccuuugaaaug

SEQ ID NO: 7102 - RNA, 16 nt, Homo sapiens
aacaauuuuugacaga

SEQ ID NO: 7103 - RNA, 16 nt, Homo sapiens
aauccagagugacguc

SEQ ID NO: 7104 - RNA, 16 nt, Homo sapiens
uugguguuuugcugug

SEQ ID NO: 7105 - RNA, 16 nt, Homo sapiens
uuccuuaggugcuucu

SEQ ID NO: 7106 - RNA, 16 nt, Homo sapiens
gguaaagauugaugaa

SEQ ID NO: 7107 - RNA, 16 nt, Homo sapiens
aaagauugaugaagaa

SEQ ID NO: 7108 - RNA, 16 nt, Homo sapiens
uuuuguaggcgauuga

SEQ ID NO: 7109 - RNA, 16 nt, Homo sapiens
guaggcgauugaaaga

SEQ ID NO: 7110 - RNA, 16 nt, Homo sapiens
gaacuagaaugagggc

SEQ ID NO: 7111 - RNA, 16 nt, Homo sapiens
gagggccccugauuau

SEQ ID NO: 7112 - RNA, 16 nt, Homo sapiens
accagaccaugcugga

SEQ ID NO: 7113 - RNA, 16 nt, Homo sapiens
gaaaucucuugcaagc

SEQ ID NO: 7114 - RNA, 16 nt, Homo sapiens
gcaagcuaaugcucag

SEQ ID NO: 7115 - RNA, 16 nt, Homo sapiens
uuguucuuccgauauc

SEQ ID NO: 7116 - RNA, 16 nt, Homo sapiens
cagagacuuugagcau

SEQ ID NO: 7117 - RNA, 16 nt, Homo sapiens
gacucucucugccuac

SEQ ID NO: 7118 - RNA, 16 nt, Homo sapiens
ggaaguaugugacccc

SEQ ID NO: 7119 - RNA, 16 nt, Homo sapiens
auuccauuaugacaac

SEQ ID NO: 7120 - RNA, 16 nt, Homo sapiens
gucaguaucugcagaa

SEQ ID NO: 7121 - RNA, 16 nt, Homo sapiens
aacaguaagcgaaaga

SEQ ID NO: 7122 - RNA, 16 nt, Homo sapiens
gccggccugugagugu

SEQ ID NO: 7123 - RNA, 16 nt, Homo sapiens
aaaaacauuugaagau

SEQ ID NO: 7124 - RNA, 16 nt, Homo sapiens
aaucccagaugacaac

SEQ ID NO: 7125 - RNA, 16 nt, Homo sapiens
uaugguucuugccuca

SEQ ID NO: 7126 - RNA, 16 nt, Homo sapiens
cagaagagcugaaaac

SEQ ID NO: 7127 - RNA, 16 nt, Homo sapiens
guggaauggugcccag

SEQ ID NO: 7128 - RNA, 16 nt, Homo sapiens
uguggcaucugaaggc

SEQ ID NO: 7129 - RNA, 16 nt, Homo sapiens
auaucacuccgaugac

SEQ ID NO: 7130 - RNA, 16 nt, Homo sapiens
ucacuccgaugacaca

SEQ ID NO: 7131 - RNA, 16 nt, Homo sapiens
guacuccagugaggaa

SEQ ID NO: 7132 - RNA, 16 nt, Homo sapiens
uuuuaaagcugauaga

SEQ ID NO: 7133 - RNA, 16 nt, Homo sapiens
agauuggagugcaaac

SEQ ID NO: 7134 - RNA, 16 nt, Homo sapiens
ucuccagccugacacg

SEQ ID NO: 7135 - RNA, 16 nt, Homo sapiens
ggaccacacugagcuc

SEQ ID NO: 7136 - RNA, 16 nt, Homo sapiens
gacaucacaugagagg

SEQ ID NO: 7137 - RNA, 16 nt, Homo sapiens
ugagaggucugcucag

SEQ ID NO: 7138 - RNA, 16 nt, Homo sapiens
cucagauuuugaagug

SEQ ID NO: 7139 - RNA, 16 nt, Homo sapiens
ggaaguagccgcauuu

SEQ ID NO: 7140 - RNA, 16 nt, Homo sapiens
agccgcauuugauuuu

SEQ ID NO: 7141 - RNA, 16 nt, Homo sapiens
uuuucauuucgacaac

SEQ ID NO: 7142 - RNA, 16 nt, Homo sapiens
accucggacugcaggg

SEQ ID NO: 7143 - RNA, 38 nt, Artificial Sequence
  Description of Artificial Sequence:  Enzymatic Nucleic Acid
gccgagagcugaugaggccguuaggccgaaaguguccg

SEQ ID NO: 7144 - RNA, 38 nt, Artificial Sequence
  Description of Artificial Sequence:  Enzymatic Nucleic Acid
ggagccgacugaugaggccguuaggccgaaaggagugu

SEQ ID NO: 7145 - RNA, 38 nt, Artificial Sequence
  Description of Artificial Sequence:  Enzymatic Nucleic Acid
gaggagcccugaugaggccguuaggccgaaagaggagu

SEQ ID NO: 7146 - RNA, 38 nt, Artificial Sequence
  Description of Artificial Sequence:  Enzymatic Nucleic Acid
ccggggagcugaugaggccguuaggccgaaagccgaga

SEQ ID NO: 7147 - RNA, 38 nt, Artificial Sequence
  Description of Artificial Sequence:  Enzymatic Nucleic Acid
cugccgggcugaugaggccguuaggccgaaaggagccg

SEQ ID NO: 7148 - RNA, 38 nt, Artificial Sequence
  Description of Artificial Sequence:  Enzymatic Nucleic Acid
cccgcucccugaugaggccguuaggccgaaagccgccg

SEQ ID NO: 7149 - RNA, 38 nt, Artificial Sequence
  Description of Artificial Sequence:  Enzymatic Nucleic Acid
gagccccgcugaugaggccguuaggccgaaagcccgcu

SEQ ID NO: 7150 - RNA, 38 nt, Artificial Sequence
  Description of Artificial Sequence:  Enzymatic Nucleic Acid
cugcaccccugaugaggccguuaggccgaaagccccgg

SEQ ID NO: 7151 - RNA, 38 nt, Artificial Sequence
  Description of Artificial Sequence:  Enzymatic Nucleic Acid
ccccgggucugaugaggccguuaggccgaaauccucgc

SEQ ID NO: 7152 - RNA, 38 nt, Artificial Sequence
  Description of Artificial Sequence:  Enzymatic Nucleic Acid
uccccgggcugaugaggccguuaggccgaaaauccucg

SEQ ID NO: 7153 - RNA, 38 nt, Artificial Sequence
  Description of Artificial Sequence:  Enzymatic Nucleic Acid
caggagaccugaugaggccguuaggccgaaaccacuuc

SEQ ID NO: 7154 - RNA, 38 nt, Artificial Sequence
  Description of Artificial Sequence:  Enzymatic Nucleic Acid
agccaggacugaugaggccguuaggccgaaacaaccac

SEQ ID NO: 7155 - RNA, 38 nt, Artificial Sequence
  Description of Artificial Sequence:  Enzymatic Nucleic Acid
ccagccagcugaugaggccguuaggccgaaagacaacc

SEQ ID NO: 7156 - RNA, 38 nt, Artificial Sequence
  Description of Artificial Sequence:  Enzymatic Nucleic Acid
cgcgcccucugaugaggccguuaggccgaaagcgcccg

SEQ ID NO: 7157 - RNA, 38 nt, Artificial Sequence
  Description of Artificial Sequence:  Enzymatic Nucleic Acid
ggccgccacugaugaggccguuaggccgaaaguccguc

SEQ ID NO: 7158 - RNA, 38 nt, Artificial Sequence
  Description of Artificial Sequence:  Enzymatic Nucleic Acid
cggccaaccugaugaggccguuaggccgaaacccggcc

SEQ ID NO: 7159 - RNA, 38 nt, Artificial Sequence
  Description of Artificial Sequence:  Enzymatic Nucleic Acid
ccccggcccugaugaggccguuaggccgaaacgacccg

SEQ ID NO: 7160 - RNA, 38 nt, Artificial Sequence
  Description of Artificial Sequence:  Enzymatic Nucleic Acid
gugagcgccugaugaggccguuaggccgaaacgcggcc

SEQ ID NO: 7161 - RNA, 38 nt, Artificial Sequence
  Description of Artificial Sequence:  Enzymatic Nucleic Acid
accauggucugaugaggccguuaggccgaaagcgcgac

SEQ ID NO: 7162 - RNA, 38 nt, Artificial Sequence
  Description of Artificial Sequence:  Enzymatic Nucleic Acid
caguagcucugaugaggccguuaggccgaaaccauggu

SEQ ID NO: 7163 - RNA, 38 nt, Artificial Sequence
  Description of Artificial Sequence:  Enzymatic Nucleic Acid
ugucccagcugaugaggccguuaggccgaaagcugacc

SEQ ID NO: 7164 - RNA, 38 nt, Artificial Sequence
  Description of Artificial Sequence:  Enzymatic Nucleic Acid
cacagcagcugaugaggccguuaggccgaaaccccggu

SEQ ID NO: 7165 - RNA, 38 nt, Artificial Sequence
  Description of Artificial Sequence:  Enzymatic Nucleic Acid
agacagcucugaugaggccguuaggccgaaagcagcgc

SEQ ID NO: 7166 - RNA, 38 nt, Artificial Sequence
  Description of Artificial Sequence:  Enzymatic Nucleic Acid
gagaagcacugaugaggccguuaggccgaaacagcuga

SEQ ID NO: 7167 - RNA, 38 nt, Artificial Sequence
  Description of Artificial Sequence:  Enzymatic Nucleic Acid
ccugugagcugaugaggccguuaggccgaaagcagaca

SEQ ID NO: 7168 - RNA, 38 nt, Artificial Sequence
  Description of Artificial Sequence:  Enzymatic Nucleic Acid
uccugugacugaugaggccguuaggccgaaaagcagac

SEQ ID NO: 7169 - RNA, 38 nt, Artificial Sequence
  Description of Artificial Sequence:  Enzymatic Nucleic Acid
gauccugucugaugaggccguuaggccgaaagaagcag

SEQ ID NO: 7170 - RNA, 38 nt, Artificial Sequence
  Description of Artificial Sequence:  Enzymatic Nucleic Acid
cugaacuacugaugaggccguuaggccgaaauccugug

SEQ ID NO: 7171 - RNA, 38 nt, Artificial Sequence
  Description of Artificial Sequence:  Enzymatic Nucleic Acid
accugaaccugaugaggccguuaggccgaaagauccug

SEQ ID NO: 7172 - RNA, 38 nt, Artificial Sequence
  Description of Artificial Sequence:  Enzymatic Nucleic Acid
ugaaccugcugaugaggccguuaggccgaaacuagauc

SEQ ID NO: 7173 - RNA, 38 nt, Artificial Sequence
  Description of Artificial Sequence:  Enzymatic Nucleic Acid
uugaaccucugaugaggccguuaggccgaaaacuagau

SEQ ID NO: 7174 - RNA, 38 nt, Artificial Sequence
  Description of Artificial Sequence:  Enzymatic Nucleic Acid
uaauuuugcugaugaggccguuaggccgaaaccugaac

SEQ ID NO: 7175 - RNA, 38 nt, Artificial Sequence
  Description of Artificial Sequence:  Enzymatic Nucleic Acid
uuaauuuucugaugaggccguuaggccgaaaaccugaa

SEQ ID NO: 7176 - RNA, 38 nt, Artificial Sequence
  Description of Artificial Sequence:  Enzymatic Nucleic Acid
gaucuuuucugaugaggccguuaggccgaaauuuugaa

SEQ ID NO: 7177 - RNA, 38 nt, Artificial Sequence
  Description of Artificial Sequence:  Enzymatic Nucleic Acid
ggaucuuucugaugaggccguuaggccgaaaauuuuga

SEQ ID NO: 7178 - RNA, 38 nt, Artificial Sequence
  Description of Artificial Sequence:  Enzymatic Nucleic Acid
caguucagcugaugaggccguuaggccgaaaucuuuua

SEQ ID NO: 7179 - RNA, 38 nt, Artificial Sequence
  Description of Artificial Sequence:  Enzymatic Nucleic Acid
gccuuuuacugaugaggccguuaggccgaaacucaguu

SEQ ID NO: 7180 - RNA, 38 nt, Artificial Sequence
  Description of Artificial Sequence:  Enzymatic Nucleic Acid
ugccuuuucugaugaggccguuaggccgaaaacucagu

SEQ ID NO: 7181 - RNA, 38 nt, Artificial Sequence
  Description of Artificial Sequence:  Enzymatic Nucleic Acid
gugccuuucugaugaggccguuaggccgaaaaacucag

SEQ ID NO: 7182 - RNA, 38 nt, Artificial Sequence
  Description of Artificial Sequence:  Enzymatic Nucleic Acid
gcuugcaucugaugaggccguuaggccgaaaugugcug

SEQ ID NO: 7183 - RNA, 38 nt, Artificial Sequence
  Description of Artificial Sequence:  Enzymatic Nucleic Acid
gcauuggacugaugaggccguuaggccgaaaugcagug

SEQ ID NO: 7184 - RNA, 38 nt, Artificial Sequence
  Description of Artificial Sequence:  Enzymatic Nucleic Acid
cugcauugcugaugaggccguuaggccgaaagaugcag

SEQ ID NO: 7185 - RNA, 38 nt, Artificial Sequence
  Description of Artificial Sequence:  Enzymatic Nucleic Acid
agaccauucugaugaggccguuaggccgaaaugggcug

SEQ ID NO: 7186 - RNA, 38 nt, Artificial Sequence
  Description of Artificial Sequence:  Enzymatic Nucleic Acid
caggcaaacugaugaggccguuaggccgaaaccauuua

SEQ ID NO: 7187 - RNA, 38 nt, Artificial Sequence
  Description of Artificial Sequence:  Enzymatic Nucleic Acid
uucaggcacugaugaggccguuaggccgaaagaccauu

SEQ ID NO: 7188 - RNA, 38 nt, Artificial Sequence
  Description of Artificial Sequence:  Enzymatic Nucleic Acid
uuucaggccugaugaggccguuaggccgaaaagaccau

SEQ ID NO: 7189 - RNA, 38 nt, Artificial Sequence
  Description of Artificial Sequence:  Enzymatic Nucleic Acid
gcuuuccucugaugaggccguuaggccgaaacucacca

SEQ ID NO: 7190 - RNA, 38 nt, Artificial Sequence
  Description of Artificial Sequence:  Enzymatic Nucleic Acid
gauuuagucugaugaggccguuaggccgaaaugcucag

SEQ ID NO: 7191 - RNA, 38 nt, Artificial Sequence
  Description of Artificial Sequence:  Enzymatic Nucleic Acid
ggcagauucugaugaggccguuaggccgaaaguuaugc

SEQ ID NO: 7192 - RNA, 38 nt, Artificial Sequence
  Description of Artificial Sequence:  Enzymatic Nucleic Acid
cacaggcacugaugaggccguuaggccgaaauuuaguu

SEQ ID NO: 7193 - RNA, 38 nt, Artificial Sequence
  Description of Artificial Sequence:  Enzymatic Nucleic Acid
uacugcagcugaugaggccguuaggccgaaauuguuug

SEQ ID NO: 7194 - RNA, 38 nt, Artificial Sequence
  Description of Artificial Sequence:  Enzymatic Nucleic Acid
guacugcacugaugaggccguuaggccgaaaauuguuu

SEQ ID NO: 7195 - RNA, 38 nt, Artificial Sequence
  Description of Artificial Sequence:  Enzymatic Nucleic Acid
gguuaaagcugaugaggccguuaggccgaaacugcaga

SEQ ID NO: 7196 - RNA, 38 nt, Artificial Sequence
  Description of Artificial Sequence:  Enzymatic Nucleic Acid
caagguuacugaugaggccguuaggccgaaaguacugc

SEQ ID NO: 7197 - RNA, 38 nt, Artificial Sequence
  Description of Artificial Sequence:  Enzymatic Nucleic Acid
ucaagguucugaugaggccguuaggccgaaaaguacug

SEQ ID NO: 7198 - RNA, 38 nt, Artificial Sequence
  Description of Artificial Sequence:  Enzymatic Nucleic Acid
uucaaggucugaugaggccguuaggccgaaaaaguacu

SEQ ID NO: 7199 - RNA, 38 nt, Artificial Sequence
  Description of Artificial Sequence:  Enzymatic Nucleic Acid
cuguguuccugaugaggccguuaggccgaaagguuaaa

SEQ ID NO: 7200 - RNA, 38 nt, Artificial Sequence
  Description of Artificial Sequence:  Enzymatic Nucleic Acid
guuugcuucugaugaggccguuaggccgaaagcugugu

SEQ ID NO: 7201 - RNA, 38 nt, Artificial Sequence
  Description of Artificial Sequence:  Enzymatic Nucleic Acid
agcuguagcugaugaggccguuaggccgaaagccagug

SEQ ID NO: 7202 - RNA, 38 nt, Artificial Sequence
  Description of Artificial Sequence:  Enzymatic Nucleic Acid
cagcuguacugaugaggccguuaggccgaaaagccagu

SEQ ID NO: 7203 - RNA, 38 nt, Artificial Sequence
  Description of Artificial Sequence:  Enzymatic Nucleic Acid
ugcagcugcugaugaggccguuaggccgaaagaagcca

SEQ ID NO: 7204 - RNA, 38 nt, Artificial Sequence
  Description of Artificial Sequence:  Enzymatic Nucleic Acid
cagcuagacugaugaggccguuaggccgaaauuugcag

SEQ ID NO: 7205 - RNA, 38 nt, Artificial Sequence
  Description of Artificial Sequence:  Enzymatic Nucleic Acid
uacagcuacugaugaggccguuaggccgaaauauuugc

SEQ ID NO: 7206 - RNA, 38 nt, Artificial Sequence
  Description of Artificial Sequence:  Enzymatic Nucleic Acid
gguacagccugaugaggccguuaggccgaaagauauuu

SEQ ID NO: 7207 - RNA, 38 nt, Artificial Sequence
  Description of Artificial Sequence:  Enzymatic Nucleic Acid
gaaguaggcugaugaggccguuaggccgaaacagcuag

SEQ ID NO: 7208 - RNA, 38 nt, Artificial Sequence
  Description of Artificial Sequence:  Enzymatic Nucleic Acid
cuuugaagcugaugaggccguuaggccgaaagguacag

SEQ ID NO: 7209 - RNA, 38 nt, Artificial Sequence
  Description of Artificial Sequence:  Enzymatic Nucleic Acid
cuucuuugcugaugaggccguuaggccgaaaguaggua

SEQ ID NO: 7210 - RNA, 38 nt, Artificial Sequence
  Description of Artificial Sequence:  Enzymatic Nucleic Acid
ucuucuuucugaugaggccguuaggccgaaaaguaggu

SEQ ID NO: 7211 - RNA, 38 nt, Artificial Sequence
  Description of Artificial Sequence:  Enzymatic Nucleic Acid
agauugcacugaugaggccguuaggccgaaauucuguu

SEQ ID NO: 7212 - RNA, 38 nt, Artificial Sequence
  Description of Artificial Sequence:  Enzymatic Nucleic Acid
aauauauacugaugaggccguuaggccgaaauugcaga

SEQ ID NO: 7213 - RNA, 38 nt, Artificial Sequence
  Description of Artificial Sequence:  Enzymatic Nucleic Acid
uaaauauacugaugaggccguuaggccgaaagauugca

SEQ ID NO: 7214 - RNA, 38 nt, Artificial Sequence
  Description of Artificial Sequence:  Enzymatic Nucleic Acid
aauaaauacugaugaggccguuaggccgaaauagauug

SEQ ID NO: 7215 - RNA, 38 nt, Artificial Sequence
  Description of Artificial Sequence:  Enzymatic Nucleic Acid
cuaauaaacugaugaggccguuaggccgaaauauagau

SEQ ID NO: 7216 - RNA, 38 nt, Artificial Sequence
  Description of Artificial Sequence:  Enzymatic Nucleic Acid
cacuaauacugaugaggccguuaggccgaaauauauag

SEQ ID NO: 7217 - RNA, 38 nt, Artificial Sequence
  Description of Artificial Sequence:  Enzymatic Nucleic Acid
ucacuaaucugaugaggccguuaggccgaaaauauaua

SEQ ID NO: 7218 - RNA, 38 nt, Artificial Sequence
  Description of Artificial Sequence:  Enzymatic Nucleic Acid
aucacuaacugaugaggccguuaggccgaaaaauauau

SEQ ID NO: 7219 - RNA, 38 nt, Artificial Sequence
  Description of Artificial Sequence:  Enzymatic Nucleic Acid
guaucacucugaugaggccguuaggccgaaauaaauau

SEQ ID NO: 7220 - RNA, 38 nt, Artificial Sequence
  Description of Artificial Sequence:  Enzymatic Nucleic Acid
uguaucaccugaugaggccguuaggccgaaaauaaaua

SEQ ID NO: 7221 - RNA, 38 nt, Artificial Sequence
  Description of Artificial Sequence:  Enzymatic Nucleic Acid
ucuaccugcugaugaggccguuaggccgaaaucacuaa

SEQ ID NO: 7222 - RNA, 38 nt, Artificial Sequence
  Description of Artificial Sequence:  Enzymatic Nucleic Acid
gaaagguccugaugaggccguuaggccgaaaccuguau

SEQ ID NO: 7223 - RNA, 38 nt, Artificial Sequence
  Description of Artificial Sequence:  Enzymatic Nucleic Acid
cucuacgacugaugaggccguuaggccgaaaggucuac

SEQ ID NO: 7224 - RNA, 38 nt, Artificial Sequence
  Description of Artificial Sequence:  Enzymatic Nucleic Acid
ucucuacgcugaugaggccguuaggccgaaaaggucua

SEQ ID NO: 7225 - RNA, 38 nt, Artificial Sequence
  Description of Artificial Sequence:  Enzymatic Nucleic Acid
aucucuaccugaugaggccguuaggccgaaaaaggucu

SEQ ID NO: 7226 - RNA, 38 nt, Artificial Sequence
  Description of Artificial Sequence:  Enzymatic Nucleic Acid
uacaucuccugaugaggccguuaggccgaaacgaaagg

SEQ ID NO: 7227 - RNA, 38 nt, Artificial Sequence
  Description of Artificial Sequence:  Enzymatic Nucleic Acid
uuucacugcugaugaggccguuaggccgaaacaucucu

SEQ ID NO: 7228 - RNA, 38 nt, Artificial Sequence
  Description of Artificial Sequence:  Enzymatic Nucleic Acid
auuucgggcugaugaggccguuaggccgaaauuucacu

SEQ ID NO: 7229 - RNA, 38 nt, Artificial Sequence
  Description of Artificial Sequence:  Enzymatic Nucleic Acid
auguguaucugaugaggccguuaggccgaaauuucggg

SEQ ID NO: 7230 - RNA, 38 nt, Artificial Sequence
  Description of Artificial Sequence:  Enzymatic Nucleic Acid
cauguguacugaugaggccguuaggccgaaaauuucgg

SEQ ID NO: 7231 - RNA, 38 nt, Artificial Sequence
  Description of Artificial Sequence:  Enzymatic Nucleic Acid
gucaugugcugaugaggccguuaggccgaaauaauuuc

SEQ ID NO: 7232 - RNA, 38 nt, Artificial Sequence
  Description of Artificial Sequence:  Enzymatic Nucleic Acid
ggaaugaccugaugaggccguuaggccgaaagcucccu

SEQ ID NO: 7233 - RNA, 38 nt, Artificial Sequence
  Description of Artificial Sequence:  Enzymatic Nucleic Acid
cagggaaucugaugaggccguuaggccgaaacgagcuc

SEQ ID NO: 7234 - RNA, 38 nt, Artificial Sequence
  Description of Artificial Sequence:  Enzymatic Nucleic Acid
cggcagggcugaugaggccguuaggccgaaaugacgag

SEQ ID NO: 7235 - RNA, 38 nt, Artificial Sequence
  Description of Artificial Sequence:  Enzymatic Nucleic Acid
ccggcaggcugaugaggccguuaggccgaaaaugacga

SEQ ID NO: 7236 - RNA, 38 nt, Artificial Sequence
  Description of Artificial Sequence:  Enzymatic Nucleic Acid
ggugacgucugaugaggccguuaggccgaaacccggca

SEQ ID NO: 7237 - RNA, 38 nt, Artificial Sequence
  Description of Artificial Sequence:  Enzymatic Nucleic Acid
aggugacgcugaugaggccguuaggccgaaaacccggc

SEQ ID NO: 7238 - RNA, 38 nt, Artificial Sequence
  Description of Artificial Sequence:  Enzymatic Nucleic Acid
uguuaggucugaugaggccguuaggccgaaacguaacc

SEQ ID NO: 7239 - RNA, 38 nt, Artificial Sequence
  Description of Artificial Sequence:  Enzymatic Nucleic Acid
agugaugucugaugaggccguuaggccgaaaggugacg

SEQ ID NO: 7240 - RNA, 38 nt, Artificial Sequence
  Description of Artificial Sequence:  Enzymatic Nucleic Acid
guaacagucugaugaggccguuaggccgaaauguuagg

SEQ ID NO: 7241 - RNA, 38 nt, Artificial Sequence
  Description of Artificial Sequence:  Enzymatic Nucleic Acid
uuuaaagucugaugaggccguuaggccgaaacagugau

SEQ ID NO: 7242 - RNA, 38 nt, Artificial Sequence
  Description of Artificial Sequence:  Enzymatic Nucleic Acid
uuuuaaagcugaugaggccguuaggccgaaaacaguga

SEQ ID NO: 7243 - RNA, 38 nt, Artificial Sequence
  Description of Artificial Sequence:  Enzymatic Nucleic Acid
cuuuuuuacugaugaggccguuaggccgaaaguaacag

SEQ ID NO: 7244 - RNA, 38 nt, Artificial Sequence
  Description of Artificial Sequence:  Enzymatic Nucleic Acid
acuuuuuucugaugaggccguuaggccgaaaaguaaca

SEQ ID NO: 7245 - RNA, 38 nt, Artificial Sequence
  Description of Artificial Sequence:  Enzymatic Nucleic Acid
aacuuuuucugaugaggccguuaggccgaaaaaguaac

SEQ ID NO: 7246 - RNA, 38 nt, Artificial Sequence
  Description of Artificial Sequence:  Enzymatic Nucleic Acid
caaguggacugaugaggccguuaggccgaaacuuuuuu

SEQ ID NO: 7247 - RNA, 38 nt, Artificial Sequence
  Description of Artificial Sequence:  Enzymatic Nucleic Acid
ucaaguggcugaugaggccguuaggccgaaaacuuuuu

SEQ ID NO: 7248 - RNA, 38 nt, Artificial Sequence
  Description of Artificial Sequence:  Enzymatic Nucleic Acid
gucaagugcugaugaggccguuaggccgaaaaacuuuu

SEQ ID NO: 7249 - RNA, 38 nt, Artificial Sequence
  Description of Artificial Sequence:  Enzymatic Nucleic Acid
aaaguguccugaugaggccguuaggccgaaaguggaaa

SEQ ID NO: 7250 - RNA, 38 nt, Artificial Sequence
  Description of Artificial Sequence:  Enzymatic Nucleic Acid
agggaucacugaugaggccguuaggccgaaagugucaa

SEQ ID NO: 7251 - RNA, 38 nt, Artificial Sequence
  Description of Artificial Sequence:  Enzymatic Nucleic Acid
cagggauccugaugaggccguuaggccgaaaaguguca

SEQ ID NO: 7252 - RNA, 38 nt, Artificial Sequence
  Description of Artificial Sequence:  Enzymatic Nucleic Acid
ccaucaggcugaugaggccguuaggccgaaaucaaagu

SEQ ID NO: 7253 - RNA, 38 nt, Artificial Sequence
  Description of Artificial Sequence:  Enzymatic Nucleic Acid
ucccagaucugaugaggccguuaggccgaaaugcguuu

SEQ ID NO: 7254 - RNA, 38 nt, Artificial Sequence
  Description of Artificial Sequence:  Enzymatic Nucleic Acid
cugucccacugaugaggccguuaggccgaaauuaugcg

SEQ ID NO: 7255 - RNA, 38 nt, Artificial Sequence
  Description of Artificial Sequence:  Enzymatic Nucleic Acid
gcccuuuccugaugaggccguuaggccgaaacuguccc

SEQ ID NO: 7256 - RNA, 38 nt, Artificial Sequence
  Description of Artificial Sequence:  Enzymatic Nucleic Acid
auaugaugcugaugaggccguuaggccgaaagcccuuu

SEQ ID NO: 7257 - RNA, 38 nt, Artificial Sequence
  Description of Artificial Sequence:  Enzymatic Nucleic Acid
gauaugaucugaugaggccguuaggccgaaaagcccuu

SEQ ID NO: 7258 - RNA, 38 nt, Artificial Sequence
  Description of Artificial Sequence:  Enzymatic Nucleic Acid
uuugauaucugaugaggccguuaggccgaaaugaagcc

SEQ ID NO: 7259 - RNA, 38 nt, Artificial Sequence
  Description of Artificial Sequence:  Enzymatic Nucleic Acid
gcauuugacugaugaggccguuaggccgaaaugaugaa

SEQ ID NO: 7260 - RNA, 38 nt, Artificial Sequence
  Description of Artificial Sequence:  Enzymatic Nucleic Acid
uugcauuucugaugaggccguuaggccgaaauaugaug

SEQ ID NO: 7261 - RNA, 38 nt, Artificial Sequence
  Description of Artificial Sequence:  Enzymatic Nucleic Acid
uuucuuugcugaugaggccguuaggccgaaacguugca

SEQ ID NO: 7262 - RNA, 38 nt, Artificial Sequence
  Description of Artificial Sequence:  Enzymatic Nucleic Acid
agaagccccugaugaggccguuaggccgaaauuucuuu

SEQ ID NO: 7263 - RNA, 38 nt, Artificial Sequence
  Description of Artificial Sequence:  Enzymatic Nucleic Acid
caggucagcugaugaggccguuaggccgaaagcccuau

SEQ ID NO: 7264 - RNA, 38 nt, Artificial Sequence
  Description of Artificial Sequence:  Enzymatic Nucleic Acid
acaggucacugaugaggccguuaggccgaaaagcccua

SEQ ID NO: 7265 - RNA, 38 nt, Artificial Sequence
  Description of Artificial Sequence:  Enzymatic Nucleic Acid
ugcccauucugaugaggccguuaggccgaaacuguugc

SEQ ID NO: 7266 - RNA, 38 nt, Artificial Sequence
  Description of Artificial Sequence:  Enzymatic Nucleic Acid
cuuauacacugaugaggccguuaggccgaaaugcccau

SEQ ID NO: 7267 - RNA, 38 nt, Artificial Sequence
  Description of Artificial Sequence:  Enzymatic Nucleic Acid
ucuuauaccugaugaggccguuaggccgaaaaugccca

SEQ ID NO: 7268 - RNA, 38 nt, Artificial Sequence
  Description of Artificial Sequence:  Enzymatic Nucleic Acid
uugucuuacugaugaggccguuaggccgaaacaaaugc

SEQ ID NO: 7269 - RNA, 38 nt, Artificial Sequence
  Description of Artificial Sequence:  Enzymatic Nucleic Acid
guuugucucugaugaggccguuaggccgaaauacaaau

SEQ ID NO: 7270 - RNA, 38 nt, Artificial Sequence
  Description of Artificial Sequence:  Enzymatic Nucleic Acid
gugugagacugaugaggccguuaggccgaaaguuuguc

SEQ ID NO: 7271 - RNA, 38 nt, Artificial Sequence
  Description of Artificial Sequence:  Enzymatic Nucleic Acid
augugugacugaugaggccguuaggccgaaauaguuug

SEQ ID NO: 7272 - RNA, 38 nt, Artificial Sequence
  Description of Artificial Sequence:  Enzymatic Nucleic Acid
cgaugugucugaugaggccguuaggccgaaagauaguu

SEQ ID NO: 7273 - RNA, 38 nt, Artificial Sequence
  Description of Artificial Sequence:  Enzymatic Nucleic Acid
gguuuguccugaugaggccguuaggccgaaauguguga

SEQ ID NO: 7274 - RNA, 38 nt, Artificial Sequence
  Description of Artificial Sequence:  Enzymatic Nucleic Acid
uaugauugcugaugaggccguuaggccgaaauugguuu

SEQ ID NO: 7275 - RNA, 38 nt, Artificial Sequence
  Description of Artificial Sequence:  Enzymatic Nucleic Acid
acaucuaucugaugaggccguuaggccgaaauuguauu

SEQ ID NO: 7276 - RNA, 38 nt, Artificial Sequence
  Description of Artificial Sequence:  Enzymatic Nucleic Acid
uggacauccugaugaggccguuaggccgaaaugauugu

SEQ ID NO: 7277 - RNA, 38 nt, Artificial Sequence
  Description of Artificial Sequence:  Enzymatic Nucleic Acid
cuuauuugcugaugaggccguuaggccgaaacaucuau

SEQ ID NO: 7278 - RNA, 38 nt, Artificial Sequence
  Description of Artificial Sequence:  Enzymatic Nucleic Acid
ggugugcucugaugaggccguuaggccgaaauuuggac

SEQ ID NO: 7279 - RNA, 38 nt, Artificial Sequence
  Description of Artificial Sequence:  Enzymatic Nucleic Acid
aguaauuucugaugaggccguuaggccgaaacugggcg

SEQ ID NO: 7280 - RNA, 38 nt, Artificial Sequence
  Description of Artificial Sequence:  Enzymatic Nucleic Acid
cucuaagucugaugaggccguuaggccgaaauuugacu

SEQ ID NO: 7281 - RNA, 38 nt, Artificial Sequence
  Description of Artificial Sequence:  Enzymatic Nucleic Acid
ccucuaagcugaugaggccguuaggccgaaaauuugac

SEQ ID NO: 7282 - RNA, 38 nt, Artificial Sequence
  Description of Artificial Sequence:  Enzymatic Nucleic Acid
uggccucucugaugaggccguuaggccgaaaguaauuu

SEQ ID NO: 7283 - RNA, 38 nt, Artificial Sequence
  Description of Artificial Sequence:  Enzymatic Nucleic Acid
auggccuccugaugaggccguuaggccgaaaaguaauu

SEQ ID NO: 7284 - RNA, 38 nt, Artificial Sequence
  Description of Artificial Sequence:  Enzymatic Nucleic Acid
gacaagagcugaugaggccguuaggccgaaauggccuc

SEQ ID NO: 7285 - RNA, 38 nt, Artificial Sequence
  Description of Artificial Sequence:  Enzymatic Nucleic Acid
gaggacaacugaugaggccguuaggccgaaaguauggc

SEQ ID NO: 7286 - RNA, 38 nt, Artificial Sequence
  Description of Artificial Sequence:  Enzymatic Nucleic Acid
uugaggaccugaugaggccguuaggccgaaagaguaug

SEQ ID NO: 7287 - RNA, 38 nt, Artificial Sequence
  Description of Artificial Sequence:  Enzymatic Nucleic Acid
caauugagcugaugaggccguuaggccgaaacaagagu

SEQ ID NO: 7288 - RNA, 38 nt, Artificial Sequence
  Description of Artificial Sequence:  Enzymatic Nucleic Acid
guacaauucugaugaggccguuaggccgaaaggacaag

SEQ ID NO: 7289 - RNA, 38 nt, Artificial Sequence
  Description of Artificial Sequence:  Enzymatic Nucleic Acid
agcaguaccugaugaggccguuaggccgaaauugagga

SEQ ID NO: 7290 - RNA, 38 nt, Artificial Sequence
  Description of Artificial Sequence:  Enzymatic Nucleic Acid
gguagcagcugaugaggccguuaggccgaaacaauuga

SEQ ID NO: 7291 - RNA, 38 nt, Artificial Sequence
  Description of Artificial Sequence:  Enzymatic Nucleic Acid
gggaguggcugaugaggccguuaggccgaaagcaguac

SEQ ID NO: 7292 - RNA, 38 nt, Artificial Sequence
  Description of Artificial Sequence:  Enzymatic Nucleic Acid
guucaaggcugaugaggccguuaggccgaaagugguag

SEQ ID NO: 7293 - RNA, 38 nt, Artificial Sequence
  Description of Artificial Sequence:  Enzymatic Nucleic Acid
ucguguuccugaugaggccguuaggccgaaagggagug

SEQ ID NO: 7294 - RNA, 38 nt, Artificial Sequence
  Description of Artificial Sequence:  Enzymatic Nucleic Acid
gucauuugcugaugaggccguuaggccgaaacucucgu

SEQ ID NO: 7295 - RNA, 38 nt, Artificial Sequence
  Description of Artificial Sequence:  Enzymatic Nucleic Acid
ggucauuucugaugaggccguuaggccgaaaacucucg

SEQ ID NO: 7296 - RNA, 38 nt, Artificial Sequence
  Description of Artificial Sequence:  Enzymatic Nucleic Acid
aucagggucugaugaggccguuaggccgaaacuccagg

SEQ ID NO: 7297 - RNA, 38 nt, Artificial Sequence
  Description of Artificial Sequence:  Enzymatic Nucleic Acid
caucagggcugaugaggccguuaggccgaaaacuccag

SEQ ID NO: 7298 - RNA, 38 nt, Artificial Sequence
  Description of Artificial Sequence:  Enzymatic Nucleic Acid
agcucucucugaugaggccguuaggccgaaauuuuuuu

SEQ ID NO: 7299 - RNA, 38 nt, Artificial Sequence
  Description of Artificial Sequence:  Enzymatic Nucleic Acid
ccuuacggcugaugaggccguuaggccgaaagcucucu

SEQ ID NO: 7300 - RNA, 38 nt, Artificial Sequence
  Description of Artificial Sequence:  Enzymatic Nucleic Acid
gccuuacgcugaugaggccguuaggccgaaaagcucuc

SEQ ID NO: 7301 - RNA, 38 nt, Artificial Sequence
  Description of Artificial Sequence:  Enzymatic Nucleic Acid
cgucgccucugaugaggccguuaggccgaaacggaagc

SEQ ID NO: 7302 - RNA, 38 nt, Artificial Sequence
  Description of Artificial Sequence:  Enzymatic Nucleic Acid
cuuugguccugaugaggccguuaggccgaaauucgucg

SEQ ID NO: 7303 - RNA, 38 nt, Artificial Sequence
  Description of Artificial Sequence:  Enzymatic Nucleic Acid
ggcaugggcugaugaggccguuaggccgaaauugcuuu

SEQ ID NO: 7304 - RNA, 38 nt, Artificial Sequence
  Description of Artificial Sequence:  Enzymatic Nucleic Acid
uggcauggcugaugaggccguuaggccgaaaauugcuu

SEQ ID NO: 7305 - RNA, 38 nt, Artificial Sequence
  Description of Artificial Sequence:  Enzymatic Nucleic Acid
cuguagaacugaugaggccguuaggccgaaauguuggc

SEQ ID NO: 7306 - RNA, 38 nt, Artificial Sequence
  Description of Artificial Sequence:  Enzymatic Nucleic Acid
cacuguagcugaugaggccguuaggccgaaauauguug

SEQ ID NO: 7307 - RNA, 38 nt, Artificial Sequence
  Description of Artificial Sequence:  Enzymatic Nucleic Acid
acacuguacugaugaggccguuaggccgaaaauauguu

SEQ ID NO: 7308 - RNA, 38 nt, Artificial Sequence
  Description of Artificial Sequence:  Enzymatic Nucleic Acid
gaacacugcugaugaggccguuaggccgaaagaauaug

SEQ ID NO: 7309 - RNA, 38 nt, Artificial Sequence
  Description of Artificial Sequence:  Enzymatic Nucleic Acid
auaguaagcugaugaggccguuaggccgaaacacugua

SEQ ID NO: 7310 - RNA, 38 nt, Artificial Sequence
  Description of Artificial Sequence:  Enzymatic Nucleic Acid
aauaguaacugaugaggccguuaggccgaaaacacugu

SEQ ID NO: 7311 - RNA, 38 nt, Artificial Sequence
  Description of Artificial Sequence:  Enzymatic Nucleic Acid
ucaauagucugaugaggccguuaggccgaaagaacacu

SEQ ID NO: 7312 - RNA, 38 nt, Artificial Sequence
  Description of Artificial Sequence:  Enzymatic Nucleic Acid
gucaauagcugaugaggccguuaggccgaaaagaacac

SEQ ID NO: 7313 - RNA, 38 nt, Artificial Sequence
  Description of Artificial Sequence:  Enzymatic Nucleic Acid
uuugucaacugaugaggccguuaggccgaaaguaagaa

SEQ ID NO: 7314 - RNA, 38 nt, Artificial Sequence
  Description of Artificial Sequence:  Enzymatic Nucleic Acid
auuuuguccugaugaggccguuaggccgaaauaguaag

SEQ ID NO: 7315 - RNA, 38 nt, Artificial Sequence
  Description of Artificial Sequence:  Enzymatic Nucleic Acid
caaguauacugaugaggccguuaggccgaaaguccuuu

SEQ ID NO: 7316 - RNA, 38 nt, Artificial Sequence
  Description of Artificial Sequence:  Enzymatic Nucleic Acid
acaaguaucugaugaggccguuaggccgaaaaguccuu

SEQ ID NO: 7317 - RNA, 38 nt, Artificial Sequence
  Description of Artificial Sequence:  Enzymatic Nucleic Acid
gacaaguacugaugaggccguuaggccgaaaaaguccu

SEQ ID NO: 7318 - RNA, 38 nt, Artificial Sequence
  Description of Artificial Sequence:  Enzymatic Nucleic Acid
acgacaagcugaugaggccguuaggccgaaauaaaguc

SEQ ID NO: 7319 - RNA, 38 nt, Artificial Sequence
  Description of Artificial Sequence:  Enzymatic Nucleic Acid
uacacgaccugaugaggccguuaggccgaaaguauaaa

SEQ ID NO: 7320 - RNA, 38 nt, Artificial Sequence
  Description of Artificial Sequence:  Enzymatic Nucleic Acid
ccuuacaccugaugaggccguuaggccgaaacaaguau

SEQ ID NO: 7321 - RNA, 38 nt, Artificial Sequence
  Description of Artificial Sequence:  Enzymatic Nucleic Acid
ccacuccucugaugaggccguuaggccgaaacacgaca

SEQ ID NO: 7322 - RNA, 38 nt, Artificial Sequence
  Description of Artificial Sequence:  Enzymatic Nucleic Acid
auuugaaucugaugaggccguuaggccgaaauggucca

SEQ ID NO: 7323 - RNA, 38 nt, Artificial Sequence
  Description of Artificial Sequence:  Enzymatic Nucleic Acid
cagauuugcugaugaggccguuaggccgaaaugauggu

SEQ ID NO: 7324 - RNA, 38 nt, Artificial Sequence
  Description of Artificial Sequence:  Enzymatic Nucleic Acid
acagauuucugaugaggccguuaggccgaaaaugaugg

SEQ ID NO: 7325 - RNA, 38 nt, Artificial Sequence
  Description of Artificial Sequence:  Enzymatic Nucleic Acid
uguuaacacugaugaggccguuaggccgaaauuugaau

SEQ ID NO: 7326 - RNA, 38 nt, Artificial Sequence
  Description of Artificial Sequence:  Enzymatic Nucleic Acid
gagguguucugaugaggccguuaggccgaaacagauuu

SEQ ID NO: 7327 - RNA, 38 nt, Artificial Sequence
  Description of Artificial Sequence:  Enzymatic Nucleic Acid
ugaggugucugaugaggccguuaggccgaaaacagauu

SEQ ID NO: 7328 - RNA, 38 nt, Artificial Sequence
  Description of Artificial Sequence:  Enzymatic Nucleic Acid
uaugcacucugaugaggccguuaggccgaaagguguua

SEQ ID NO: 7329 - RNA, 38 nt, Artificial Sequence
  Description of Artificial Sequence:  Enzymatic Nucleic Acid
aucauauacugaugaggccguuaggccgaaaugcacug

SEQ ID NO: 7330 - RNA, 38 nt, Artificial Sequence
  Description of Artificial Sequence:  Enzymatic Nucleic Acid
uuaucauacugaugaggccguuaggccgaaauaugcac

SEQ ID NO: 7331 - RNA, 38 nt, Artificial Sequence
  Description of Artificial Sequence:  Enzymatic Nucleic Acid
cuuuaucacugaugaggccguuaggccgaaauauaugc

SEQ ID NO: 7332 - RNA, 38 nt, Artificial Sequence
  Description of Artificial Sequence:  Enzymatic Nucleic Acid
gaaugcuucugaugaggccguuaggccgaaaucauaua

SEQ ID NO: 7333 - RNA, 38 nt, Artificial Sequence
  Description of Artificial Sequence:  Enzymatic Nucleic Acid
cagugaugcugaugaggccguuaggccgaaaugcuuua

SEQ ID NO: 7334 - RNA, 38 nt, Artificial Sequence
  Description of Artificial Sequence:  Enzymatic Nucleic Acid
acagugaucugaugaggccguuaggccgaaaaugcuuu

SEQ ID NO: 7335 - RNA, 38 nt, Artificial Sequence
  Description of Artificial Sequence:  Enzymatic Nucleic Acid
uucacagucugaugaggccguuaggccgaaaugaaugc

SEQ ID NO: 7336 - RNA, 38 nt, Artificial Sequence
  Description of Artificial Sequence:  Enzymatic Nucleic Acid
cuguuuuccugaugaggccguuaggccgaaauguuuca

SEQ ID NO: 7337 - RNA, 38 nt, Artificial Sequence
  Description of Artificial Sequence:  Enzymatic Nucleic Acid
acgguuuccugaugaggccguuaggccgaaagcaccug

SEQ ID NO: 7338 - RNA, 38 nt, Artificial Sequence
  Description of Artificial Sequence:  Enzymatic Nucleic Acid
uugccagccugaugaggccguuaggccgaaacgguuuc

SEQ ID NO: 7339 - RNA, 38 nt, Artificial Sequence
  Description of Artificial Sequence:  Enzymatic Nucleic Acid
gccgguaacugaugaggccguuaggccgaaaccgcuug

SEQ ID NO: 7340 - RNA, 38 nt, Artificial Sequence
  Description of Artificial Sequence:  Enzymatic Nucleic Acid
gagccggucugaugaggccguuaggccgaaagaccgcu

SEQ ID NO: 7341 - RNA, 38 nt, Artificial Sequence
  Description of Artificial Sequence:  Enzymatic Nucleic Acid
agagccggcugaugaggccguuaggccgaaaagaccgc

SEQ ID NO: 7342 - RNA, 38 nt, Artificial Sequence
  Description of Artificial Sequence:  Enzymatic Nucleic Acid
uucauagacugaugaggccguuaggccgaaagccggua

SEQ ID NO: 7343 - RNA, 38 nt, Artificial Sequence
  Description of Artificial Sequence:  Enzymatic Nucleic Acid
cuuucauacugaugaggccguuaggccgaaagagccgg

SEQ ID NO: 7344 - RNA, 38 nt, Artificial Sequence
  Description of Artificial Sequence:  Enzymatic Nucleic Acid
cacuuucacugaugaggccguuaggccgaaagagagcc

SEQ ID NO: 7345 - RNA, 38 nt, Artificial Sequence
  Description of Artificial Sequence:  Enzymatic Nucleic Acid
gcgagggacugaugaggccguuaggccgaaaugccuuc

SEQ ID NO: 7346 - RNA, 38 nt, Artificial Sequence
  Description of Artificial Sequence:  Enzymatic Nucleic Acid
ggcgagggcugaugaggccguuaggccgaaaaugccuu

SEQ ID NO: 7347 - RNA, 38 nt, Artificial Sequence
  Description of Artificial Sequence:  Enzymatic Nucleic Acid
cggcgaggcugaugaggccguuaggccgaaaaaugccu

SEQ ID NO: 7348 - RNA, 38 nt, Artificial Sequence
  Description of Artificial Sequence:  Enzymatic Nucleic Acid
cuuccggccugaugaggccguuaggccgaaagggaaau

SEQ ID NO: 7349 - RNA, 38 nt, Artificial Sequence
  Description of Artificial Sequence:  Enzymatic Nucleic Acid
aaccauaccugaugaggccguuaggccgaaacuuccgg

SEQ ID NO: 7350 - RNA, 38 nt, Artificial Sequence
  Description of Artificial Sequence:  Enzymatic Nucleic Acid
uuuaaccacugaugaggccguuaggccgaaacaacuuc

SEQ ID NO: 7351 - RNA, 38 nt, Artificial Sequence
  Description of Artificial Sequence:  Enzymatic Nucleic Acid
caucuuuucugaugaggccguuaggccgaaaccauaca

SEQ ID NO: 7352 - RNA, 38 nt, Artificial Sequence
  Description of Artificial Sequence:  Enzymatic Nucleic Acid
ccaucuuucugaugaggccguuaggccgaaaaccauac

SEQ ID NO: 7353 - RNA, 38 nt, Artificial Sequence
  Description of Artificial Sequence:  Enzymatic Nucleic Acid
ucgcaggucugaugaggccguuaggccgaaacccaucu

SEQ ID NO: 7354 - RNA, 38 nt, Artificial Sequence
  Description of Artificial Sequence:  Enzymatic Nucleic Acid
gucgcaggcugaugaggccguuaggccgaaaacccauc

SEQ ID NO: 7355 - RNA, 38 nt, Artificial Sequence
  Description of Artificial Sequence:  Enzymatic Nucleic Acid
agcgagcacugaugaggccguuaggccgaaauuucuca

SEQ ID NO: 7356 - RNA, 38 nt, Artificial Sequence
  Description of Artificial Sequence:  Enzymatic Nucleic Acid
caaauagccugaugaggccguuaggccgaaagcagauu

SEQ ID NO: 7357 - RNA, 38 nt, Artificial Sequence
  Description of Artificial Sequence:  Enzymatic Nucleic Acid
gagucaaacugaugaggccguuaggccgaaagcgagca

SEQ ID NO: 7358 - RNA, 38 nt, Artificial Sequence
  Description of Artificial Sequence:  Enzymatic Nucleic Acid
acgagucacugaugaggccguuaggccgaaauagcgag

SEQ ID NO: 7359 - RNA, 38 nt, Artificial Sequence
  Description of Artificial Sequence:  Enzymatic Nucleic Acid
cacgaguccugaugaggccguuaggccgaaaauagcga

SEQ ID NO: 7360 - RNA, 38 nt, Artificial Sequence
  Description of Artificial Sequence:  Enzymatic Nucleic Acid
guagccaccugaugaggccguuaggccgaaagucaaau

SEQ ID NO: 7361 - RNA, 38 nt, Artificial Sequence
  Description of Artificial Sequence:  Enzymatic Nucleic Acid
uuaacgagcugaugaggccguuaggccgaaagccacga

SEQ ID NO: 7362 - RNA, 38 nt, Artificial Sequence
  Description of Artificial Sequence:  Enzymatic Nucleic Acid
uaauuaaccugaugaggccguuaggccgaaaguagcca

SEQ ID NO: 7363 - RNA, 38 nt, Artificial Sequence
  Description of Artificial Sequence:  Enzymatic Nucleic Acid
ugauaauucugaugaggccguuaggccgaaacgaguag

SEQ ID NO: 7364 - RNA, 38 nt, Artificial Sequence
  Description of Artificial Sequence:  Enzymatic Nucleic Acid
uugauaaucugaugaggccguuaggccgaaaacgagua

SEQ ID NO: 7365 - RNA, 38 nt, Artificial Sequence
  Description of Artificial Sequence:  Enzymatic Nucleic Acid
uccuugaucugaugaggccguuaggccgaaauuaacga

SEQ ID NO: 7366 - RNA, 38 nt, Artificial Sequence
  Description of Artificial Sequence:  Enzymatic Nucleic Acid
guccuugacugaugaggccguuaggccgaaaauuaacg

SEQ ID NO: 7367 - RNA, 38 nt, Artificial Sequence
  Description of Artificial Sequence:  Enzymatic Nucleic Acid
acguccuucugaugaggccguuaggccgaaauaauuaa

SEQ ID NO: 7368 - RNA, 38 nt, Artificial Sequence
  Description of Artificial Sequence:  Enzymatic Nucleic Acid
ucuucagucugaugaggccguuaggccgaaacguccuu

SEQ ID NO: 7369 - RNA, 38 nt, Artificial Sequence
  Description of Artificial Sequence:  Enzymatic Nucleic Acid
gauuguaucugaugaggccguuaggccgaaauucccug

SEQ ID NO: 7370 - RNA, 38 nt, Artificial Sequence
  Description of Artificial Sequence:  Enzymatic Nucleic Acid
agauuguacugaugaggccguuaggccgaaaauucccu

SEQ ID NO: 7371 - RNA, 38 nt, Artificial Sequence
  Description of Artificial Sequence:  Enzymatic Nucleic Acid
caagauugcugaugaggccguuaggccgaaauaauucc

SEQ ID NO: 7372 - RNA, 38 nt, Artificial Sequence
  Description of Artificial Sequence:  Enzymatic Nucleic Acid
cucagcaacugaugaggccguuaggccgaaauuguaua

SEQ ID NO: 7373 - RNA, 38 nt, Artificial Sequence
  Description of Artificial Sequence:  Enzymatic Nucleic Acid
ugcucagccugaugaggccguuaggccgaaagauugua

SEQ ID NO: 7374 - RNA, 38 nt, Artificial Sequence
  Description of Artificial Sequence:  Enzymatic Nucleic Acid
gacuguuucugaugaggccguuaggccgaaaugcucag

SEQ ID NO: 7375 - RNA, 38 nt, Artificial Sequence
  Description of Artificial Sequence:  Enzymatic Nucleic Acid
acacauuucugaugaggccguuaggccgaaacuguuuu

SEQ ID NO: 7376 - RNA, 38 nt, Artificial Sequence
  Description of Artificial Sequence:  Enzymatic Nucleic Acid
gguuuuuacugaugaggccguuaggccgaaacacauuu

SEQ ID NO: 7377 - RNA, 38 nt, Artificial Sequence
  Description of Artificial Sequence:  Enzymatic Nucleic Acid
agguuuuucugaugaggccguuaggccgaaaacacauu

SEQ ID NO: 7378 - RNA, 38 nt, Artificial Sequence
  Description of Artificial Sequence:  Enzymatic Nucleic Acid
gagguuuucugaugaggccguuaggccgaaaaacacau

SEQ ID NO: 7379 - RNA, 38 nt, Artificial Sequence
  Description of Artificial Sequence:  Enzymatic Nucleic Acid
guggcagucugaugaggccguuaggccgaaagguuuuu

SEQ ID NO: 7380 - RNA, 38 nt, Artificial Sequence
  Description of Artificial Sequence:  Enzymatic Nucleic Acid
gacaauuacugaugaggccguuaggccgaaaguggcag

SEQ ID NO: 7381 - RNA, 38 nt, Artificial Sequence
  Description of Artificial Sequence:  Enzymatic Nucleic Acid
uugacaaucugaugaggccguuaggccgaaagaguggc

SEQ ID NO: 7382 - RNA, 38 nt, Artificial Sequence
  Description of Artificial Sequence:  Enzymatic Nucleic Acid
acauugaccugaugaggccguuaggccgaaauuagagu

SEQ ID NO: 7383 - RNA, 38 nt, Artificial Sequence
  Description of Artificial Sequence:  Enzymatic Nucleic Acid
uucacauucugaugaggccguuaggccgaaacaauuag

SEQ ID NO: 7384 - RNA, 38 nt, Artificial Sequence
  Description of Artificial Sequence:  Enzymatic Nucleic Acid
uuuucguacugaugaggccguuaggccgaaaucugggg

SEQ ID NO: 7385 - RNA, 38 nt, Artificial Sequence
  Description of Artificial Sequence:  Enzymatic Nucleic Acid
cuuuucgucugaugaggccguuaggccgaaaaucuggg

SEQ ID NO: 7386 - RNA, 38 nt, Artificial Sequence
  Description of Artificial Sequence:  Enzymatic Nucleic Acid
ccuuuucgcugaugaggccguuaggccgaaaaaucugg

SEQ ID NO: 7387 - RNA, 38 nt, Artificial Sequence
  Description of Artificial Sequence:  Enzymatic Nucleic Acid
gaaacgaucugaugaggccguuaggccgaaacacggcc

SEQ ID NO: 7388 - RNA, 38 nt, Artificial Sequence
  Description of Artificial Sequence:  Enzymatic Nucleic Acid
cuggaaaccugaugaggccguuaggccgaaaugacacg

SEQ ID NO: 7389 - RNA, 38 nt, Artificial Sequence
  Description of Artificial Sequence:  Enzymatic Nucleic Acid
ggucuggacugaugaggccguuaggccgaaacgaugac

SEQ ID NO: 7390 - RNA, 38 nt, Artificial Sequence
  Description of Artificial Sequence:  Enzymatic Nucleic Acid
gggucuggcugaugaggccguuaggccgaaaacgauga

SEQ ID NO: 7391 - RNA, 38 nt, Artificial Sequence
  Description of Artificial Sequence:  Enzymatic Nucleic Acid
cgggucugcugaugaggccguuaggccgaaaaacgaug

SEQ ID NO: 7392 - RNA, 38 nt, Artificial Sequence
  Description of Artificial Sequence:  Enzymatic Nucleic Acid
uggguagacugaugaggccguuaggccgaaagccgggu

SEQ ID NO: 7393 - RNA, 38 nt, Artificial Sequence
  Description of Artificial Sequence:  Enzymatic Nucleic Acid
aguggguacugaugaggccguuaggccgaaagagccgg

SEQ ID NO: 7394 - RNA, 38 nt, Artificial Sequence
  Description of Artificial Sequence:  Enzymatic Nucleic Acid
ccagugggcugaugaggccguuaggccgaaagagagcc

SEQ ID NO: 7395 - RNA, 38 nt, Artificial Sequence
  Description of Artificial Sequence:  Enzymatic Nucleic Acid
caagucagcugaugaggccguuaggccgaaauuugucu

SEQ ID NO: 7396 - RNA, 38 nt, Artificial Sequence
  Description of Artificial Sequence:  Enzymatic Nucleic Acid
ugcgguaccugaugaggccguuaggccgaaagucagga

SEQ ID NO: 7397 - RNA, 38 nt, Artificial Sequence
  Description of Artificial Sequence:  Enzymatic Nucleic Acid
auaugcggcugaugaggccguuaggccgaaacaaguca

SEQ ID NO: 7398 - RNA, 38 nt, Artificial Sequence
  Description of Artificial Sequence:  Enzymatic Nucleic Acid
ggauaccacugaugaggccguuaggccgaaaugcggua

SEQ ID NO: 7399 - RNA, 38 nt, Artificial Sequence
  Description of Artificial Sequence:  Enzymatic Nucleic Acid
uugagggacugaugaggccguuaggccgaaaccauaug

SEQ ID NO: 7400 - RNA, 38 nt, Artificial Sequence
  Description of Artificial Sequence:  Enzymatic Nucleic Acid
gguugaggcugaugaggccguuaggccgaaauaccaua

SEQ ID NO: 7401 - RNA, 38 nt, Artificial Sequence
  Description of Artificial Sequence:  Enzymatic Nucleic Acid
uguagguucugaugaggccguuaggccgaaagggauac

SEQ ID NO: 7402 - RNA, 38 nt, Artificial Sequence
  Description of Artificial Sequence:  Enzymatic Nucleic Acid
cuugauugcugaugaggccguuaggccgaaagguugag

SEQ ID NO: 7403 - RNA, 38 nt, Artificial Sequence
  Description of Artificial Sequence:  Enzymatic Nucleic Acid
aaccacuucugaugaggccguuaggccgaaauuguagg

SEQ ID NO: 7404 - RNA, 38 nt, Artificial Sequence
  Description of Artificial Sequence:  Enzymatic Nucleic Acid
ggugccagcugaugaggccguuaggccgaaaccacuug

SEQ ID NO: 7405 - RNA, 38 nt, Artificial Sequence
  Description of Artificial Sequence:  Enzymatic Nucleic Acid
gggugccacugaugaggccguuaggccgaaaaccacuu

SEQ ID NO: 7406 - RNA, 38 nt, Artificial Sequence
  Description of Artificial Sequence:  Enzymatic Nucleic Acid
auuauggucugaugaggccguuaggccgaaacaggggu

SEQ ID NO: 7407 - RNA, 38 nt, Artificial Sequence
  Description of Artificial Sequence:  Enzymatic Nucleic Acid
ggaaugaucugaugaggccguuaggccgaaaugguuac

SEQ ID NO: 7408 - RNA, 38 nt, Artificial Sequence
  Description of Artificial Sequence:  Enzymatic Nucleic Acid
uucggaaucugaugaggccguuaggccgaaauuauggu

SEQ ID NO: 7409 - RNA, 38 nt, Artificial Sequence
  Description of Artificial Sequence:  Enzymatic Nucleic Acid
ugcuucggcugaugaggccguuaggccgaaaugauuau

SEQ ID NO: 7410 - RNA, 38 nt, Artificial Sequence
  Description of Artificial Sequence:  Enzymatic Nucleic Acid
uugcuucgcugaugaggccguuaggccgaaaaugauua

SEQ ID NO: 7411 - RNA, 38 nt, Artificial Sequence
  Description of Artificial Sequence:  Enzymatic Nucleic Acid
uggaacaacugaugaggccguuaggccgaaagucacac

SEQ ID NO: 7412 - RNA, 38 nt, Artificial Sequence
  Description of Artificial Sequence:  Enzymatic Nucleic Acid
uuggaacacugaugaggccguuaggccgaaaagucaca

SEQ ID NO: 7413 - RNA, 38 nt, Artificial Sequence
  Description of Artificial Sequence:  Enzymatic Nucleic Acid
auuggaaccugaugaggccguuaggccgaaaaagucac

SEQ ID NO: 7414 - RNA, 38 nt, Artificial Sequence
  Description of Artificial Sequence:  Enzymatic Nucleic Acid
auuauuggcugaugaggccguuaggccgaaacaaaagu

SEQ ID NO: 7415 - RNA, 38 nt, Artificial Sequence
  Description of Artificial Sequence:  Enzymatic Nucleic Acid
cauuauugcugaugaggccguuaggccgaaaacaaaag

SEQ ID NO: 7416 - RNA, 38 nt, Artificial Sequence
  Description of Artificial Sequence:  Enzymatic Nucleic Acid
cucuucaucugaugaggccguuaggccgaaauuggaac

SEQ ID NO: 7417 - RNA, 38 nt, Artificial Sequence
  Description of Artificial Sequence:  Enzymatic Nucleic Acid
ggauaaagcugaugaggccguuaggccgaaacucuuca

SEQ ID NO: 7418 - RNA, 38 nt, Artificial Sequence
  Description of Artificial Sequence:  Enzymatic Nucleic Acid
ccaggauacugaugaggccguuaggccgaaaggacucu

SEQ ID NO: 7419 - RNA, 38 nt, Artificial Sequence
  Description of Artificial Sequence:  Enzymatic Nucleic Acid
uccaggaucugaugaggccguuaggccgaaaaggacuc

SEQ ID NO: 7420 - RNA, 38 nt, Artificial Sequence
  Description of Artificial Sequence:  Enzymatic Nucleic Acid
auccaggacugaugaggccguuaggccgaaaaaggacu

SEQ ID NO: 7421 - RNA, 38 nt, Artificial Sequence
  Description of Artificial Sequence:  Enzymatic Nucleic Acid
gcauccagcugaugaggccguuaggccgaaauaaagga

SEQ ID NO: 7422 - RNA, 38 nt, Artificial Sequence
  Description of Artificial Sequence:  Enzymatic Nucleic Acid
augcucuccugaugaggccguuaggccgaaauucuguu

SEQ ID NO: 7423 - RNA, 38 nt, Artificial Sequence
  Description of Artificial Sequence:  Enzymatic Nucleic Acid
cgcugagucugaugaggccguuaggccgaaaugcucuc

SEQ ID NO: 7424 - RNA, 38 nt, Artificial Sequence
  Description of Artificial Sequence:  Enzymatic Nucleic Acid
caugcgcucugaugaggccguuaggccgaaagugaugc

SEQ ID NO: 7425 - RNA, 38 nt, Artificial Sequence
  Description of Artificial Sequence:  Enzymatic Nucleic Acid
ccuucuaucugaugaggccguuaggccgaaauugccau

SEQ ID NO: 7426 - RNA, 38 nt, Artificial Sequence
  Description of Artificial Sequence:  Enzymatic Nucleic Acid
uuuccuuccugaugaggccguuaggccgaaauuauugc

SEQ ID NO: 7427 - RNA, 38 nt, Artificial Sequence
  Description of Artificial Sequence:  Enzymatic Nucleic Acid
agccaucucugaugaggccguuaggccgaaauucuuuc

SEQ ID NO: 7428 - RNA, 38 nt, Artificial Sequence
  Description of Artificial Sequence:  Enzymatic Nucleic Acid
caaggugccugaugaggccguuaggccgaaagccaucu

SEQ ID NO: 7429 - RNA, 38 nt, Artificial Sequence
  Description of Artificial Sequence:  Enzymatic Nucleic Acid
ccacaacccugaugaggccguuaggccgaaaggugcua

SEQ ID NO: 7430 - RNA, 38 nt, Artificial Sequence
  Description of Artificial Sequence:  Enzymatic Nucleic Acid
ucagccaccugaugaggccguuaggccgaaaccaaggu

SEQ ID NO: 7431 - RNA, 38 nt, Artificial Sequence
  Description of Artificial Sequence:  Enzymatic Nucleic Acid
aaauucuacugaugaggccguuaggccgaaagucagcc

SEQ ID NO: 7432 - RNA, 38 nt, Artificial Sequence
  Description of Artificial Sequence:  Enzymatic Nucleic Acid
agaaauuccugaugaggccguuaggccgaaagagucag

SEQ ID NO: 7433 - RNA, 38 nt, Artificial Sequence
  Description of Artificial Sequence:  Enzymatic Nucleic Acid
auuccagacugaugaggccguuaggccgaaauucuaga

SEQ ID NO: 7434 - RNA, 38 nt, Artificial Sequence
  Description of Artificial Sequence:  Enzymatic Nucleic Acid
gauuccagcugaugaggccguuaggccgaaaauucuag

SEQ ID NO: 7435 - RNA, 38 nt, Artificial Sequence
  Description of Artificial Sequence:  Enzymatic Nucleic Acid
agauuccacugaugaggccguuaggccgaaaaauucua

SEQ ID NO: 7436 - RNA, 38 nt, Artificial Sequence
  Description of Artificial Sequence:  Enzymatic Nucleic Acid
caaauguacugaugaggccguuaggccgaaauuccaga

SEQ ID NO: 7437 - RNA, 38 nt, Artificial Sequence
  Description of Artificial Sequence:  Enzymatic Nucleic Acid
ugcaaaugcugaugaggccguuaggccgaaagauucca

SEQ ID NO: 7438 - RNA, 38 nt, Artificial Sequence
  Description of Artificial Sequence:  Enzymatic Nucleic Acid
gcuaugcacugaugaggccguuaggccgaaauguagau

SEQ ID NO: 7439 - RNA, 38 nt, Artificial Sequence
  Description of Artificial Sequence:  Enzymatic Nucleic Acid
agcuaugccugaugaggccguuaggccgaaaauguaga

SEQ ID NO: 7440 - RNA, 38 nt, Artificial Sequence
  Description of Artificial Sequence:  Enzymatic Nucleic Acid
uuggaagccugaugaggccguuaggccgaaaugcaaau

SEQ ID NO: 7441 - RNA, 38 nt, Artificial Sequence
  Description of Artificial Sequence:  Enzymatic Nucleic Acid
uuuauuggcugaugaggccguuaggccgaaagcuaugc

SEQ ID NO: 7442 - RNA, 38 nt, Artificial Sequence
  Description of Artificial Sequence:  Enzymatic Nucleic Acid
cuuuauugcugaugaggccguuaggccgaaaagcuaug

SEQ ID NO: 7443 - RNA, 38 nt, Artificial Sequence
  Description of Artificial Sequence:  Enzymatic Nucleic Acid
cccaacuucugaugaggccguuaggccgaaauuggaag

SEQ ID NO: 7444 - RNA, 38 nt, Artificial Sequence
  Description of Artificial Sequence:  Enzymatic Nucleic Acid
acaguccccugaugaggccguuaggccgaaacuuuauu

SEQ ID NO: 7445 - RNA, 38 nt, Artificial Sequence
  Description of Artificial Sequence:  Enzymatic Nucleic Acid
uaaaagcucugaugaggccguuaggccgaaauguuucu

SEQ ID NO: 7446 - RNA, 38 nt, Artificial Sequence
  Description of Artificial Sequence:  Enzymatic Nucleic Acid
ugauauaacugaugaggccguuaggccgaaagcuuaug

SEQ ID NO: 7447 - RNA, 38 nt, Artificial Sequence
  Description of Artificial Sequence:  Enzymatic Nucleic Acid
gugauauacugaugaggccguuaggccgaaaagcuuau

SEQ ID NO: 7448 - RNA, 38 nt, Artificial Sequence
  Description of Artificial Sequence:  Enzymatic Nucleic Acid
ugugauaucugaugaggccguuaggccgaaaaagcuua

SEQ ID NO: 7449 - RNA, 38 nt, Artificial Sequence
  Description of Artificial Sequence:  Enzymatic Nucleic Acid
cugugauacugaugaggccguuaggccgaaaaaagcuu

SEQ ID NO: 7450 - RNA, 38 nt, Artificial Sequence
  Description of Artificial Sequence:  Enzymatic Nucleic Acid
aucugugacugaugaggccguuaggccgaaauaaaagc

SEQ ID NO: 7451 - RNA, 38 nt, Artificial Sequence
  Description of Artificial Sequence:  Enzymatic Nucleic Acid
acaucugucugaugaggccguuaggccgaaauauaaaa

SEQ ID NO: 7452 - RNA, 38 nt, Artificial Sequence
  Description of Artificial Sequence:  Enzymatic Nucleic Acid
uaacaugacugaugaggccguuaggccgaaacccauuu

SEQ ID NO: 7453 - RNA, 38 nt, Artificial Sequence
  Description of Artificial Sequence:  Enzymatic Nucleic Acid
uuaacaugcugaugaggccguuaggccgaaaacccauu

SEQ ID NO: 7454 - RNA, 38 nt, Artificial Sequence
  Description of Artificial Sequence:  Enzymatic Nucleic Acid
guuaacaucugaugaggccguuaggccgaaaaacccau

SEQ ID NO: 7455 - RNA, 38 nt, Artificial Sequence
  Description of Artificial Sequence:  Enzymatic Nucleic Acid
uccaaguucugaugaggccguuaggccgaaacaugaaa

SEQ ID NO: 7456 - RNA, 38 nt, Artificial Sequence
  Description of Artificial Sequence:  Enzymatic Nucleic Acid
uuccaagucugaugaggccguuaggccgaaaacaugaa

SEQ ID NO: 7457 - RNA, 38 nt, Artificial Sequence
  Description of Artificial Sequence:  Enzymatic Nucleic Acid
uuuuuucccugaugaggccguuaggccgaaaguuaaca

SEQ ID NO: 7458 - RNA, 38 nt, Artificial Sequence
  Description of Artificial Sequence:  Enzymatic Nucleic Acid
cugugcaacugaugaggccguuaggccgaaacaguuuc

SEQ ID NO: 7459 - RNA, 38 nt, Artificial Sequence
  Description of Artificial Sequence:  Enzymatic Nucleic Acid
aacugugccugaugaggccguuaggccgaaagacaguu

SEQ ID NO: 7460 - RNA, 38 nt, Artificial Sequence
  Description of Artificial Sequence:  Enzymatic Nucleic Acid
aacuuguucugaugaggccguuaggccgaaacugugca

SEQ ID NO: 7461 - RNA, 38 nt, Artificial Sequence
  Description of Artificial Sequence:  Enzymatic Nucleic Acid
gaacuugucugaugaggccguuaggccgaaaacugugc

SEQ ID NO: 7462 - RNA, 38 nt, Artificial Sequence
  Description of Artificial Sequence:  Enzymatic Nucleic Acid
uguauaagcugaugaggccguuaggccgaaacuuguua

SEQ ID NO: 7463 - RNA, 38 nt, Artificial Sequence
  Description of Artificial Sequence:  Enzymatic Nucleic Acid
cuguauaacugaugaggccguuaggccgaaaacuuguu

SEQ ID NO: 7464 - RNA, 38 nt, Artificial Sequence
  Description of Artificial Sequence:  Enzymatic Nucleic Acid
cucuguaucugaugaggccguuaggccgaaagaacuug

SEQ ID NO: 7465 - RNA, 38 nt, Artificial Sequence
  Description of Artificial Sequence:  Enzymatic Nucleic Acid
ucucuguacugaugaggccguuaggccgaaaagaacuu

SEQ ID NO: 7466 - RNA, 38 nt, Artificial Sequence
  Description of Artificial Sequence:  Enzymatic Nucleic Acid
cgucucugcugaugaggccguuaggccgaaauaagaac

SEQ ID NO: 7467 - RNA, 38 nt, Artificial Sequence
  Description of Artificial Sequence:  Enzymatic Nucleic Acid
auccaagucugaugaggccguuaggccgaaacgucucu

SEQ ID NO: 7468 - RNA, 38 nt, Artificial Sequence
  Description of Artificial Sequence:  Enzymatic Nucleic Acid
aauccaagcugaugaggccguuaggccgaaaacgucuc

SEQ ID NO: 7469 - RNA, 38 nt, Artificial Sequence
  Description of Artificial Sequence:  Enzymatic Nucleic Acid
uaaaaucccugaugaggccguuaggccgaaaguaacgu

SEQ ID NO: 7470 - RNA, 38 nt, Artificial Sequence
  Description of Artificial Sequence:  Enzymatic Nucleic Acid
cgcaguaacugaugaggccguuaggccgaaauccaagu

SEQ ID NO: 7471 - RNA, 38 nt, Artificial Sequence
  Description of Artificial Sequence:  Enzymatic Nucleic Acid
ccgcaguacugaugaggccguuaggccgaaaauccaag

SEQ ID NO: 7472 - RNA, 38 nt, Artificial Sequence
  Description of Artificial Sequence:  Enzymatic Nucleic Acid
uccgcagucugaugaggccguuaggccgaaaaauccaa

SEQ ID NO: 7473 - RNA, 38 nt, Artificial Sequence
  Description of Artificial Sequence:  Enzymatic Nucleic Acid
guccgcagcugaugaggccguuaggccgaaaaaaucca

SEQ ID NO: 7474 - RNA, 38 nt, Artificial Sequence
  Description of Artificial Sequence:  Enzymatic Nucleic Acid
cuguuauucugaugaggccguuaggccgaaacuguccg

SEQ ID NO: 7475 - RNA, 38 nt, Artificial Sequence
  Description of Artificial Sequence:  Enzymatic Nucleic Acid
ucuguuaucugaugaggccguuaggccgaaaacugucc

SEQ ID NO: 7476 - RNA, 38 nt, Artificial Sequence
  Description of Artificial Sequence:  Enzymatic Nucleic Acid
uguucugucugaugaggccguuaggccgaaauuaacug

SEQ ID NO: 7477 - RNA, 38 nt, Artificial Sequence
  Description of Artificial Sequence:  Enzymatic Nucleic Acid
uaauacugcugaugaggccguuaggccgaaagugcauu

SEQ ID NO: 7478 - RNA, 38 nt, Artificial Sequence
  Description of Artificial Sequence:  Enzymatic Nucleic Acid
cuugcuaacugaugaggccguuaggccgaaacuguagu

SEQ ID NO: 7479 - RNA, 38 nt, Artificial Sequence
  Description of Artificial Sequence:  Enzymatic Nucleic Acid
ugcuugcucugaugaggccguuaggccgaaauacugua

SEQ ID NO: 7480 - RNA, 38 nt, Artificial Sequence
  Description of Artificial Sequence:  Enzymatic Nucleic Acid
uugcuugccugaugaggccguuaggccgaaaauacugu

SEQ ID NO: 7481 - RNA, 38 nt, Artificial Sequence
  Description of Artificial Sequence:  Enzymatic Nucleic Acid
uccuuagucugaugaggccguuaggccgaaauggccau

SEQ ID NO: 7482 - RNA, 38 nt, Artificial Sequence
  Description of Artificial Sequence:  Enzymatic Nucleic Acid
gugcuccucugaugaggccguuaggccgaaagugaugg

SEQ ID NO: 7483 - RNA, 38 nt, Artificial Sequence
  Description of Artificial Sequence:  Enzymatic Nucleic Acid
gagugaugcugaugaggccguuaggccgaaagugcucc

SEQ ID NO: 7484 - RNA, 38 nt, Artificial Sequence
  Description of Artificial Sequence:  Enzymatic Nucleic Acid
uuaagagucugaugaggccguuaggccgaaauggagug

SEQ ID NO: 7485 - RNA, 38 nt, Artificial Sequence
  Description of Artificial Sequence:  Enzymatic Nucleic Acid
aagauuaacugaugaggccguuaggccgaaagugaugg

SEQ ID NO: 7486 - RNA, 38 nt, Artificial Sequence
  Description of Artificial Sequence:  Enzymatic Nucleic Acid
guaagauucugaugaggccguuaggccgaaagagugau

SEQ ID NO: 7487 - RNA, 38 nt, Artificial Sequence
  Description of Artificial Sequence:  Enzymatic Nucleic Acid
gguaagaucugaugaggccguuaggccgaaaagaguga

SEQ ID NO: 7488 - RNA, 38 nt, Artificial Sequence
  Description of Artificial Sequence:  Enzymatic Nucleic Acid
gaugguaacugaugaggccguuaggccgaaauuaagag

SEQ ID NO: 7489 - RNA, 38 nt, Artificial Sequence
  Description of Artificial Sequence:  Enzymatic Nucleic Acid
augauggucugaugaggccguuaggccgaaagauuaag

SEQ ID NO: 7490 - RNA, 38 nt, Artificial Sequence
  Description of Artificial Sequence:  Enzymatic Nucleic Acid
caugauggcugaugaggccguuaggccgaaaagauuaa

SEQ ID NO: 7491 - RNA, 38 nt, Artificial Sequence
  Description of Artificial Sequence:  Enzymatic Nucleic Acid
acauucaucugaugaggccguuaggccgaaaugguaag

SEQ ID NO: 7492 - RNA, 38 nt, Artificial Sequence
  Description of Artificial Sequence:  Enzymatic Nucleic Acid
ugcagggacugaugaggccguuaggccgaaacauucau

SEQ ID NO: 7493 - RNA, 38 nt, Artificial Sequence
  Description of Artificial Sequence:  Enzymatic Nucleic Acid
uugcagggcugaugaggccguuaggccgaaaacauuca

SEQ ID NO: 7494 - RNA, 38 nt, Artificial Sequence
  Description of Artificial Sequence:  Enzymatic Nucleic Acid
cuugcaggcugaugaggccguuaggccgaaaaacauuc

SEQ ID NO: 7495 - RNA, 38 nt, Artificial Sequence
  Description of Artificial Sequence:  Enzymatic Nucleic Acid
ggugccugcugaugaggccguuaggccgaaaucuugca

SEQ ID NO: 7496 - RNA, 38 nt, Artificial Sequence
  Description of Artificial Sequence:  Enzymatic Nucleic Acid
aggugccucugaugaggccguuaggccgaaaaucuugc

SEQ ID NO: 7497 - RNA, 38 nt, Artificial Sequence
  Description of Artificial Sequence:  Enzymatic Nucleic Acid
ugcaggcacugaugaggccguuaggccgaaaggugccu

SEQ ID NO: 7498 - RNA, 38 nt, Artificial Sequence
  Description of Artificial Sequence:  Enzymatic Nucleic Acid
ccuguguacugaugaggccguuaggccgaaacauuccu

SEQ ID NO: 7499 - RNA, 38 nt, Artificial Sequence
  Description of Artificial Sequence:  Enzymatic Nucleic Acid
ccccugugcugaugaggccguuaggccgaaauacauuc

SEQ ID NO: 7500 - RNA, 38 nt, Artificial Sequence
  Description of Artificial Sequence:  Enzymatic Nucleic Acid
uucuggagcugaugaggccguuaggccgaaauuucuuc

SEQ ID NO: 7501 - RNA, 38 nt, Artificial Sequence
  Description of Artificial Sequence:  Enzymatic Nucleic Acid
uucuucugcugaugaggccguuaggccgaaaggauuuc

SEQ ID NO: 7502 - RNA, 38 nt, Artificial Sequence
  Description of Artificial Sequence:  Enzymatic Nucleic Acid
cugauugucugaugaggccguuaggccgaaauuucuuu

SEQ ID NO: 7503 - RNA, 38 nt, Artificial Sequence
  Description of Artificial Sequence:  Enzymatic Nucleic Acid
ucugauugcugaugaggccguuaggccgaaaauuucuu

SEQ ID NO: 7504 - RNA, 38 nt, Artificial Sequence
  Description of Artificial Sequence:  Enzymatic Nucleic Acid
ugaucucucugaugaggccguuaggccgaaauuguaau

SEQ ID NO: 7505 - RNA, 38 nt, Artificial Sequence
  Description of Artificial Sequence:  Enzymatic Nucleic Acid
ugcuuccucugaugaggccguuaggccgaaaucucuga

SEQ ID NO: 7506 - RNA, 38 nt, Artificial Sequence
  Description of Artificial Sequence:  Enzymatic Nucleic Acid
gcaggaggcugaugaggccguuaggccgaaauggugcu

SEQ ID NO: 7507 - RNA, 38 nt, Artificial Sequence
  Description of Artificial Sequence:  Enzymatic Nucleic Acid
uuucgcagcugaugaggccguuaggccgaaagguaugg

SEQ ID NO: 7508 - RNA, 38 nt, Artificial Sequence
  Description of Artificial Sequence:  Enzymatic Nucleic Acid
ugaucacucugaugaggccguuaggccgaaagguuucg

SEQ ID NO: 7509 - RNA, 38 nt, Artificial Sequence
  Description of Artificial Sequence:  Enzymatic Nucleic Acid
cacugugucugaugaggccguuaggccgaaaucacuga

SEQ ID NO: 7510 - RNA, 38 nt, Artificial Sequence
  Description of Artificial Sequence:  Enzymatic Nucleic Acid
gaacugcucugaugaggccguuaggccgaaauggccac

SEQ ID NO: 7511 - RNA, 38 nt, Artificial Sequence
  Description of Artificial Sequence:  Enzymatic Nucleic Acid
agugguggcugaugaggccguuaggccgaaacugcuga

SEQ ID NO: 7512 - RNA, 38 nt, Artificial Sequence
  Description of Artificial Sequence:  Enzymatic Nucleic Acid
aaguggugcugaugaggccguuaggccgaaaacugcug

SEQ ID NO: 7513 - RNA, 38 nt, Artificial Sequence
  Description of Artificial Sequence:  Enzymatic Nucleic Acid
acagucuacugaugaggccguuaggccgaaaguggugg

SEQ ID NO: 7514 - RNA, 38 nt, Artificial Sequence
  Description of Artificial Sequence:  Enzymatic Nucleic Acid
gacagucucugaugaggccguuaggccgaaaaguggug

SEQ ID NO: 7515 - RNA, 38 nt, Artificial Sequence
  Description of Artificial Sequence:  Enzymatic Nucleic Acid
ugacaguccugaugaggccguuaggccgaaaaaguggu

SEQ ID NO: 7516 - RNA, 38 nt, Artificial Sequence
  Description of Artificial Sequence:  Enzymatic Nucleic Acid
auuagcaucugaugaggccguuaggccgaaacagucua

SEQ ID NO: 7517 - RNA, 38 nt, Artificial Sequence
  Description of Artificial Sequence:  Enzymatic Nucleic Acid
gacaccaucugaugaggccguuaggccgaaagcaugac

SEQ ID NO: 7518 - RNA, 38 nt, Artificial Sequence
  Description of Artificial Sequence:  Enzymatic Nucleic Acid
ggcucgggcugaugaggccguuaggccgaaacaccauu

SEQ ID NO: 7519 - RNA, 38 nt, Artificial Sequence
  Description of Artificial Sequence:  Enzymatic Nucleic Acid
agugaucucugaugaggccguuaggccgaaaggcucgg

SEQ ID NO: 7520 - RNA, 38 nt, Artificial Sequence
  Description of Artificial Sequence:  Enzymatic Nucleic Acid
aaccaagucugaugaggccguuaggccgaaaucugagg

SEQ ID NO: 7521 - RNA, 38 nt, Artificial Sequence
  Description of Artificial Sequence:  Enzymatic Nucleic Acid
uuuaaacccugaugaggccguuaggccgaaagugaucu

SEQ ID NO: 7522 - RNA, 38 nt, Artificial Sequence
  Description of Artificial Sequence:  Enzymatic Nucleic Acid
uguuuuuacugaugaggccguuaggccgaaaccaagug

SEQ ID NO: 7523 - RNA, 38 nt, Artificial Sequence
  Description of Artificial Sequence:  Enzymatic Nucleic Acid
uuguuuuucugaugaggccguuaggccgaaaaccaagu

SEQ ID NO: 7524 - RNA, 38 nt, Artificial Sequence
  Description of Artificial Sequence:  Enzymatic Nucleic Acid
guuguuuucugaugaggccguuaggccgaaaaaccaag

SEQ ID NO: 7525 - RNA, 38 nt, Artificial Sequence
  Description of Artificial Sequence:  Enzymatic Nucleic Acid
ucuuguugcugaugaggccguuaggccgaaauuuugug

SEQ ID NO: 7526 - RNA, 38 nt, Artificial Sequence
  Description of Artificial Sequence:  Enzymatic Nucleic Acid
ccuaaaaucugaugaggccguuaggccgaaauuccagg

SEQ ID NO: 7527 - RNA, 38 nt, Artificial Sequence
  Description of Artificial Sequence:  Enzymatic Nucleic Acid
uccuaaaacugaugaggccguuaggccgaaaauuccag

SEQ ID NO: 7528 - RNA, 38 nt, Artificial Sequence
  Description of Artificial Sequence:  Enzymatic Nucleic Acid
gguccuaacugaugaggccguuaggccgaaauaauucc

SEQ ID NO: 7529 - RNA, 38 nt, Artificial Sequence
  Description of Artificial Sequence:  Enzymatic Nucleic Acid
ugguccuacugaugaggccguuaggccgaaaauaauuc

SEQ ID NO: 7530 - RNA, 38 nt, Artificial Sequence
  Description of Artificial Sequence:  Enzymatic Nucleic Acid
cugguccucugaugaggccguuaggccgaaaaauaauu

SEQ ID NO: 7531 - RNA, 38 nt, Artificial Sequence
  Description of Artificial Sequence:  Enzymatic Nucleic Acid
ccuggucccugaugaggccguuaggccgaaaaaauaau

SEQ ID NO: 7532 - RNA, 38 nt, Artificial Sequence
  Description of Artificial Sequence:  Enzymatic Nucleic Acid
uuucaauacugaugaggccguuaggccgaaacagcgug

SEQ ID NO: 7533 - RNA, 38 nt, Artificial Sequence
  Description of Artificial Sequence:  Enzymatic Nucleic Acid
cuuucaaucugaugaggccguuaggccgaaaacagcgu

SEQ ID NO: 7534 - RNA, 38 nt, Artificial Sequence
  Description of Artificial Sequence:  Enzymatic Nucleic Acid
ucuuucaacugaugaggccguuaggccgaaaaacagcg

SEQ ID NO: 7535 - RNA, 38 nt, Artificial Sequence
  Description of Artificial Sequence:  Enzymatic Nucleic Acid
acucuuuccugaugaggccguuaggccgaaauaaacag

SEQ ID NO: 7536 - RNA, 38 nt, Artificial Sequence
  Description of Artificial Sequence:  Enzymatic Nucleic Acid
ucuucugucugaugaggccguuaggccgaaacucuuuc

SEQ ID NO: 7537 - RNA, 38 nt, Artificial Sequence
  Description of Artificial Sequence:  Enzymatic Nucleic Acid
cagugauacugaugaggccguuaggccgaaacaccuuc

SEQ ID NO: 7538 - RNA, 38 nt, Artificial Sequence
  Description of Artificial Sequence:  Enzymatic Nucleic Acid
ugcagugacugaugaggccguuaggccgaaagacaccu

SEQ ID NO: 7539 - RNA, 38 nt, Artificial Sequence
  Description of Artificial Sequence:  Enzymatic Nucleic Acid
uuugcagucugaugaggccguuaggccgaaauagacac

SEQ ID NO: 7540 - RNA, 38 nt, Artificial Sequence
  Description of Artificial Sequence:  Enzymatic Nucleic Acid
uuuccacacugaugaggccguuaggccgaaagcccuuc

SEQ ID NO: 7541 - RNA, 38 nt, Artificial Sequence
  Description of Artificial Sequence:  Enzymatic Nucleic Acid
guaugcugcugaugaggccguuaggccgaaacuuucca

SEQ ID NO: 7542 - RNA, 38 nt, Artificial Sequence
  Description of Artificial Sequence:  Enzymatic Nucleic Acid
gguaugcucugaugaggccguuaggccgaaaacuuucc

SEQ ID NO: 7543 - RNA, 38 nt, Artificial Sequence
  Description of Artificial Sequence:  Enzymatic Nucleic Acid
cagugaggcugaugaggccguuaggccgaaaugcugaa

SEQ ID NO: 7544 - RNA, 38 nt, Artificial Sequence
  Description of Artificial Sequence:  Enzymatic Nucleic Acid
ugaacagucugaugaggccguuaggccgaaagguaugc

SEQ ID NO: 7545 - RNA, 38 nt, Artificial Sequence
  Description of Artificial Sequence:  Enzymatic Nucleic Acid
guuccuugcugaugaggccguuaggccgaaacagugag

SEQ ID NO: 7546 - RNA, 38 nt, Artificial Sequence
  Description of Artificial Sequence:  Enzymatic Nucleic Acid
gguuccuucugaugaggccguuaggccgaaaacaguga

SEQ ID NO: 7547 - RNA, 38 nt, Artificial Sequence
  Description of Artificial Sequence:  Enzymatic Nucleic Acid
acuugucccugaugaggccguuaggccgaaagguuccu

SEQ ID NO: 7548 - RNA, 38 nt, Artificial Sequence
  Description of Artificial Sequence:  Enzymatic Nucleic Acid
ccagauuacugaugaggccguuaggccgaaacuugucc

SEQ ID NO: 7549 - RNA, 38 nt, Artificial Sequence
  Description of Artificial Sequence:  Enzymatic Nucleic Acid
cuccagaucugaugaggccguuaggccgaaagacuugu

SEQ ID NO: 7550 - RNA, 38 nt, Artificial Sequence
  Description of Artificial Sequence:  Enzymatic Nucleic Acid
cagcuccacugaugaggccguuaggccgaaauuagacu

SEQ ID NO: 7551 - RNA, 38 nt, Artificial Sequence
  Description of Artificial Sequence:  Enzymatic Nucleic Acid
guuagagucugaugaggccguuaggccgaaaucagcuc

SEQ ID NO: 7552 - RNA, 38 nt, Artificial Sequence
  Description of Artificial Sequence:  Enzymatic Nucleic Acid
gcauguuacugaugaggccguuaggccgaaagugauca

SEQ ID NO: 7553 - RNA, 38 nt, Artificial Sequence
  Description of Artificial Sequence:  Enzymatic Nucleic Acid
gugcaugucugaugaggccguuaggccgaaagagugau

SEQ ID NO: 7554 - RNA, 38 nt, Artificial Sequence
  Description of Artificial Sequence:  Enzymatic Nucleic Acid
ccagaagacugaugaggccguuaggccgaaagucgcag

SEQ ID NO: 7555 - RNA, 38 nt, Artificial Sequence
  Description of Artificial Sequence:  Enzymatic Nucleic Acid
agccagaacugaugaggccguuaggccgaaagagucgc

SEQ ID NO: 7556 - RNA, 38 nt, Artificial Sequence
  Description of Artificial Sequence:  Enzymatic Nucleic Acid
ggagccagcugaugaggccguuaggccgaaagagaguc

SEQ ID NO: 7557 - RNA, 38 nt, Artificial Sequence
  Description of Artificial Sequence:  Enzymatic Nucleic Acid
aggagccacugaugaggccguuaggccgaaaagagagu

SEQ ID NO: 7558 - RNA, 38 nt, Artificial Sequence
  Description of Artificial Sequence:  Enzymatic Nucleic Acid
guuaauagcugaugaggccguuaggccgaaagccagaa

SEQ ID NO: 7559 - RNA, 38 nt, Artificial Sequence
  Description of Artificial Sequence:  Enzymatic Nucleic Acid
aggguuaacugaugaggccguuaggccgaaaggagcca

SEQ ID NO: 7560 - RNA, 38 nt, Artificial Sequence
  Description of Artificial Sequence:  Enzymatic Nucleic Acid
ggaggguucugaugaggccguuaggccgaaauaggagc

SEQ ID NO: 7561 - RNA, 38 nt, Artificial Sequence
  Description of Artificial Sequence:  Enzymatic Nucleic Acid
aggagggucugaugaggccguuaggccgaaaauaggag

SEQ ID NO: 7562 - RNA, 38 nt, Artificial Sequence
  Description of Artificial Sequence:  Enzymatic Nucleic Acid
cggauaagcugaugaggccguuaggccgaaaggguuaa

SEQ ID NO: 7563 - RNA, 38 nt, Artificial Sequence
  Description of Artificial Sequence:  Enzymatic Nucleic Acid
uuucggaucugaugaggccguuaggccgaaaggagggu

SEQ ID NO: 7564 - RNA, 38 nt, Artificial Sequence
  Description of Artificial Sequence:  Enzymatic Nucleic Acid
uuuucggacugaugaggccguuaggccgaaaaggaggg

SEQ ID NO: 7565 - RNA, 38 nt, Artificial Sequence
  Description of Artificial Sequence:  Enzymatic Nucleic Acid
auuuuucgcugaugaggccguuaggccgaaauaaggag

SEQ ID NO: 7566 - RNA, 38 nt, Artificial Sequence
  Description of Artificial Sequence:  Enzymatic Nucleic Acid
cagaagaacugaugaggccguuaggccgaaaccuuuuc

SEQ ID NO: 7567 - RNA, 38 nt, Artificial Sequence
  Description of Artificial Sequence:  Enzymatic Nucleic Acid
uucagaagcugaugaggccguuaggccgaaagaccuuu

SEQ ID NO: 7568 - RNA, 38 nt, Artificial Sequence
  Description of Artificial Sequence:  Enzymatic Nucleic Acid
uuucagaacugaugaggccguuaggccgaaaagaccuu

SEQ ID NO: 7569 - RNA, 38 nt, Artificial Sequence
  Description of Artificial Sequence:  Enzymatic Nucleic Acid
uauuucagcugaugaggccguuaggccgaaagaagacc

SEQ ID NO: 7570 - RNA, 38 nt, Artificial Sequence
  Description of Artificial Sequence:  Enzymatic Nucleic Acid
uuauuucacugaugaggccguuaggccgaaaagaagac

SEQ ID NO: 7571 - RNA, 38 nt, Artificial Sequence
  Description of Artificial Sequence:  Enzymatic Nucleic Acid
ucagucuucugaugaggccguuaggccgaaauuucaga

SEQ ID NO: 7572 - RNA, 38 nt, Artificial Sequence
  Description of Artificial Sequence:  Enzymatic Nucleic Acid
uugauaggcugaugaggccguuaggccgaaagucaguc

SEQ ID NO: 7573 - RNA, 38 nt, Artificial Sequence
  Description of Artificial Sequence:  Enzymatic Nucleic Acid
auaauugacugaugaggccguuaggccgaaagguaguc

SEQ ID NO: 7574 - RNA, 38 nt, Artificial Sequence
  Description of Artificial Sequence:  Enzymatic Nucleic Acid
uuauaauucugaugaggccguuaggccgaaauagguag

SEQ ID NO: 7575 - RNA, 38 nt, Artificial Sequence
  Description of Artificial Sequence:  Enzymatic Nucleic Acid
uccauuaucugaugaggccguuaggccgaaauugauag

SEQ ID NO: 7576 - RNA, 38 nt, Artificial Sequence
  Description of Artificial Sequence:  Enzymatic Nucleic Acid
guccauuacugaugaggccguuaggccgaaaauugaua

SEQ ID NO: 7577 - RNA, 38 nt, Artificial Sequence
  Description of Artificial Sequence:  Enzymatic Nucleic Acid
ggguccaucugaugaggccguuaggccgaaauaauuga

SEQ ID NO: 7578 - RNA, 38 nt, Artificial Sequence
  Description of Artificial Sequence:  Enzymatic Nucleic Acid
uccaaaggcugaugaggccguuaggccgaaacuucauc

SEQ ID NO: 7579 - RNA, 38 nt, Artificial Sequence
  Description of Artificial Sequence:  Enzymatic Nucleic Acid
auccaaagcugaugaggccguuaggccgaaaacuucau

SEQ ID NO: 7580 - RNA, 38 nt, Artificial Sequence
  Description of Artificial Sequence:  Enzymatic Nucleic Acid
cucauccacugaugaggccguuaggccgaaaggaacuu

SEQ ID NO: 7581 - RNA, 38 nt, Artificial Sequence
  Description of Artificial Sequence:  Enzymatic Nucleic Acid
gcucaucccugaugaggccguuaggccgaaaaggaacu

SEQ ID NO: 7582 - RNA, 38 nt, Artificial Sequence
  Description of Artificial Sequence:  Enzymatic Nucleic Acid
ucauaaggcugaugaggccguuaggccgaaagccgcuc

SEQ ID NO: 7583 - RNA, 38 nt, Artificial Sequence
  Description of Artificial Sequence:  Enzymatic Nucleic Acid
ggcaucaucugaugaggccguuaggccgaaagggagcc

SEQ ID NO: 7584 - RNA, 38 nt, Artificial Sequence
  Description of Artificial Sequence:  Enzymatic Nucleic Acid
uggcaucacugaugaggccguuaggccgaaaagggagc

SEQ ID NO: 7585 - RNA, 38 nt, Artificial Sequence
  Description of Artificial Sequence:  Enzymatic Nucleic Acid
cccgggcacugaugaggccguuaggccgaaacucccac

SEQ ID NO: 7586 - RNA, 38 nt, Artificial Sequence
  Description of Artificial Sequence:  Enzymatic Nucleic Acid
ucccgggccugaugaggccguuaggccgaaaacuccca

SEQ ID NO: 7587 - RNA, 38 nt, Artificial Sequence
  Description of Artificial Sequence:  Enzymatic Nucleic Acid
cccaguuucugaugaggccguuaggccgaaagucucuc

SEQ ID NO: 7588 - RNA, 38 nt, Artificial Sequence
  Description of Artificial Sequence:  Enzymatic Nucleic Acid
gcccaguucugaugaggccguuaggccgaaaagucucu

SEQ ID NO: 7589 - RNA, 38 nt, Artificial Sequence
  Description of Artificial Sequence:  Enzymatic Nucleic Acid
uuccaagucugaugaggccguuaggccgaaauuugccc

SEQ ID NO: 7590 - RNA, 38 nt, Artificial Sequence
  Description of Artificial Sequence:  Enzymatic Nucleic Acid
ccucuucccugaugaggccguuaggccgaaagugauuu

SEQ ID NO: 7591 - RNA, 38 nt, Artificial Sequence
  Description of Artificial Sequence:  Enzymatic Nucleic Acid
uuuuccaacugaugaggccguuaggccgaaagccccuc

SEQ ID NO: 7592 - RNA, 38 nt, Artificial Sequence
  Description of Artificial Sequence:  Enzymatic Nucleic Acid
cuuuuccacugaugaggccguuaggccgaaaagccccu

SEQ ID NO: 7593 - RNA, 38 nt, Artificial Sequence
  Description of Artificial Sequence:  Enzymatic Nucleic Acid
acuuuucccugaugaggccguuaggccgaaaaagcccc

SEQ ID NO: 7594 - RNA, 38 nt, Artificial Sequence
  Description of Artificial Sequence:  Enzymatic Nucleic Acid
gaugcuugcugaugaggccguuaggccgaaaccacuuu

SEQ ID NO: 7595 - RNA, 38 nt, Artificial Sequence
  Description of Artificial Sequence:  Enzymatic Nucleic Acid
ugaugcuucugaugaggccguuaggccgaaaaccacuu

SEQ ID NO: 7596 - RNA, 38 nt, Artificial Sequence
  Description of Artificial Sequence:  Enzymatic Nucleic Acid
caaaugcucugaugaggccguuaggccgaaaugcuuga

SEQ ID NO: 7597 - RNA, 38 nt, Artificial Sequence
  Description of Artificial Sequence:  Enzymatic Nucleic Acid
uaaugccacugaugaggccguuaggccgaaaugcugau

SEQ ID NO: 7598 - RNA, 38 nt, Artificial Sequence
  Description of Artificial Sequence:  Enzymatic Nucleic Acid
uuaaugcccugaugaggccguuaggccgaaaaugcuga

SEQ ID NO: 7599 - RNA, 38 nt, Artificial Sequence
  Description of Artificial Sequence:  Enzymatic Nucleic Acid
gauuucuucugaugaggccguuaggccgaaaugccaaa

SEQ ID NO: 7600 - RNA, 38 nt, Artificial Sequence
  Description of Artificial Sequence:  Enzymatic Nucleic Acid
ugauuucucugaugaggccguuaggccgaaaaugccaa

SEQ ID NO: 7601 - RNA, 38 nt, Artificial Sequence
  Description of Artificial Sequence:  Enzymatic Nucleic Acid
acguaggucugaugaggccguuaggccgaaauuucuua

SEQ ID NO: 7602 - RNA, 38 nt, Artificial Sequence
  Description of Artificial Sequence:  Enzymatic Nucleic Acid
ccggcacgcugaugaggccguuaggccgaaaggugauu

SEQ ID NO: 7603 - RNA, 38 nt, Artificial Sequence
  Description of Artificial Sequence:  Enzymatic Nucleic Acid
gagcuuugcugaugaggccguuaggccgaaacucgcug

SEQ ID NO: 7604 - RNA, 38 nt, Artificial Sequence
  Description of Artificial Sequence:  Enzymatic Nucleic Acid
agucaucacugaugaggccguuaggccgaaagcuuugu

SEQ ID NO: 7605 - RNA, 38 nt, Artificial Sequence
  Description of Artificial Sequence:  Enzymatic Nucleic Acid
aagauuuucugaugaggccguuaggccgaaagcucagu

SEQ ID NO: 7606 - RNA, 38 nt, Artificial Sequence
  Description of Artificial Sequence:  Enzymatic Nucleic Acid
ugggucaacugaugaggccguuaggccgaaauuuuuag

SEQ ID NO: 7607 - RNA, 38 nt, Artificial Sequence
  Description of Artificial Sequence:  Enzymatic Nucleic Acid
uguggguccugaugaggccguuaggccgaaagauuuuu

SEQ ID NO: 7608 - RNA, 38 nt, Artificial Sequence
  Description of Artificial Sequence:  Enzymatic Nucleic Acid
ugguggcccugaugaggccguuaggccgaaaugugggu

SEQ ID NO: 7609 - RNA, 38 nt, Artificial Sequence
  Description of Artificial Sequence:  Enzymatic Nucleic Acid
cacguucacugaugaggccguuaggccgaaaugguggc

SEQ ID NO: 7610 - RNA, 38 nt, Artificial Sequence
  Description of Artificial Sequence:  Enzymatic Nucleic Acid
agcagguucugaugaggccguuaggccgaaaccacguu

SEQ ID NO: 7611 - RNA, 38 nt, Artificial Sequence
  Description of Artificial Sequence:  Enzymatic Nucleic Acid
cagcaggucugaugaggccguuaggccgaaaaccacgu

SEQ ID NO: 7612 - RNA, 38 nt, Artificial Sequence
  Description of Artificial Sequence:  Enzymatic Nucleic Acid
caccaucacugaugaggccguuaggccgaaaggcccuc

SEQ ID NO: 7613 - RNA, 38 nt, Artificial Sequence
  Description of Artificial Sequence:  Enzymatic Nucleic Acid
uauucaaccugaugaggccguuaggccgaaaucaccau

SEQ ID NO: 7614 - RNA, 38 nt, Artificial Sequence
  Description of Artificial Sequence:  Enzymatic Nucleic Acid
caguauuccugaugaggccguuaggccgaaacaaucac

SEQ ID NO: 7615 - RNA, 38 nt, Artificial Sequence
  Description of Artificial Sequence:  Enzymatic Nucleic Acid
auuugcagcugaugaggccguuaggccgaaauucaaca

SEQ ID NO: 7616 - RNA, 38 nt, Artificial Sequence
  Description of Artificial Sequence:  Enzymatic Nucleic Acid
gauuuccacugaugaggccguuaggccgaaauuugcag

SEQ ID NO: 7617 - RNA, 38 nt, Artificial Sequence
  Description of Artificial Sequence:  Enzymatic Nucleic Acid
guuggagacugaugaggccguuaggccgaaauuuccau

SEQ ID NO: 7618 - RNA, 38 nt, Artificial Sequence
  Description of Artificial Sequence:  Enzymatic Nucleic Acid
uaguuggacugaugaggccguuaggccgaaagauuucc

SEQ ID NO: 7619 - RNA, 38 nt, Artificial Sequence
  Description of Artificial Sequence:  Enzymatic Nucleic Acid
gguaguugcugaugaggccguuaggccgaaagagauuu

SEQ ID NO: 7620 - RNA, 38 nt, Artificial Sequence
  Description of Artificial Sequence:  Enzymatic Nucleic Acid
ucuugaggcugaugaggccguuaggccgaaaguuggag

SEQ ID NO: 7621 - RNA, 38 nt, Artificial Sequence
  Description of Artificial Sequence:  Enzymatic Nucleic Acid
uugcucuucugaugaggccguuaggccgaaagguaguu

SEQ ID NO: 7622 - RNA, 38 nt, Artificial Sequence
  Description of Artificial Sequence:  Enzymatic Nucleic Acid
gaaaaaaucugaugaggccguuaggccgaaagucacgu

SEQ ID NO: 7623 - RNA, 38 nt, Artificial Sequence
  Description of Artificial Sequence:  Enzymatic Nucleic Acid
agaaaaaacugaugaggccguuaggccgaaaagucacg

SEQ ID NO: 7624 - RNA, 38 nt, Artificial Sequence
  Description of Artificial Sequence:  Enzymatic Nucleic Acid
ugagaaaacugaugaggccguuaggccgaaauaaguca

SEQ ID NO: 7625 - RNA, 38 nt, Artificial Sequence
  Description of Artificial Sequence:  Enzymatic Nucleic Acid
uugagaaacugaugaggccguuaggccgaaaauaaguc

SEQ ID NO: 7626 - RNA, 38 nt, Artificial Sequence
  Description of Artificial Sequence:  Enzymatic Nucleic Acid
guugagaacugaugaggccguuaggccgaaaaauaagu

SEQ ID NO: 7627 - RNA, 38 nt, Artificial Sequence
  Description of Artificial Sequence:  Enzymatic Nucleic Acid
uguugagacugaugaggccguuaggccgaaaaaauaag

SEQ ID NO: 7628 - RNA, 38 nt, Artificial Sequence
  Description of Artificial Sequence:  Enzymatic Nucleic Acid
uuguugagcugaugaggccguuaggccgaaaaaaauaa

SEQ ID NO: 7629 - RNA, 38 nt, Artificial Sequence
  Description of Artificial Sequence:  Enzymatic Nucleic Acid
cuuguugacugaugaggccguuaggccgaaaaaaaaua

SEQ ID NO: 7630 - RNA, 38 nt, Artificial Sequence
  Description of Artificial Sequence:  Enzymatic Nucleic Acid
uccuuguucugaugaggccguuaggccgaaagaaaaaa

SEQ ID NO: 7631 - RNA, 38 nt, Artificial Sequence
  Description of Artificial Sequence:  Enzymatic Nucleic Acid
uccaugugcugaugaggccguuaggccgaaagugcugc

SEQ ID NO: 7632 - RNA, 38 nt, Artificial Sequence
  Description of Artificial Sequence:  Enzymatic Nucleic Acid
uucuuucucugaugaggccguuaggccgaaaggcucca

SEQ ID NO: 7633 - RNA, 38 nt, Artificial Sequence
  Description of Artificial Sequence:  Enzymatic Nucleic Acid
acgcuauccugaugaggccguuaggccgaaagucuugg

SEQ ID NO: 7634 - RNA, 38 nt, Artificial Sequence
  Description of Artificial Sequence:  Enzymatic Nucleic Acid
ggugacgccugaugaggccguuaggccgaaaucuaguc

SEQ ID NO: 7635 - RNA, 38 nt, Artificial Sequence
  Description of Artificial Sequence:  Enzymatic Nucleic Acid
cugcuggucugaugaggccguuaggccgaaacgcuauc

SEQ ID NO: 7636 - RNA, 38 nt, Artificial Sequence
  Description of Artificial Sequence:  Enzymatic Nucleic Acid
agcucgcacugaugaggccguuaggccgaaagcuuucg

SEQ ID NO: 7637 - RNA, 38 nt, Artificial Sequence
  Description of Artificial Sequence:  Enzymatic Nucleic Acid
gagcucgccugaugaggccguuaggccgaaaagcuuuc

SEQ ID NO: 7638 - RNA, 38 nt, Artificial Sequence
  Description of Artificial Sequence:  Enzymatic Nucleic Acid
gaaagccgcugaugaggccguuaggccgaaagcucgca

SEQ ID NO: 7639 - RNA, 38 nt, Artificial Sequence
  Description of Artificial Sequence:  Enzymatic Nucleic Acid
cuuccugacugaugaggccguuaggccgaaagccggag

SEQ ID NO: 7640 - RNA, 38 nt, Artificial Sequence
  Description of Artificial Sequence:  Enzymatic Nucleic Acid
ucuuccugcugaugaggccguuaggccgaaaagccgga

SEQ ID NO: 7641 - RNA, 38 nt, Artificial Sequence
  Description of Artificial Sequence:  Enzymatic Nucleic Acid
aucuuccucugaugaggccguuaggccgaaaaagccgg

SEQ ID NO: 7642 - RNA, 38 nt, Artificial Sequence
  Description of Artificial Sequence:  Enzymatic Nucleic Acid
cagacuuucugaugaggccguuaggccgaaaucuuccu

SEQ ID NO: 7643 - RNA, 38 nt, Artificial Sequence
  Description of Artificial Sequence:  Enzymatic Nucleic Acid
aucacucacugaugaggccguuaggccgaaacuuuuau

SEQ ID NO: 7644 - RNA, 38 nt, Artificial Sequence
  Description of Artificial Sequence:  Enzymatic Nucleic Acid
ucuuccuccugaugaggccguuaggccgaaacaucacu

SEQ ID NO: 7645 - RNA, 38 nt, Artificial Sequence
  Description of Artificial Sequence:  Enzymatic Nucleic Acid
accgucagcugaugaggccguuaggccgaaauccuccu

SEQ ID NO: 7646 - RNA, 38 nt, Artificial Sequence
  Description of Artificial Sequence:  Enzymatic Nucleic Acid
aaccgucacugaugaggccguuaggccgaaaauccucc

SEQ ID NO: 7647 - RNA, 38 nt, Artificial Sequence
  Description of Artificial Sequence:  Enzymatic Nucleic Acid
cuuguagacugaugaggccguuaggccgaaaccgucag

SEQ ID NO: 7648 - RNA, 38 nt, Artificial Sequence
  Description of Artificial Sequence:  Enzymatic Nucleic Acid
ccuuguagcugaugaggccguuaggccgaaaaccguca

SEQ ID NO: 7649 - RNA, 38 nt, Artificial Sequence
  Description of Artificial Sequence:  Enzymatic Nucleic Acid
uccuuguacugaugaggccguuaggccgaaaaaccguc

SEQ ID NO: 7650 - RNA, 38 nt, Artificial Sequence
  Description of Artificial Sequence:  Enzymatic Nucleic Acid
gcuccuugcugaugaggccguuaggccgaaagaaaccg

SEQ ID NO: 7651 - RNA, 38 nt, Artificial Sequence
  Description of Artificial Sequence:  Enzymatic Nucleic Acid
uccauagucugaugaggccguuaggccgaaaugggcuc

SEQ ID NO: 7652 - RNA, 38 nt, Artificial Sequence
  Description of Artificial Sequence:  Enzymatic Nucleic Acid
aucuuccacugaugaggccguuaggccgaaagugaugg

SEQ ID NO: 7653 - RNA, 38 nt, Artificial Sequence
  Description of Artificial Sequence:  Enzymatic Nucleic Acid
agaaaucacugaugaggccguuaggccgaaaucuucca

SEQ ID NO: 7654 - RNA, 38 nt, Artificial Sequence
  Description of Artificial Sequence:  Enzymatic Nucleic Acid
cuguaagacugaugaggccguuaggccgaaaucagauc

SEQ ID NO: 7655 - RNA, 38 nt, Artificial Sequence
  Description of Artificial Sequence:  Enzymatic Nucleic Acid
acuguaagcugaugaggccguuaggccgaaaaucagau

SEQ ID NO: 7656 - RNA, 38 nt, Artificial Sequence
  Description of Artificial Sequence:  Enzymatic Nucleic Acid
aacuguaacugaugaggccguuaggccgaaaaaucaga

SEQ ID NO: 7657 - RNA, 38 nt, Artificial Sequence
  Description of Artificial Sequence:  Enzymatic Nucleic Acid
aaaacugucugaugaggccguuaggccgaaagaaauca

SEQ ID NO: 7658 - RNA, 38 nt, Artificial Sequence
  Description of Artificial Sequence:  Enzymatic Nucleic Acid
gaaaacugcugaugaggccguuaggccgaaaagaaauc

SEQ ID NO: 7659 - RNA, 38 nt, Artificial Sequence
  Description of Artificial Sequence:  Enzymatic Nucleic Acid
cacuugaacugaugaggccguuaggccgaaacuguaag

SEQ ID NO: 7660 - RNA, 38 nt, Artificial Sequence
  Description of Artificial Sequence:  Enzymatic Nucleic Acid
ccacuugacugaugaggccguuaggccgaaaacuguaa

SEQ ID NO: 7661 - RNA, 38 nt, Artificial Sequence
  Description of Artificial Sequence:  Enzymatic Nucleic Acid
gccacuugcugaugaggccguuaggccgaaaaacugua

SEQ ID NO: 7662 - RNA, 38 nt, Artificial Sequence
  Description of Artificial Sequence:  Enzymatic Nucleic Acid
ggccacuucugaugaggccguuaggccgaaaaaacugu

SEQ ID NO: 7663 - RNA, 38 nt, Artificial Sequence
  Description of Artificial Sequence:  Enzymatic Nucleic Acid
aagacaggcugaugaggccguuaggccgaaacuccaug

SEQ ID NO: 7664 - RNA, 38 nt, Artificial Sequence
  Description of Artificial Sequence:  Enzymatic Nucleic Acid
gaagacagcugaugaggccguuaggccgaaaacuccau

SEQ ID NO: 7665 - RNA, 38 nt, Artificial Sequence
  Description of Artificial Sequence:  Enzymatic Nucleic Acid
uucuggaacugaugaggccguuaggccgaaacaggaac

SEQ ID NO: 7666 - RNA, 38 nt, Artificial Sequence
  Description of Artificial Sequence:  Enzymatic Nucleic Acid
cuuucuggcugaugaggccguuaggccgaaagacagga

SEQ ID NO: 7667 - RNA, 38 nt, Artificial Sequence
  Description of Artificial Sequence:  Enzymatic Nucleic Acid
acuuucugcugaugaggccguuaggccgaaaagacagg

SEQ ID NO: 7668 - RNA, 38 nt, Artificial Sequence
  Description of Artificial Sequence:  Enzymatic Nucleic Acid
ucccgaugcugaugaggccguuaggccgaaaugcacuu

SEQ ID NO: 7669 - RNA, 38 nt, Artificial Sequence
  Description of Artificial Sequence:  Enzymatic Nucleic Acid
gucccgaucugaugaggccguuaggccgaaaaugcacu

SEQ ID NO: 7670 - RNA, 38 nt, Artificial Sequence
  Description of Artificial Sequence:  Enzymatic Nucleic Acid
cagguccccugaugaggccguuaggccgaaaugaaugc

SEQ ID NO: 7671 - RNA, 38 nt, Artificial Sequence
  Description of Artificial Sequence:  Enzymatic Nucleic Acid
gauaaaagcugaugaggccguuaggccgaaauguuucu

SEQ ID NO: 7672 - RNA, 38 nt, Artificial Sequence
  Description of Artificial Sequence:  Enzymatic Nucleic Acid
agauaaaacugaugaggccguuaggccgaaaauguuuc

SEQ ID NO: 7673 - RNA, 38 nt, Artificial Sequence
  Description of Artificial Sequence:  Enzymatic Nucleic Acid
ucagauaacugaugaggccguuaggccgaaagaauguu

SEQ ID NO: 7674 - RNA, 38 nt, Artificial Sequence
  Description of Artificial Sequence:  Enzymatic Nucleic Acid
cucagauacugaugaggccguuaggccgaaaagaaugu

SEQ ID NO: 7675 - RNA, 38 nt, Artificial Sequence
  Description of Artificial Sequence:  Enzymatic Nucleic Acid
ucucagaucugaugaggccguuaggccgaaaaagaaug

SEQ ID NO: 7676 - RNA, 38 nt, Artificial Sequence
  Description of Artificial Sequence:  Enzymatic Nucleic Acid
uucucagacugaugaggccguuaggccgaaaaaagaau

SEQ ID NO: 7677 - RNA, 38 nt, Artificial Sequence
  Description of Artificial Sequence:  Enzymatic Nucleic Acid
uguucucacugaugaggccguuaggccgaaauaaaaga

SEQ ID NO: 7678 - RNA, 38 nt, Artificial Sequence
  Description of Artificial Sequence:  Enzymatic Nucleic Acid
aaaucacacugaugaggccguuaggccgaaaucuucac

SEQ ID NO: 7679 - RNA, 38 nt, Artificial Sequence
  Description of Artificial Sequence:  Enzymatic Nucleic Acid
aaaaucaccugaugaggccguuaggccgaaaaucuuca

SEQ ID NO: 7680 - RNA, 38 nt, Artificial Sequence
  Description of Artificial Sequence:  Enzymatic Nucleic Acid
aaggccaacugaugaggccguuaggccgaaaucacaaa

SEQ ID NO: 7681 - RNA, 38 nt, Artificial Sequence
  Description of Artificial Sequence:  Enzymatic Nucleic Acid
caaggccacugaugaggccguuaggccgaaaaucacaa

SEQ ID NO: 7682 - RNA, 38 nt, Artificial Sequence
  Description of Artificial Sequence:  Enzymatic Nucleic Acid
gcaaggcccugaugaggccguuaggccgaaaaaucaca

SEQ ID NO: 7683 - RNA, 38 nt, Artificial Sequence
  Description of Artificial Sequence:  Enzymatic Nucleic Acid
ucccgggccugaugaggccguuaggccgaaaggccaaa

SEQ ID NO: 7684 - RNA, 38 nt, Artificial Sequence
  Description of Artificial Sequence:  Enzymatic Nucleic Acid
cuuauaaacugaugaggccguuaggccgaaaucccggg

SEQ ID NO: 7685 - RNA, 38 nt, Artificial Sequence
  Description of Artificial Sequence:  Enzymatic Nucleic Acid
uucuuauacugaugaggccguuaggccgaaauaucccg

SEQ ID NO: 7686 - RNA, 38 nt, Artificial Sequence
  Description of Artificial Sequence:  Enzymatic Nucleic Acid
guucuuaucugaugaggccguuaggccgaaaauauccc

SEQ ID NO: 7687 - RNA, 38 nt, Artificial Sequence
  Description of Artificial Sequence:  Enzymatic Nucleic Acid
gguucuuacugaugaggccguuaggccgaaaaauaucc

SEQ ID NO: 7688 - RNA, 38 nt, Artificial Sequence
  Description of Artificial Sequence:  Enzymatic Nucleic Acid
gggguucucugaugaggccguuaggccgaaauaaauau

SEQ ID NO: 7689 - RNA, 38 nt, Artificial Sequence
  Description of Artificial Sequence:  Enzymatic Nucleic Acid
ucucacaucugaugaggccguuaggccgaaaucggggu

SEQ ID NO: 7690 - RNA, 38 nt, Artificial Sequence
  Description of Artificial Sequence:  Enzymatic Nucleic Acid
uucucacacugaugaggccguuaggccgaaaaucgggg

SEQ ID NO: 7691 - RNA, 38 nt, Artificial Sequence
  Description of Artificial Sequence:  Enzymatic Nucleic Acid
aagucgagcugaugaggccguuaggccgaaaucuccuu

SEQ ID NO: 7692 - RNA, 38 nt, Artificial Sequence
  Description of Artificial Sequence:  Enzymatic Nucleic Acid
aggaaguccugaugaggccguuaggccgaaaguaucuc

SEQ ID NO: 7693 - RNA, 38 nt, Artificial Sequence
  Description of Artificial Sequence:  Enzymatic Nucleic Acid
uucagaggcugaugaggccguuaggccgaaagucgagu

SEQ ID NO: 7694 - RNA, 38 nt, Artificial Sequence
  Description of Artificial Sequence:  Enzymatic Nucleic Acid
uuucagagcugaugaggccguuaggccgaaaagucgag

SEQ ID NO: 7695 - RNA, 38 nt, Artificial Sequence
  Description of Artificial Sequence:  Enzymatic Nucleic Acid
ccauuucacugaugaggccguuaggccgaaaggaaguc

SEQ ID NO: 7696 - RNA, 38 nt, Artificial Sequence
  Description of Artificial Sequence:  Enzymatic Nucleic Acid
agauucggcugaugaggccguuaggccgaaagccaucc

SEQ ID NO: 7697 - RNA, 38 nt, Artificial Sequence
  Description of Artificial Sequence:  Enzymatic Nucleic Acid
caaagauacugaugaggccguuaggccgaaauucggga

SEQ ID NO: 7698 - RNA, 38 nt, Artificial Sequence
  Description of Artificial Sequence:  Enzymatic Nucleic Acid
gucaaagacugaugaggccguuaggccgaaagauucgg

SEQ ID NO: 7699 - RNA, 38 nt, Artificial Sequence
  Description of Artificial Sequence:  Enzymatic Nucleic Acid
uugucaaacugaugaggccguuaggccgaaauagauuc

SEQ ID NO: 7700 - RNA, 38 nt, Artificial Sequence
  Description of Artificial Sequence:  Enzymatic Nucleic Acid
uuuugucacugaugaggccguuaggccgaaagauagau

SEQ ID NO: 7701 - RNA, 38 nt, Artificial Sequence
  Description of Artificial Sequence:  Enzymatic Nucleic Acid
auuuuguccugaugaggccguuaggccgaaaagauaga

SEQ ID NO: 7702 - RNA, 38 nt, Artificial Sequence
  Description of Artificial Sequence:  Enzymatic Nucleic Acid
gugcuguacugaugaggccguuaggccgaaauuuuguc

SEQ ID NO: 7703 - RNA, 38 nt, Artificial Sequence
  Description of Artificial Sequence:  Enzymatic Nucleic Acid
uggugcugcugaugaggccguuaggccgaaagauuuug

SEQ ID NO: 7704 - RNA, 38 nt, Artificial Sequence
  Description of Artificial Sequence:  Enzymatic Nucleic Acid
cuccguaacugaugaggccguuaggccgaaaccacacg

SEQ ID NO: 7705 - RNA, 38 nt, Artificial Sequence
  Description of Artificial Sequence:  Enzymatic Nucleic Acid
uacuccgucugaugaggccguuaggccgaaagaccaca

SEQ ID NO: 7706 - RNA, 38 nt, Artificial Sequence
  Description of Artificial Sequence:  Enzymatic Nucleic Acid
auacuccgcugaugaggccguuaggccgaaaagaccac

SEQ ID NO: 7707 - RNA, 38 nt, Artificial Sequence
  Description of Artificial Sequence:  Enzymatic Nucleic Acid
cacagcaacugaugaggccguuaggccgaaacuccgua

SEQ ID NO: 7708 - RNA, 38 nt, Artificial Sequence
  Description of Artificial Sequence:  Enzymatic Nucleic Acid
cccacagccugaugaggccguuaggccgaaauacuccg

SEQ ID NO: 7709 - RNA, 38 nt, Artificial Sequence
  Description of Artificial Sequence:  Enzymatic Nucleic Acid
aaggagaacugaugaggccguuaggccgaaauuuccca

SEQ ID NO: 7710 - RNA, 38 nt, Artificial Sequence
  Description of Artificial Sequence:  Enzymatic Nucleic Acid
cuaaggagcugaugaggccguuaggccgaaagauuucc

SEQ ID NO: 7711 - RNA, 38 nt, Artificial Sequence
  Description of Artificial Sequence:  Enzymatic Nucleic Acid
ccuaaggacugaugaggccguuaggccgaaaagauuuc

SEQ ID NO: 7712 - RNA, 38 nt, Artificial Sequence
  Description of Artificial Sequence:  Enzymatic Nucleic Acid
caccuaagcugaugaggccguuaggccgaaagaagauu

SEQ ID NO: 7713 - RNA, 38 nt, Artificial Sequence
  Description of Artificial Sequence:  Enzymatic Nucleic Acid
acccaccucugaugaggccguuaggccgaaaggagaag

SEQ ID NO: 7714 - RNA, 38 nt, Artificial Sequence
  Description of Artificial Sequence:  Enzymatic Nucleic Acid
gacccacccugaugaggccguuaggccgaaaaggagaa

SEQ ID NO: 7715 - RNA, 38 nt, Artificial Sequence
  Description of Artificial Sequence:  Enzymatic Nucleic Acid
gguauggacugaugaggccguuaggccgaaacccaccu

SEQ ID NO: 7716 - RNA, 38 nt, Artificial Sequence
  Description of Artificial Sequence:  Enzymatic Nucleic Acid
uggguaugcugaugaggccguuaggccgaaagacccac

SEQ ID NO: 7717 - RNA, 38 nt, Artificial Sequence
  Description of Artificial Sequence:  Enzymatic Nucleic Acid
cuccugggcugaugaggccguuaggccgaaauggagac

SEQ ID NO: 7718 - RNA, 38 nt, Artificial Sequence
  Description of Artificial Sequence:  Enzymatic Nucleic Acid
uccauuugcugaugaggccguuaggccgaaacuccugg

SEQ ID NO: 7719 - RNA, 38 nt, Artificial Sequence
  Description of Artificial Sequence:  Enzymatic Nucleic Acid
gacugcaacugaugaggccguuaggccgaaaguccuca

SEQ ID NO: 7720 - RNA, 38 nt, Artificial Sequence
  Description of Artificial Sequence:  Enzymatic Nucleic Acid
cgacugcacugaugaggccguuaggccgaaaaguccuc

SEQ ID NO: 7721 - RNA, 38 nt, Artificial Sequence
  Description of Artificial Sequence:  Enzymatic Nucleic Acid
gcgacugccugaugaggccguuaggccgaaaaaguccu

SEQ ID NO: 7722 - RNA, 38 nt, Artificial Sequence
  Description of Artificial Sequence:  Enzymatic Nucleic Acid
ccucaggccugaugaggccguuaggccgaaacugcaaa

SEQ ID NO: 7723 - RNA, 38 nt, Artificial Sequence
  Description of Artificial Sequence:  Enzymatic Nucleic Acid
guacucagcugaugaggccguuaggccgaaagcucuca

SEQ ID NO: 7724 - RNA, 38 nt, Artificial Sequence
  Description of Artificial Sequence:  Enzymatic Nucleic Acid
gaguagagcugaugaggccguuaggccgaaacucagga

SEQ ID NO: 7725 - RNA, 38 nt, Artificial Sequence
  Description of Artificial Sequence:  Enzymatic Nucleic Acid
caggaguacugaugaggccguuaggccgaaaguacuca

SEQ ID NO: 7726 - RNA, 38 nt, Artificial Sequence
  Description of Artificial Sequence:  Enzymatic Nucleic Acid
uucaggagcugaugaggccguuaggccgaaagaguacu

SEQ ID NO: 7727 - RNA, 38 nt, Artificial Sequence
  Description of Artificial Sequence:  Enzymatic Nucleic Acid
gauuucagcugaugaggccguuaggccgaaaguagagu

SEQ ID NO: 7728 - RNA, 38 nt, Artificial Sequence
  Description of Artificial Sequence:  Enzymatic Nucleic Acid
aucugauacugaugaggccguuaggccgaaauuucagg

SEQ ID NO: 7729 - RNA, 38 nt, Artificial Sequence
  Description of Artificial Sequence:  Enzymatic Nucleic Acid
ugaucugacugaugaggccguuaggccgaaagauuuca

SEQ ID NO: 7730 - RNA, 38 nt, Artificial Sequence
  Description of Artificial Sequence:  Enzymatic Nucleic Acid
caugaucucugaugaggccguuaggccgaaauagauuu

SEQ ID NO: 7731 - RNA, 38 nt, Artificial Sequence
  Description of Artificial Sequence:  Enzymatic Nucleic Acid
uccagcaucugaugaggccguuaggccgaaaucugaua

SEQ ID NO: 7732 - RNA, 38 nt, Artificial Sequence
  Description of Artificial Sequence:  Enzymatic Nucleic Acid
guucugcacugaugaggccguuaggccgaaaucuuggc

SEQ ID NO: 7733 - RNA, 38 nt, Artificial Sequence
  Description of Artificial Sequence:  Enzymatic Nucleic Acid
aguucugccugaugaggccguuaggccgaaaaucuugg

SEQ ID NO: 7734 - RNA, 38 nt, Artificial Sequence
  Description of Artificial Sequence:  Enzymatic Nucleic Acid
uuuuccaccugaugaggccguuaggccgaaaguucugc

SEQ ID NO: 7735 - RNA, 38 nt, Artificial Sequence
  Description of Artificial Sequence:  Enzymatic Nucleic Acid
aaaucacccugaugaggccguuaggccgaaaguuuuuc

SEQ ID NO: 7736 - RNA, 38 nt, Artificial Sequence
  Description of Artificial Sequence:  Enzymatic Nucleic Acid
uugaagcacugaugaggccguuaggccgaaaucaccua

SEQ ID NO: 7737 - RNA, 38 nt, Artificial Sequence
  Description of Artificial Sequence:  Enzymatic Nucleic Acid
cuugaagccugaugaggccguuaggccgaaaaucaccu

SEQ ID NO: 7738 - RNA, 38 nt, Artificial Sequence
  Description of Artificial Sequence:  Enzymatic Nucleic Acid
uuugcuugcugaugaggccguuaggccgaaagcaaauc

SEQ ID NO: 7739 - RNA, 38 nt, Artificial Sequence
  Description of Artificial Sequence:  Enzymatic Nucleic Acid
auuugcuucugaugaggccguuaggccgaaaagcaaau

SEQ ID NO: 7740 - RNA, 38 nt, Artificial Sequence
  Description of Artificial Sequence:  Enzymatic Nucleic Acid
uccuguugcugaugaggccguuaggccgaaacauuugc

SEQ ID NO: 7741 - RNA, 38 nt, Artificial Sequence
  Description of Artificial Sequence:  Enzymatic Nucleic Acid
guagucuucugaugaggccguuaggccgaaaccauccu

SEQ ID NO: 7742 - RNA, 38 nt, Artificial Sequence
  Description of Artificial Sequence:  Enzymatic Nucleic Acid
uugggaugcugaugaggccguuaggccgaaagucuuua

SEQ ID NO: 7743 - RNA, 38 nt, Artificial Sequence
  Description of Artificial Sequence:  Enzymatic Nucleic Acid
uugauuggcugaugaggccguuaggccgaaauguaguc

SEQ ID NO: 7744 - RNA, 38 nt, Artificial Sequence
  Description of Artificial Sequence:  Enzymatic Nucleic Acid
auggcauucugaugaggccguuaggccgaaauugggau

SEQ ID NO: 7745 - RNA, 38 nt, Artificial Sequence
  Description of Artificial Sequence:  Enzymatic Nucleic Acid
ccugucagcugaugaggccguuaggccgaaauggcauu

SEQ ID NO: 7746 - RNA, 38 nt, Artificial Sequence
  Description of Artificial Sequence:  Enzymatic Nucleic Acid
aaacccaccugaugaggccguuaggccgaaauuuccug

SEQ ID NO: 7747 - RNA, 38 nt, Artificial Sequence
  Description of Artificial Sequence:  Enzymatic Nucleic Acid
aguauguacugaugaggccguuaggccgaaacccacua

SEQ ID NO: 7748 - RNA, 38 nt, Artificial Sequence
  Description of Artificial Sequence:  Enzymatic Nucleic Acid
gaguaugucugaugaggccguuaggccgaaaacccacu

SEQ ID NO: 7749 - RNA, 38 nt, Artificial Sequence
  Description of Artificial Sequence:  Enzymatic Nucleic Acid
ugaguaugcugaugaggccguuaggccgaaaaacccac

SEQ ID NO: 7750 - RNA, 38 nt, Artificial Sequence
  Description of Artificial Sequence:  Enzymatic Nucleic Acid
gaguugagcugaugaggccguuaggccgaaauguaaac

SEQ ID NO: 7751 - RNA, 38 nt, Artificial Sequence
  Description of Artificial Sequence:  Enzymatic Nucleic Acid
caggaguucugaugaggccguuaggccgaaaguaugua

SEQ ID NO: 7752 - RNA, 38 nt, Artificial Sequence
  Description of Artificial Sequence:  Enzymatic Nucleic Acid
gaaggcagcugaugaggccguuaggccgaaaguugagu

SEQ ID NO: 7753 - RNA, 38 nt, Artificial Sequence
  Description of Artificial Sequence:  Enzymatic Nucleic Acid
ccucagagcugaugaggccguuaggccgaaaggcagga

SEQ ID NO: 7754 - RNA, 38 nt, Artificial Sequence
  Description of Artificial Sequence:  Enzymatic Nucleic Acid
uccucagacugaugaggccguuaggccgaaaaggcagg

SEQ ID NO: 7755 - RNA, 38 nt, Artificial Sequence
  Description of Artificial Sequence:  Enzymatic Nucleic Acid
aguccucacugaugaggccguuaggccgaaagaaggca

SEQ ID NO: 7756 - RNA, 38 nt, Artificial Sequence
  Description of Artificial Sequence:  Enzymatic Nucleic Acid
ccuugaagcugaugaggccguuaggccgaaaguccuca

SEQ ID NO: 7757 - RNA, 38 nt, Artificial Sequence
  Description of Artificial Sequence:  Enzymatic Nucleic Acid
uccuugaacugaugaggccguuaggccgaaaaguccuc

SEQ ID NO: 7758 - RNA, 38 nt, Artificial Sequence
  Description of Artificial Sequence:  Enzymatic Nucleic Acid
uuuccuugcugaugaggccguuaggccgaaagaagucc

SEQ ID NO: 7759 - RNA, 38 nt, Artificial Sequence
  Description of Artificial Sequence:  Enzymatic Nucleic Acid
cuuuccuucugaugaggccguuaggccgaaaagaaguc

SEQ ID NO: 7760 - RNA, 38 nt, Artificial Sequence
  Description of Artificial Sequence:  Enzymatic Nucleic Acid
agcugaaacugaugaggccguuaggccgaaacuuuccu

SEQ ID NO: 7761 - RNA, 38 nt, Artificial Sequence
  Description of Artificial Sequence:  Enzymatic Nucleic Acid
ggagcugacugaugaggccguuaggccgaaauacuuuc

SEQ ID NO: 7762 - RNA, 38 nt, Artificial Sequence
  Description of Artificial Sequence:  Enzymatic Nucleic Acid
cggagcugcugaugaggccguuaggccgaaaauacuuu

SEQ ID NO: 7763 - RNA, 38 nt, Artificial Sequence
  Description of Artificial Sequence:  Enzymatic Nucleic Acid
ucggagcucugaugaggccguuaggccgaaaaauacuu

SEQ ID NO: 7764 - RNA, 38 nt, Artificial Sequence
  Description of Artificial Sequence:  Enzymatic Nucleic Acid
aaacuucgcugaugaggccguuaggccgaaagcugaaa

SEQ ID NO: 7765 - RNA, 38 nt, Artificial Sequence
  Description of Artificial Sequence:  Enzymatic Nucleic Acid
cugaauuacugaugaggccguuaggccgaaacuucgga

SEQ ID NO: 7766 - RNA, 38 nt, Artificial Sequence
  Description of Artificial Sequence:  Enzymatic Nucleic Acid
ccugaauucugaugaggccguuaggccgaaaacuucgg

SEQ ID NO: 7767 - RNA, 38 nt, Artificial Sequence
  Description of Artificial Sequence:  Enzymatic Nucleic Acid
uccugaaucugaugaggccguuaggccgaaaaacuucg

SEQ ID NO: 7768 - RNA, 38 nt, Artificial Sequence
  Description of Artificial Sequence:  Enzymatic Nucleic Acid
gcuuccugcugaugaggccguuaggccgaaauuaaacu

SEQ ID NO: 7769 - RNA, 38 nt, Artificial Sequence
  Description of Artificial Sequence:  Enzymatic Nucleic Acid
agcuuccucugaugaggccguuaggccgaaaauuaaac

SEQ ID NO: 7770 - RNA, 38 nt, Artificial Sequence
  Description of Artificial Sequence:  Enzymatic Nucleic Acid
caucaucacugaugaggccguuaggccgaaagcuuccu

SEQ ID NO: 7771 - RNA, 38 nt, Artificial Sequence
  Description of Artificial Sequence:  Enzymatic Nucleic Acid
acauaucucugaugaggccguuaggccgaaacaucauc

SEQ ID NO: 7772 - RNA, 38 nt, Artificial Sequence
  Description of Artificial Sequence:  Enzymatic Nucleic Acid
cauuuacacugaugaggccguuaggccgaaaucugaca

SEQ ID NO: 7773 - RNA, 38 nt, Artificial Sequence
  Description of Artificial Sequence:  Enzymatic Nucleic Acid
aaagcauucugaugaggccguuaggccgaaacauaucu

SEQ ID NO: 7774 - RNA, 38 nt, Artificial Sequence
  Description of Artificial Sequence:  Enzymatic Nucleic Acid
gaacuugacugaugaggccguuaggccgaaagcauuua

SEQ ID NO: 7775 - RNA, 38 nt, Artificial Sequence
  Description of Artificial Sequence:  Enzymatic Nucleic Acid
ugaacuugcugaugaggccguuaggccgaaaagcauuu

SEQ ID NO: 7776 - RNA, 38 nt, Artificial Sequence
  Description of Artificial Sequence:  Enzymatic Nucleic Acid
augaacuucugaugaggccguuaggccgaaaaagcauu

SEQ ID NO: 7777 - RNA, 38 nt, Artificial Sequence
  Description of Artificial Sequence:  Enzymatic Nucleic Acid
ggcucaugcugaugaggccguuaggccgaaacuugaaa

SEQ ID NO: 7778 - RNA, 38 nt, Artificial Sequence
  Description of Artificial Sequence:  Enzymatic Nucleic Acid
aggcucaucugaugaggccguuaggccgaaaacuugaa

SEQ ID NO: 7779 - RNA, 38 nt, Artificial Sequence
  Description of Artificial Sequence:  Enzymatic Nucleic Acid
aagguuuucugaugaggccguuaggccgaaauucuuuc

SEQ ID NO: 7780 - RNA, 38 nt, Artificial Sequence
  Description of Artificial Sequence:  Enzymatic Nucleic Acid
guucuucacugaugaggccguuaggccgaaagguuuug

SEQ ID NO: 7781 - RNA, 38 nt, Artificial Sequence
  Description of Artificial Sequence:  Enzymatic Nucleic Acid
aguucuuccugaugaggccguuaggccgaaaagguuuu

SEQ ID NO: 7782 - RNA, 38 nt, Artificial Sequence
  Description of Artificial Sequence:  Enzymatic Nucleic Acid
uucgguaacugaugaggccguuaggccgaaaguucuuc

SEQ ID NO: 7783 - RNA, 38 nt, Artificial Sequence
  Description of Artificial Sequence:  Enzymatic Nucleic Acid
auucgguacugaugaggccguuaggccgaaaaguucuu

SEQ ID NO: 7784 - RNA, 38 nt, Artificial Sequence
  Description of Artificial Sequence:  Enzymatic Nucleic Acid
cauucggucugaugaggccguuaggccgaaaaaguucu

SEQ ID NO: 7785 - RNA, 38 nt, Artificial Sequence
  Description of Artificial Sequence:  Enzymatic Nucleic Acid
gcauucggcugaugaggccguuaggccgaaaaaaguuc

SEQ ID NO: 7786 - RNA, 38 nt, Artificial Sequence
  Description of Artificial Sequence:  Enzymatic Nucleic Acid
caaacaugcugaugaggccguuaggccgaaagguggca

SEQ ID NO: 7787 - RNA, 38 nt, Artificial Sequence
  Description of Artificial Sequence:  Enzymatic Nucleic Acid
agucaucacugaugaggccguuaggccgaaacauggag

SEQ ID NO: 7788 - RNA, 38 nt, Artificial Sequence
  Description of Artificial Sequence:  Enzymatic Nucleic Acid
uagucauccugaugaggccguuaggccgaaaacaugga

SEQ ID NO: 7789 - RNA, 38 nt, Artificial Sequence
  Description of Artificial Sequence:  Enzymatic Nucleic Acid
cgcccuggcugaugaggccguuaggccgaaagucauca

SEQ ID NO: 7790 - RNA, 38 nt, Artificial Sequence
  Description of Artificial Sequence:  Enzymatic Nucleic Acid
ggccaacacugaugaggccguuaggccgaaagugcugc

SEQ ID NO: 7791 - RNA, 38 nt, Artificial Sequence
  Description of Artificial Sequence:  Enzymatic Nucleic Acid
gagaggcccugaugaggccguuaggccgaaacagagug

SEQ ID NO: 7792 - RNA, 38 nt, Artificial Sequence
  Description of Artificial Sequence:  Enzymatic Nucleic Acid
gcaugggacugaugaggccguuaggccgaaaggccaac

SEQ ID NO: 7793 - RNA, 38 nt, Artificial Sequence
  Description of Artificial Sequence:  Enzymatic Nucleic Acid
cagcauggcugaugaggccguuaggccgaaagaggcca

SEQ ID NO: 7794 - RNA, 38 nt, Artificial Sequence
  Description of Artificial Sequence:  Enzymatic Nucleic Acid
uccaggugcugaugaggccguuaggccgaaagcgcuuc

SEQ ID NO: 7795 - RNA, 38 nt, Artificial Sequence
  Description of Artificial Sequence:  Enzymatic Nucleic Acid
guccaggucugaugaggccguuaggccgaaaagcgcuu

SEQ ID NO: 7796 - RNA, 38 nt, Artificial Sequence
  Description of Artificial Sequence:  Enzymatic Nucleic Acid
ucuugagccugaugaggccguuaggccgaaaggccuug

SEQ ID NO: 7797 - RNA, 38 nt, Artificial Sequence
  Description of Artificial Sequence:  Enzymatic Nucleic Acid
ucaaucuucugaugaggccguuaggccgaaagcgaggc

SEQ ID NO: 7798 - RNA, 38 nt, Artificial Sequence
  Description of Artificial Sequence:  Enzymatic Nucleic Acid
cucaaguccugaugaggccguuaggccgaaaucuugag

SEQ ID NO: 7799 - RNA, 38 nt, Artificial Sequence
  Description of Artificial Sequence:  Enzymatic Nucleic Acid
uuacucuccugaugaggccguuaggccgaaagucaauc

SEQ ID NO: 7800 - RNA, 38 nt, Artificial Sequence
  Description of Artificial Sequence:  Enzymatic Nucleic Acid
uuacuggucugaugaggccguuaggccgaaacucucaa

SEQ ID NO: 7801 - RNA, 38 nt, Artificial Sequence
  Description of Artificial Sequence:  Enzymatic Nucleic Acid
cuuacuuucugaugaggccguuaggccgaaacugguua

SEQ ID NO: 7802 - RNA, 38 nt, Artificial Sequence
  Description of Artificial Sequence:  Enzymatic Nucleic Acid
cgacuccucugaugaggccguuaggccgaaacuuuuac

SEQ ID NO: 7803 - RNA, 38 nt, Artificial Sequence
  Description of Artificial Sequence:  Enzymatic Nucleic Acid
acagcccccugaugaggccguuaggccgaaacuccuua

SEQ ID NO: 7804 - RNA, 38 nt, Artificial Sequence
  Description of Artificial Sequence:  Enzymatic Nucleic Acid
ugacaucacugaugaggccguuaggccgaaacagcccc

SEQ ID NO: 7805 - RNA, 38 nt, Artificial Sequence
  Description of Artificial Sequence:  Enzymatic Nucleic Acid
ggccugcucugaugaggccguuaggccgaaacaucaga

SEQ ID NO: 7806 - RNA, 38 nt, Artificial Sequence
  Description of Artificial Sequence:  Enzymatic Nucleic Acid
auggcagacugaugaggccguuaggccgaaacugggcc

SEQ ID NO: 7807 - RNA, 38 nt, Artificial Sequence
  Description of Artificial Sequence:  Enzymatic Nucleic Acid
aauggcagcugaugaggccguuaggccgaaaacugggc

SEQ ID NO: 7808 - RNA, 38 nt, Artificial Sequence
  Description of Artificial Sequence:  Enzymatic Nucleic Acid
gaauggcacugaugaggccguuaggccgaaaaacuggg

SEQ ID NO: 7809 - RNA, 38 nt, Artificial Sequence
  Description of Artificial Sequence:  Enzymatic Nucleic Acid
acagcuggcugaugaggccguuaggccgaaauggcaga

SEQ ID NO: 7810 - RNA, 38 nt, Artificial Sequence
  Description of Artificial Sequence:  Enzymatic Nucleic Acid
cacagcugcugaugaggccguuaggccgaaaauggcag

SEQ ID NO: 7811 - RNA, 38 nt, Artificial Sequence
  Description of Artificial Sequence:  Enzymatic Nucleic Acid
ccuucgcucugaugaggccguuaggccgaaacgugccc

SEQ ID NO: 7812 - RNA, 38 nt, Artificial Sequence
  Description of Artificial Sequence:  Enzymatic Nucleic Acid
cguaggugcugaugaggccguuaggccgaaaccugcgc

SEQ ID NO: 7813 - RNA, 38 nt, Artificial Sequence
  Description of Artificial Sequence:  Enzymatic Nucleic Acid
ucguaggucugaugaggccguuaggccgaaaaccugcg

SEQ ID NO: 7814 - RNA, 38 nt, Artificial Sequence
  Description of Artificial Sequence:  Enzymatic Nucleic Acid
cguggucgcugaugaggccguuaggccgaaaggugaac

SEQ ID NO: 7815 - RNA, 38 nt, Artificial Sequence
  Description of Artificial Sequence:  Enzymatic Nucleic Acid
cagcacgccugaugaggccguuaggccgaaauuuuccu

SEQ ID NO: 7816 - RNA, 38 nt, Artificial Sequence
  Description of Artificial Sequence:  Enzymatic Nucleic Acid
ggggcgggcugaugaggccguuaggccgaaagcagcac

SEQ ID NO: 7817 - RNA, 38 nt, Artificial Sequence
  Description of Artificial Sequence:  Enzymatic Nucleic Acid
ccgaguugcugaugaggccguuaggccgaaagucuggg

SEQ ID NO: 7818 - RNA, 38 nt, Artificial Sequence
  Description of Artificial Sequence:  Enzymatic Nucleic Acid
ggaccacccugaugaggccguuaggccgaaaguuguag

SEQ ID NO: 7819 - RNA, 38 nt, Artificial Sequence
  Description of Artificial Sequence:  Enzymatic Nucleic Acid
gaguacagcugaugaggccguuaggccgaaaccaccga

SEQ ID NO: 7820 - RNA, 38 nt, Artificial Sequence
  Description of Artificial Sequence:  Enzymatic Nucleic Acid
ggguggagcugaugaggccguuaggccgaaacaggacc

SEQ ID NO: 7821 - RNA, 38 nt, Artificial Sequence
  Description of Artificial Sequence:  Enzymatic Nucleic Acid
guggggugcugaugaggccguuaggccgaaaguacagg

SEQ ID NO: 7822 - RNA, 38 nt, Artificial Sequence
  Description of Artificial Sequence:  Enzymatic Nucleic Acid
aaacucuacugaugaggccguuaggccgaaaugggugg

SEQ ID NO: 7823 - RNA, 38 nt, Artificial Sequence
  Description of Artificial Sequence:  Enzymatic Nucleic Acid
ucaaacuccugaugaggccguuaggccgaaagaugggu

SEQ ID NO: 7824 - RNA, 38 nt, Artificial Sequence
  Description of Artificial Sequence:  Enzymatic Nucleic Acid
ucgugucacugaugaggccguuaggccgaaacucuaga

SEQ ID NO: 7825 - RNA, 38 nt, Artificial Sequence
  Description of Artificial Sequence:  Enzymatic Nucleic Acid
uucguguccugaugaggccguuaggccgaaaacucuag

SEQ ID NO: 7826 - RNA, 38 nt, Artificial Sequence
  Description of Artificial Sequence:  Enzymatic Nucleic Acid
cuagaaaucugaugaggccguuaggccgaaaggcuucg

SEQ ID NO: 7827 - RNA, 38 nt, Artificial Sequence
  Description of Artificial Sequence:  Enzymatic Nucleic Acid
ucuagaaacugaugaggccguuaggccgaaaaggcuuc

SEQ ID NO: 7828 - RNA, 38 nt, Artificial Sequence
  Description of Artificial Sequence:  Enzymatic Nucleic Acid
cuucuagacugaugaggccguuaggccgaaauaaggcu

SEQ ID NO: 7829 - RNA, 38 nt, Artificial Sequence
  Description of Artificial Sequence:  Enzymatic Nucleic Acid
gcuucuagcugaugaggccguuaggccgaaaauaaggc

SEQ ID NO: 7830 - RNA, 38 nt, Artificial Sequence
  Description of Artificial Sequence:  Enzymatic Nucleic Acid
ugcuucuacugaugaggccguuaggccgaaaaauaagg

SEQ ID NO: 7831 - RNA, 38 nt, Artificial Sequence
  Description of Artificial Sequence:  Enzymatic Nucleic Acid
ugugcuuccugaugaggccguuaggccgaaagaaauaa

SEQ ID NO: 7832 - RNA, 38 nt, Artificial Sequence
  Description of Artificial Sequence:  Enzymatic Nucleic Acid
gguauaaacugaugaggccguuaggccgaaacacaugu

SEQ ID NO: 7833 - RNA, 38 nt, Artificial Sequence
  Description of Artificial Sequence:  Enzymatic Nucleic Acid
gggguauacugaugaggccguuaggccgaaauacacau

SEQ ID NO: 7834 - RNA, 38 nt, Artificial Sequence
  Description of Artificial Sequence:  Enzymatic Nucleic Acid
ggggguaucugaugaggccguuaggccgaaaauacaca

SEQ ID NO: 7835 - RNA, 38 nt, Artificial Sequence
  Description of Artificial Sequence:  Enzymatic Nucleic Acid
uggggguacugaugaggccguuaggccgaaaaauacac

SEQ ID NO: 7836 - RNA, 38 nt, Artificial Sequence
  Description of Artificial Sequence:  Enzymatic Nucleic Acid
ccugggggcugaugaggccguuaggccgaaauaaauac

SEQ ID NO: 7837 - RNA, 38 nt, Artificial Sequence
  Description of Artificial Sequence:  Enzymatic Nucleic Acid
gcaaaagccugaugaggccguuaggccgaaaguuuccu

SEQ ID NO: 7838 - RNA, 38 nt, Artificial Sequence
  Description of Artificial Sequence:  Enzymatic Nucleic Acid
acuggcaacugaugaggccguuaggccgaaagcuaguu

SEQ ID NO: 7839 - RNA, 38 nt, Artificial Sequence
  Description of Artificial Sequence:  Enzymatic Nucleic Acid
uacuggcacugaugaggccguuaggccgaaaagcuagu

SEQ ID NO: 7840 - RNA, 38 nt, Artificial Sequence
  Description of Artificial Sequence:  Enzymatic Nucleic Acid
auacuggccugaugaggccguuaggccgaaaaagcuag

SEQ ID NO: 7841 - RNA, 38 nt, Artificial Sequence
  Description of Artificial Sequence:  Enzymatic Nucleic Acid
augcauaacugaugaggccguuaggccgaaacuggcaa

SEQ ID NO: 7842 - RNA, 38 nt, Artificial Sequence
  Description of Artificial Sequence:  Enzymatic Nucleic Acid
auaugcaucugaugaggccguuaggccgaaauacuggc

SEQ ID NO: 7843 - RNA, 38 nt, Artificial Sequence
  Description of Artificial Sequence:  Enzymatic Nucleic Acid
uauaugcacugaugaggccguuaggccgaaaauacugg

SEQ ID NO: 7844 - RNA, 38 nt, Artificial Sequence
  Description of Artificial Sequence:  Enzymatic Nucleic Acid
aacuuauacugaugaggccguuaggccgaaaugcauaa

SEQ ID NO: 7845 - RNA, 38 nt, Artificial Sequence
  Description of Artificial Sequence:  Enzymatic Nucleic Acid
uaaacuuacugaugaggccguuaggccgaaauaugcau

SEQ ID NO: 7846 - RNA, 38 nt, Artificial Sequence
  Description of Artificial Sequence:  Enzymatic Nucleic Acid
uguaaacucugaugaggccguuaggccgaaauauaugc

SEQ ID NO: 7847 - RNA, 38 nt, Artificial Sequence
  Description of Artificial Sequence:  Enzymatic Nucleic Acid
aagguguacugaugaggccguuaggccgaaacuuauau

SEQ ID NO: 7848 - RNA, 38 nt, Artificial Sequence
  Description of Artificial Sequence:  Enzymatic Nucleic Acid
aaaggugucugaugaggccguuaggccgaaaacuuaua

SEQ ID NO: 7849 - RNA, 38 nt, Artificial Sequence
  Description of Artificial Sequence:  Enzymatic Nucleic Acid
uaaaggugcugaugaggccguuaggccgaaaaacuuau

SEQ ID NO: 7850 - RNA, 38 nt, Artificial Sequence
  Description of Artificial Sequence:  Enzymatic Nucleic Acid
gaaagauacugaugaggccguuaggccgaaagguguaa

SEQ ID NO: 7851 - RNA, 38 nt, Artificial Sequence
  Description of Artificial Sequence:  Enzymatic Nucleic Acid
ggaaagaucugaugaggccguuaggccgaaaaggugua

SEQ ID NO: 7852 - RNA, 38 nt, Artificial Sequence
  Description of Artificial Sequence:  Enzymatic Nucleic Acid
uggaaagacugaugaggccguuaggccgaaaaaggugu

SEQ ID NO: 7853 - RNA, 38 nt, Artificial Sequence
  Description of Artificial Sequence:  Enzymatic Nucleic Acid
cauggaaacugaugaggccguuaggccgaaauaaaggu

SEQ ID NO: 7854 - RNA, 38 nt, Artificial Sequence
  Description of Artificial Sequence:  Enzymatic Nucleic Acid
cccauggacugaugaggccguuaggccgaaagauaaag

SEQ ID NO: 7855 - RNA, 38 nt, Artificial Sequence
  Description of Artificial Sequence:  Enzymatic Nucleic Acid
ucccauggcugaugaggccguuaggccgaaaagauaaa

SEQ ID NO: 7856 - RNA, 38 nt, Artificial Sequence
  Description of Artificial Sequence:  Enzymatic Nucleic Acid
cucccaugcugaugaggccguuaggccgaaaaagauaa

SEQ ID NO: 7857 - RNA, 38 nt, Artificial Sequence
  Description of Artificial Sequence:  Enzymatic Nucleic Acid
aucacaaacugaugaggccguuaggccgaaagcagcug

SEQ ID NO: 7858 - RNA, 38 nt, Artificial Sequence
  Description of Artificial Sequence:  Enzymatic Nucleic Acid
aaucacaacugaugaggccguuaggccgaaaagcagcu

SEQ ID NO: 7859 - RNA, 38 nt, Artificial Sequence
  Description of Artificial Sequence:  Enzymatic Nucleic Acid
aaaucacacugaugaggccguuaggccgaaaaagcagc

SEQ ID NO: 7860 - RNA, 38 nt, Artificial Sequence
  Description of Artificial Sequence:  Enzymatic Nucleic Acid
aaaaucaccugaugaggccguuaggccgaaaaaagcag

SEQ ID NO: 7861 - RNA, 38 nt, Artificial Sequence
  Description of Artificial Sequence:  Enzymatic Nucleic Acid
auuaaaaacugaugaggccguuaggccgaaaucacaaa

SEQ ID NO: 7862 - RNA, 38 nt, Artificial Sequence
  Description of Artificial Sequence:  Enzymatic Nucleic Acid
uauuaaaacugaugaggccguuaggccgaaaaucacaa

SEQ ID NO: 7863 - RNA, 38 nt, Artificial Sequence
  Description of Artificial Sequence:  Enzymatic Nucleic Acid
cuauuaaacugaugaggccguuaggccgaaaaaucaca

SEQ ID NO: 7864 - RNA, 38 nt, Artificial Sequence
  Description of Artificial Sequence:  Enzymatic Nucleic Acid
acuauuaacugaugaggccguuaggccgaaaaaaucac

SEQ ID NO: 7865 - RNA, 38 nt, Artificial Sequence
  Description of Artificial Sequence:  Enzymatic Nucleic Acid
cacuauuacugaugaggccguuaggccgaaaaaaauca

SEQ ID NO: 7866 - RNA, 38 nt, Artificial Sequence
  Description of Artificial Sequence:  Enzymatic Nucleic Acid
gcacuauucugaugaggccguuaggccgaaaaaaaauc

SEQ ID NO: 7867 - RNA, 38 nt, Artificial Sequence
  Description of Artificial Sequence:  Enzymatic Nucleic Acid
agcacuaucugaugaggccguuaggccgaaaaaaaaau

SEQ ID NO: 7868 - RNA, 38 nt, Artificial Sequence
  Description of Artificial Sequence:  Enzymatic Nucleic Acid
aaaagcaccugaugaggccguuaggccgaaauuaaaaa

SEQ ID NO: 7869 - RNA, 38 nt, Artificial Sequence
  Description of Artificial Sequence:  Enzymatic Nucleic Acid
aaaaaaaacugaugaggccguuaggccgaaagcacuau

SEQ ID NO: 7870 - RNA, 38 nt, Artificial Sequence
  Description of Artificial Sequence:  Enzymatic Nucleic Acid
aaaaaaaacugaugaggccguuaggccgaaaagcacua

SEQ ID NO: 7871 - RNA, 38 nt, Artificial Sequence
  Description of Artificial Sequence:  Enzymatic Nucleic Acid
caaaaaaacugaugaggccguuaggccgaaaaagcacu

SEQ ID NO: 7872 - RNA, 38 nt, Artificial Sequence
  Description of Artificial Sequence:  Enzymatic Nucleic Acid
ucaaaaaacugaugaggccguuaggccgaaaaaagcac

SEQ ID NO: 7873 - RNA, 38 nt, Artificial Sequence
  Description of Artificial Sequence:  Enzymatic Nucleic Acid
gucaaaaacugaugaggccguuaggccgaaaaaaagca

SEQ ID NO: 7874 - RNA, 38 nt, Artificial Sequence
  Description of Artificial Sequence:  Enzymatic Nucleic Acid
agucaaaacugaugaggccguuaggccgaaaaaaaagc

SEQ ID NO: 7875 - RNA, 38 nt, Artificial Sequence
  Description of Artificial Sequence:  Enzymatic Nucleic Acid
uagucaaacugaugaggccguuaggccgaaaaaaaaag

SEQ ID NO: 7876 - RNA, 38 nt, Artificial Sequence
  Description of Artificial Sequence:  Enzymatic Nucleic Acid
uuagucaacugaugaggccguuaggccgaaaaaaaaaa

SEQ ID NO: 7877 - RNA, 38 nt, Artificial Sequence
  Description of Artificial Sequence:  Enzymatic Nucleic Acid
guuagucacugaugaggccguuaggccgaaaaaaaaaa

SEQ ID NO: 7878 - RNA, 38 nt, Artificial Sequence
  Description of Artificial Sequence:  Enzymatic Nucleic Acid
uguuaguccugaugaggccguuaggccgaaaaaaaaaa

SEQ ID NO: 7879 - RNA, 38 nt, Artificial Sequence
  Description of Artificial Sequence:  Enzymatic Nucleic Acid
auucuugucugaugaggccguuaggccgaaagucaaaa

SEQ ID NO: 7880 - RNA, 38 nt, Artificial Sequence
  Description of Artificial Sequence:  Enzymatic Nucleic Acid
ucuggagucugaugaggccguuaggccgaaacauucuu

SEQ ID NO: 7881 - RNA, 38 nt, Artificial Sequence
  Description of Artificial Sequence:  Enzymatic Nucleic Acid
ucuaucugcugaugaggccguuaggccgaaaguuacau

SEQ ID NO: 7882 - RNA, 38 nt, Artificial Sequence
  Description of Artificial Sequence:  Enzymatic Nucleic Acid
uauuucuccugaugaggccguuaggccgaaaucuggag

SEQ ID NO: 7883 - RNA, 38 nt, Artificial Sequence
  Description of Artificial Sequence:  Enzymatic Nucleic Acid
cuugucaccugaugaggccguuaggccgaaauuucucu

SEQ ID NO: 7884 - RNA, 38 nt, Artificial Sequence
  Description of Artificial Sequence:  Enzymatic Nucleic Acid
uuuagcagcugaugaggccguuaggccgaaaguguucu

SEQ ID NO: 7885 - RNA, 38 nt, Artificial Sequence
  Description of Artificial Sequence:  Enzymatic Nucleic Acid
ugaggauucugaugaggccguuaggccgaaagcaguag

SEQ ID NO: 7886 - RNA, 38 nt, Artificial Sequence
  Description of Artificial Sequence:  Enzymatic Nucleic Acid
aacaugagcugaugaggccguuaggccgaaauuuagca

SEQ ID NO: 7887 - RNA, 38 nt, Artificial Sequence
  Description of Artificial Sequence:  Enzymatic Nucleic Acid
aguaacaucugaugaggccguuaggccgaaaggauuua

SEQ ID NO: 7888 - RNA, 38 nt, Artificial Sequence
  Description of Artificial Sequence:  Enzymatic Nucleic Acid
cacugagucugaugaggccguuaggccgaaacaugagg

SEQ ID NO: 7889 - RNA, 38 nt, Artificial Sequence
  Description of Artificial Sequence:  Enzymatic Nucleic Acid
acacugagcugaugaggccguuaggccgaaaacaugag

SEQ ID NO: 7890 - RNA, 38 nt, Artificial Sequence
  Description of Artificial Sequence:  Enzymatic Nucleic Acid
cuaacacucugaugaggccguuaggccgaaaguaacau

SEQ ID NO: 7891 - RNA, 38 nt, Artificial Sequence
  Description of Artificial Sequence:  Enzymatic Nucleic Acid
auuucucucugaugaggccguuaggccgaaacacugag

SEQ ID NO: 7892 - RNA, 38 nt, Artificial Sequence
  Description of Artificial Sequence:  Enzymatic Nucleic Acid
gauuucuccugaugaggccguuaggccgaaaacacuga

SEQ ID NO: 7893 - RNA, 38 nt, Artificial Sequence
  Description of Artificial Sequence:  Enzymatic Nucleic Acid
uuaggaagcugaugaggccguuaggccgaaauuucucu

SEQ ID NO: 7894 - RNA, 38 nt, Artificial Sequence
  Description of Artificial Sequence:  Enzymatic Nucleic Acid
gguuuaggcugaugaggccguuaggccgaaaggauuuc

SEQ ID NO: 7895 - RNA, 38 nt, Artificial Sequence
  Description of Artificial Sequence:  Enzymatic Nucleic Acid
ggguuuagcugaugaggccguuaggccgaaaaggauuu

SEQ ID NO: 7896 - RNA, 38 nt, Artificial Sequence
  Description of Artificial Sequence:  Enzymatic Nucleic Acid
auuggguucugaugaggccguuaggccgaaaggaagga

SEQ ID NO: 7897 - RNA, 38 nt, Artificial Sequence
  Description of Artificial Sequence:  Enzymatic Nucleic Acid
gagcagggcugaugaggccguuaggccgaaagucauug

SEQ ID NO: 7898 - RNA, 38 nt, Artificial Sequence
  Description of Artificial Sequence:  Enzymatic Nucleic Acid
ggagcaggcugaugaggccguuaggccgaaaagucauu

SEQ ID NO: 7899 - RNA, 38 nt, Artificial Sequence
  Description of Artificial Sequence:  Enzymatic Nucleic Acid
ggggguugcugaugaggccguuaggccgaaagcaggga

SEQ ID NO: 7900 - RNA, 38 nt, Artificial Sequence
  Description of Artificial Sequence:  Enzymatic Nucleic Acid
cgugcccucugaugaggccguuaggccgaaagguggcg

SEQ ID NO: 7901 - RNA, 38 nt, Artificial Sequence
  Description of Artificial Sequence:  Enzymatic Nucleic Acid
cucaaucacugaugaggccguuaggccgaaacuggucc

SEQ ID NO: 7902 - RNA, 38 nt, Artificial Sequence
  Description of Artificial Sequence:  Enzymatic Nucleic Acid
ccucaauccugaugaggccguuaggccgaaaacugguc

SEQ ID NO: 7903 - RNA, 38 nt, Artificial Sequence
  Description of Artificial Sequence:  Enzymatic Nucleic Acid
agcuccuccugaugaggccguuaggccgaaaucaaacu

SEQ ID NO: 7904 - RNA, 38 nt, Artificial Sequence
  Description of Artificial Sequence:  Enzymatic Nucleic Acid
cauugggucugaugaggccguuaggccgaaaucagugc

SEQ ID NO: 7905 - RNA, 38 nt, Artificial Sequence
  Description of Artificial Sequence:  Enzymatic Nucleic Acid
ggguacgucugaugaggccguuaggccgaaaugcauug

SEQ ID NO: 7906 - RNA, 38 nt, Artificial Sequence
  Description of Artificial Sequence:  Enzymatic Nucleic Acid
caguggggcugaugaggccguuaggccgaaacgugaug

SEQ ID NO: 7907 - RNA, 38 nt, Artificial Sequence
  Description of Artificial Sequence:  Enzymatic Nucleic Acid
cuggggcucugaugaggccguuaggccgaaacgggcuu

SEQ ID NO: 7908 - RNA, 38 nt, Artificial Sequence
  Description of Artificial Sequence:  Enzymatic Nucleic Acid
ccuggggccugaugaggccguuaggccgaaaacgggcu

SEQ ID NO: 7909 - RNA, 38 nt, Artificial Sequence
  Description of Artificial Sequence:  Enzymatic Nucleic Acid
cagccagucugaugaggccguuaggccgaaauccccug

SEQ ID NO: 7910 - RNA, 38 nt, Artificial Sequence
  Description of Artificial Sequence:  Enzymatic Nucleic Acid
acucccgacugaugaggccguuaggccgaaauguugcu

SEQ ID NO: 7911 - RNA, 38 nt, Artificial Sequence
  Description of Artificial Sequence:  Enzymatic Nucleic Acid
ggacuccccugaugaggccguuaggccgaaagauguug

SEQ ID NO: 7912 - RNA, 38 nt, Artificial Sequence
  Description of Artificial Sequence:  Enzymatic Nucleic Acid
ugcuagagcugaugaggccguuaggccgaaacucccga

SEQ ID NO: 7913 - RNA, 38 nt, Artificial Sequence
  Description of Artificial Sequence:  Enzymatic Nucleic Acid
gccugcuacugaugaggccguuaggccgaaaggacucc

SEQ ID NO: 7914 - RNA, 38 nt, Artificial Sequence
  Description of Artificial Sequence:  Enzymatic Nucleic Acid
aggccugccugaugaggccguuaggccgaaagaggacu

SEQ ID NO: 7915 - RNA, 38 nt, Artificial Sequence
  Description of Artificial Sequence:  Enzymatic Nucleic Acid
acaugucucugaugaggccguuaggccgaaaggccugc

SEQ ID NO: 7916 - RNA, 38 nt, Artificial Sequence
  Description of Artificial Sequence:  Enzymatic Nucleic Acid
gcgucucacugaugaggccguuaggccgaaauucuuuc

SEQ ID NO: 7917 - RNA, 38 nt, Artificial Sequence
  Description of Artificial Sequence:  Enzymatic Nucleic Acid
ugcgucuccugaugaggccguuaggccgaaaauucuuu

SEQ ID NO: 7918 - RNA, 38 nt, Artificial Sequence
  Description of Artificial Sequence:  Enzymatic Nucleic Acid
gcauugcucugaugaggccguuaggccgaaagccccgu

SEQ ID NO: 7919 - RNA, 38 nt, Artificial Sequence
  Description of Artificial Sequence:  Enzymatic Nucleic Acid
gccacugacugaugaggccguuaggccgaaauggcauu

SEQ ID NO: 7920 - RNA, 38 nt, Artificial Sequence
  Description of Artificial Sequence:  Enzymatic Nucleic Acid
agccacugcugaugaggccguuaggccgaaaauggcau

SEQ ID NO: 7921 - RNA, 38 nt, Artificial Sequence
  Description of Artificial Sequence:  Enzymatic Nucleic Acid
aagccacucugaugaggccguuaggccgaaaaauggca

SEQ ID NO: 7922 - RNA, 38 nt, Artificial Sequence
  Description of Artificial Sequence:  Enzymatic Nucleic Acid
gagcugggcugaugaggccguuaggccgaaagccacug

SEQ ID NO: 7923 - RNA, 38 nt, Artificial Sequence
  Description of Artificial Sequence:  Enzymatic Nucleic Acid
agagcuggcugaugaggccguuaggccgaaaagccacu

SEQ ID NO: 7924 - RNA, 38 nt, Artificial Sequence
  Description of Artificial Sequence:  Enzymatic Nucleic Acid
aagggucacugaugaggccguuaggccgaaagcuggga

SEQ ID NO: 7925 - RNA, 38 nt, Artificial Sequence
  Description of Artificial Sequence:  Enzymatic Nucleic Acid
aaauguagcugaugaggccguuaggccgaaagggucag

SEQ ID NO: 7926 - RNA, 38 nt, Artificial Sequence
  Description of Artificial Sequence:  Enzymatic Nucleic Acid
caaauguacugaugaggccguuaggccgaaaaggguca

SEQ ID NO: 7927 - RNA, 38 nt, Artificial Sequence
  Description of Artificial Sequence:  Enzymatic Nucleic Acid
cucaaaugcugaugaggccguuaggccgaaagaagggu

SEQ ID NO: 7928 - RNA, 38 nt, Artificial Sequence
  Description of Artificial Sequence:  Enzymatic Nucleic Acid
ggcccucacugaugaggccguuaggccgaaauguagaa

SEQ ID NO: 7929 - RNA, 38 nt, Artificial Sequence
  Description of Artificial Sequence:  Enzymatic Nucleic Acid
gggcccuccugaugaggccguuaggccgaaaauguaga

SEQ ID NO: 7930 - RNA, 38 nt, Artificial Sequence
  Description of Artificial Sequence:  Enzymatic Nucleic Acid
auccagaacugaugaggccguuaggccgaaaugucccc

SEQ ID NO: 7931 - RNA, 38 nt, Artificial Sequence
  Description of Artificial Sequence:  Enzymatic Nucleic Acid
aauccagacugaugaggccguuaggccgaaaauguccc

SEQ ID NO: 7932 - RNA, 38 nt, Artificial Sequence
  Description of Artificial Sequence:  Enzymatic Nucleic Acid
gaauccagcugaugaggccguuaggccgaaaaaugucc

SEQ ID NO: 7933 - RNA, 38 nt, Artificial Sequence
  Description of Artificial Sequence:  Enzymatic Nucleic Acid
agaauccacugaugaggccguuaggccgaaaaaauguc

SEQ ID NO: 7934 - RNA, 38 nt, Artificial Sequence
  Description of Artificial Sequence:  Enzymatic Nucleic Acid
ccucccagcugaugaggccguuaggccgaaauccagaa

SEQ ID NO: 7935 - RNA, 38 nt, Artificial Sequence
  Description of Artificial Sequence:  Enzymatic Nucleic Acid
gccucccacugaugaggccguuaggccgaaaauccaga

SEQ ID NO: 7936 - RNA, 38 nt, Artificial Sequence
  Description of Artificial Sequence:  Enzymatic Nucleic Acid
aaaaaagacugaugaggccguuaggccgaaauuugucc

SEQ ID NO: 7937 - RNA, 38 nt, Artificial Sequence
  Description of Artificial Sequence:  Enzymatic Nucleic Acid
ccaaaaaacugaugaggccguuaggccgaaauauuugu

SEQ ID NO: 7938 - RNA, 38 nt, Artificial Sequence
  Description of Artificial Sequence:  Enzymatic Nucleic Acid
uuccaaaacugaugaggccguuaggccgaaagauauuu

SEQ ID NO: 7939 - RNA, 38 nt, Artificial Sequence
  Description of Artificial Sequence:  Enzymatic Nucleic Acid
guuccaaacugaugaggccguuaggccgaaaagauauu

SEQ ID NO: 7940 - RNA, 38 nt, Artificial Sequence
  Description of Artificial Sequence:  Enzymatic Nucleic Acid
aguuccaacugaugaggccguuaggccgaaaaagauau

SEQ ID NO: 7941 - RNA, 38 nt, Artificial Sequence
  Description of Artificial Sequence:  Enzymatic Nucleic Acid
uaguuccacugaugaggccguuaggccgaaaaaagaua

SEQ ID NO: 7942 - RNA, 38 nt, Artificial Sequence
  Description of Artificial Sequence:  Enzymatic Nucleic Acid
uuaguucccugaugaggccguuaggccgaaaaaaagau

SEQ ID NO: 7943 - RNA, 38 nt, Artificial Sequence
  Description of Artificial Sequence:  Enzymatic Nucleic Acid
auuugcuucugaugaggccguuaggccgaaaguuccaa

SEQ ID NO: 7944 - RNA, 38 nt, Artificial Sequence
  Description of Artificial Sequence:  Enzymatic Nucleic Acid
aggucuaacugaugaggccguuaggccgaaauuugcuu

SEQ ID NO: 7945 - RNA, 38 nt, Artificial Sequence
  Description of Artificial Sequence:  Enzymatic Nucleic Acid
aaggucuacugaugaggccguuaggccgaaaauuugcu

SEQ ID NO: 7946 - RNA, 38 nt, Artificial Sequence
  Description of Artificial Sequence:  Enzymatic Nucleic Acid
aaaggucucugaugaggccguuaggccgaaaaauuugc

SEQ ID NO: 7947 - RNA, 38 nt, Artificial Sequence
  Description of Artificial Sequence:  Enzymatic Nucleic Acid
uaaagguccugaugaggccguuaggccgaaaaaauuug

SEQ ID NO: 7948 - RNA, 38 nt, Artificial Sequence
  Description of Artificial Sequence:  Enzymatic Nucleic Acid
cauagguacugaugaggccguuaggccgaaaggucuaa

SEQ ID NO: 7949 - RNA, 38 nt, Artificial Sequence
  Description of Artificial Sequence:  Enzymatic Nucleic Acid
ccauaggucugaugaggccguuaggccgaaaaggucua

SEQ ID NO: 7950 - RNA, 38 nt, Artificial Sequence
  Description of Artificial Sequence:  Enzymatic Nucleic Acid
uccauaggcugaugaggccguuaggccgaaaaaggucu

SEQ ID NO: 7951 - RNA, 38 nt, Artificial Sequence
  Description of Artificial Sequence:  Enzymatic Nucleic Acid
cacuuccacugaugaggccguuaggccgaaagguaaag

SEQ ID NO: 7952 - RNA, 38 nt, Artificial Sequence
  Description of Artificial Sequence:  Enzymatic Nucleic Acid
ggacauagcugaugaggccguuaggccgaaaccacuuc

SEQ ID NO: 7953 - RNA, 38 nt, Artificial Sequence
  Description of Artificial Sequence:  Enzymatic Nucleic Acid
uggacauacugaugaggccguuaggccgaaaaccacuu

SEQ ID NO: 7954 - RNA, 38 nt, Artificial Sequence
  Description of Artificial Sequence:  Enzymatic Nucleic Acid
aauggacacugaugaggccguuaggccgaaagaaccac

SEQ ID NO: 7955 - RNA, 38 nt, Artificial Sequence
  Description of Artificial Sequence:  Enzymatic Nucleic Acid
ugagaaugcugaugaggccguuaggccgaaacauagaa

SEQ ID NO: 7956 - RNA, 38 nt, Artificial Sequence
  Description of Artificial Sequence:  Enzymatic Nucleic Acid
cgaaugagcugaugaggccguuaggccgaaauggacau

SEQ ID NO: 7957 - RNA, 38 nt, Artificial Sequence
  Description of Artificial Sequence:  Enzymatic Nucleic Acid
acgaaugacugaugaggccguuaggccgaaaauggaca

SEQ ID NO: 7958 - RNA, 38 nt, Artificial Sequence
  Description of Artificial Sequence:  Enzymatic Nucleic Acid
ccacgaaucugaugaggccguuaggccgaaagaaugga

SEQ ID NO: 7959 - RNA, 38 nt, Artificial Sequence
  Description of Artificial Sequence:  Enzymatic Nucleic Acid
augccacgcugaugaggccguuaggccgaaaugagaau

SEQ ID NO: 7960 - RNA, 38 nt, Artificial Sequence
  Description of Artificial Sequence:  Enzymatic Nucleic Acid
caugccaccugaugaggccguuaggccgaaaaugagaa

SEQ ID NO: 7961 - RNA, 38 nt, Artificial Sequence
  Description of Artificial Sequence:  Enzymatic Nucleic Acid
caaaucaacugaugaggccguuaggccgaaacaugcca

SEQ ID NO: 7962 - RNA, 38 nt, Artificial Sequence
  Description of Artificial Sequence:  Enzymatic Nucleic Acid
acaaaucacugaugaggccguuaggccgaaaacaugcc

SEQ ID NO: 7963 - RNA, 38 nt, Artificial Sequence
  Description of Artificial Sequence:  Enzymatic Nucleic Acid
uacaaauccugaugaggccguuaggccgaaaaacaugc

SEQ ID NO: 7964 - RNA, 38 nt, Artificial Sequence
  Description of Artificial Sequence:  Enzymatic Nucleic Acid
gugcuacacugaugaggccguuaggccgaaaucaaaac

SEQ ID NO: 7965 - RNA, 38 nt, Artificial Sequence
  Description of Artificial Sequence:  Enzymatic Nucleic Acid
agugcuaccugaugaggccguuaggccgaaaaucaaaa

SEQ ID NO: 7966 - RNA, 38 nt, Artificial Sequence
  Description of Artificial Sequence:  Enzymatic Nucleic Acid
cucagugccugaugaggccguuaggccgaaacaaauca

SEQ ID NO: 7967 - RNA, 38 nt, Artificial Sequence
  Description of Artificial Sequence:  Enzymatic Nucleic Acid
ucagaguucugaugaggccguuaggccgaaagugccac

SEQ ID NO: 7968 - RNA, 38 nt, Artificial Sequence
  Description of Artificial Sequence:  Enzymatic Nucleic Acid
ugggcucacugaugaggccguuaggccgaaaguugagu

SEQ ID NO: 7969 - RNA, 38 nt, Artificial Sequence
  Description of Artificial Sequence:  Enzymatic Nucleic Acid
gccaaaagcugaugaggccguuaggccgaaaugggcuc

SEQ ID NO: 7970 - RNA, 38 nt, Artificial Sequence
  Description of Artificial Sequence:  Enzymatic Nucleic Acid
ggagccaacugaugaggccguuaggccgaaaguauggg

SEQ ID NO: 7971 - RNA, 38 nt, Artificial Sequence
  Description of Artificial Sequence:  Enzymatic Nucleic Acid
aggagccacugaugaggccguuaggccgaaaaguaugg

SEQ ID NO: 7972 - RNA, 38 nt, Artificial Sequence
  Description of Artificial Sequence:  Enzymatic Nucleic Acid
gaggagcccugaugaggccguuaggccgaaaaaguaug

SEQ ID NO: 7973 - RNA, 38 nt, Artificial Sequence
  Description of Artificial Sequence:  Enzymatic Nucleic Acid
uacuagagcugaugaggccguuaggccgaaagccaaaa

SEQ ID NO: 7974 - RNA, 38 nt, Artificial Sequence
  Description of Artificial Sequence:  Enzymatic Nucleic Acid
ucuuacuacugaugaggccguuaggccgaaaggagcca

SEQ ID NO: 7975 - RNA, 38 nt, Artificial Sequence
  Description of Artificial Sequence:  Enzymatic Nucleic Acid
caucuuaccugaugaggccguuaggccgaaagaggagc

SEQ ID NO: 7976 - RNA, 38 nt, Artificial Sequence
  Description of Artificial Sequence:  Enzymatic Nucleic Acid
gugcaucucugaugaggccguuaggccgaaacuagagg

SEQ ID NO: 7977 - RNA, 38 nt, Artificial Sequence
  Description of Artificial Sequence:  Enzymatic Nucleic Acid
cucuggcucugaugaggccguuaggccgaaaguuuuca

SEQ ID NO: 7978 - RNA, 38 nt, Artificial Sequence
  Description of Artificial Sequence:  Enzymatic Nucleic Acid
acucuggccugaugaggccguuaggccgaaaaguuuuc

SEQ ID NO: 7979 - RNA, 38 nt, Artificial Sequence
  Description of Artificial Sequence:  Enzymatic Nucleic Acid
gacaaccucugaugaggccguuaggccgaaacucuggc

SEQ ID NO: 7980 - RNA, 38 nt, Artificial Sequence
  Description of Artificial Sequence:  Enzymatic Nucleic Acid
agacaacccugaugaggccguuaggccgaaaacucugg

SEQ ID NO: 7981 - RNA, 38 nt, Artificial Sequence
  Description of Artificial Sequence:  Enzymatic Nucleic Acid
cuggagaccugaugaggccguuaggccgaaaccuaacu

SEQ ID NO: 7982 - RNA, 38 nt, Artificial Sequence
  Description of Artificial Sequence:  Enzymatic Nucleic Acid
ggccuggacugaugaggccguuaggccgaaacaaccua

SEQ ID NO: 7983 - RNA, 38 nt, Artificial Sequence
  Description of Artificial Sequence:  Enzymatic Nucleic Acid
auggccugcugaugaggccguuaggccgaaagacaacc

SEQ ID NO: 7984 - RNA, 38 nt, Artificial Sequence
  Description of Artificial Sequence:  Enzymatic Nucleic Acid
uucagugucugaugaggccguuaggccgaaaggccauc

SEQ ID NO: 7985 - RNA, 38 nt, Artificial Sequence
  Description of Artificial Sequence:  Enzymatic Nucleic Acid
uuucagugcugaugaggccguuaggccgaaaaggccau

SEQ ID NO: 7986 - RNA, 38 nt, Artificial Sequence
  Description of Artificial Sequence:  Enzymatic Nucleic Acid
uagaaugucugaugaggccguuaggccgaaacauuuuc

SEQ ID NO: 7987 - RNA, 38 nt, Artificial Sequence
  Description of Artificial Sequence:  Enzymatic Nucleic Acid
caaaauagcugaugaggccguuaggccgaaaugugaca

SEQ ID NO: 7988 - RNA, 38 nt, Artificial Sequence
  Description of Artificial Sequence:  Enzymatic Nucleic Acid
ccaaaauacugaugaggccguuaggccgaaaaugugac

SEQ ID NO: 7989 - RNA, 38 nt, Artificial Sequence
  Description of Artificial Sequence:  Enzymatic Nucleic Acid
acccaaaacugaugaggccguuaggccgaaagaaugug

SEQ ID NO: 7990 - RNA, 38 nt, Artificial Sequence
  Description of Artificial Sequence:  Enzymatic Nucleic Acid
auacccaacugaugaggccguuaggccgaaauagaaug

SEQ ID NO: 7991 - RNA, 38 nt, Artificial Sequence
  Description of Artificial Sequence:  Enzymatic Nucleic Acid
aauacccacugaugaggccguuaggccgaaaauagaau

SEQ ID NO: 7992 - RNA, 38 nt, Artificial Sequence
  Description of Artificial Sequence:  Enzymatic Nucleic Acid
uaauaccccugaugaggccguuaggccgaaaaauagaa

SEQ ID NO: 7993 - RNA, 38 nt, Artificial Sequence
  Description of Artificial Sequence:  Enzymatic Nucleic Acid
uauauuaacugaugaggccguuaggccgaaacccaaaa

SEQ ID NO: 7994 - RNA, 38 nt, Artificial Sequence
  Description of Artificial Sequence:  Enzymatic Nucleic Acid
uauauauucugaugaggccguuaggccgaaauacccaa

SEQ ID NO: 7995 - RNA, 38 nt, Artificial Sequence
  Description of Artificial Sequence:  Enzymatic Nucleic Acid
cuauauaucugaugaggccguuaggccgaaaauaccca

SEQ ID NO: 7996 - RNA, 38 nt, Artificial Sequence
  Description of Artificial Sequence:  Enzymatic Nucleic Acid
ggacuauacugaugaggccguuaggccgaaauuaauac

SEQ ID NO: 7997 - RNA, 38 nt, Artificial Sequence
  Description of Artificial Sequence:  Enzymatic Nucleic Acid
cuggacuacugaugaggccguuaggccgaaauauuaau

SEQ ID NO: 7998 - RNA, 38 nt, Artificial Sequence
  Description of Artificial Sequence:  Enzymatic Nucleic Acid
gucuggaccugaugaggccguuaggccgaaauauauua

SEQ ID NO: 7999 - RNA, 38 nt, Artificial Sequence
  Description of Artificial Sequence:  Enzymatic Nucleic Acid
agugucugcugaugaggccguuaggccgaaacuauaua

SEQ ID NO: 8000 - RNA, 38 nt, Artificial Sequence
  Description of Artificial Sequence:  Enzymatic Nucleic Acid
auugaguucugaugaggccguuaggccgaaagugucug

SEQ ID NO: 8001 - RNA, 38 nt, Artificial Sequence
  Description of Artificial Sequence:  Enzymatic Nucleic Acid
aauugagucugaugaggccguuaggccgaaaagugucu

SEQ ID NO: 8002 - RNA, 38 nt, Artificial Sequence
  Description of Artificial Sequence:  Enzymatic Nucleic Acid
aagaaauucugaugaggccguuaggccgaaaguuaagu

SEQ ID NO: 8003 - RNA, 38 nt, Artificial Sequence
  Description of Artificial Sequence:  Enzymatic Nucleic Acid
uaccaagacugaugaggccguuaggccgaaauugaguu

SEQ ID NO: 8004 - RNA, 38 nt, Artificial Sequence
  Description of Artificial Sequence:  Enzymatic Nucleic Acid
auaccaagcugaugaggccguuaggccgaaaauugagu

SEQ ID NO: 8005 - RNA, 38 nt, Artificial Sequence
  Description of Artificial Sequence:  Enzymatic Nucleic Acid
aauaccaacugaugaggccguuaggccgaaaaauugag

SEQ ID NO: 8006 - RNA, 38 nt, Artificial Sequence
  Description of Artificial Sequence:  Enzymatic Nucleic Acid
auaauacccugaugaggccguuaggccgaaagaaauug

SEQ ID NO: 8007 - RNA, 38 nt, Artificial Sequence
  Description of Artificial Sequence:  Enzymatic Nucleic Acid
cagaauaacugaugaggccguuaggccgaaaccaagaa

SEQ ID NO: 8008 - RNA, 38 nt, Artificial Sequence
  Description of Artificial Sequence:  Enzymatic Nucleic Acid
aacagaaucugaugaggccguuaggccgaaauaccaag

SEQ ID NO: 8009 - RNA, 38 nt, Artificial Sequence
  Description of Artificial Sequence:  Enzymatic Nucleic Acid
aaacagaacugaugaggccguuaggccgaaaauaccaa

SEQ ID NO: 8010 - RNA, 38 nt, Artificial Sequence
  Description of Artificial Sequence:  Enzymatic Nucleic Acid
caaaacagcugaugaggccguuaggccgaaauaauacc

SEQ ID NO: 8011 - RNA, 38 nt, Artificial Sequence
  Description of Artificial Sequence:  Enzymatic Nucleic Acid
gcaaaacacugaugaggccguuaggccgaaaauaauac

SEQ ID NO: 8012 - RNA, 38 nt, Artificial Sequence
  Description of Artificial Sequence:  Enzymatic Nucleic Acid
cugugcaacugaugaggccguuaggccgaaacagaaua

SEQ ID NO: 8013 - RNA, 38 nt, Artificial Sequence
  Description of Artificial Sequence:  Enzymatic Nucleic Acid
acugugcacugaugaggccguuaggccgaaaacagaau

SEQ ID NO: 8014 - RNA, 38 nt, Artificial Sequence
  Description of Artificial Sequence:  Enzymatic Nucleic Acid
aacugugccugaugaggccguuaggccgaaaaacagaa

SEQ ID NO: 8015 - RNA, 38 nt, Artificial Sequence
  Description of Artificial Sequence:  Enzymatic Nucleic Acid
ucacaacucugaugaggccguuaggccgaaacugugca

SEQ ID NO: 8016 - RNA, 38 nt, Artificial Sequence
  Description of Artificial Sequence:  Enzymatic Nucleic Acid
uucacaaccugaugaggccguuaggccgaaaacugugc

SEQ ID NO: 8017 - RNA, 38 nt, Artificial Sequence
  Description of Artificial Sequence:  Enzymatic Nucleic Acid
ucuuucaccugaugaggccguuaggccgaaacuaacug

SEQ ID NO: 8018 - RNA, 38 nt, Artificial Sequence
  Description of Artificial Sequence:  Enzymatic Nucleic Acid
cuccucagcugaugaggccguuaggccgaaacugcauu

SEQ ID NO: 8019 - RNA, 38 nt, Artificial Sequence
  Description of Artificial Sequence:  Enzymatic Nucleic Acid
auggagaacugaugaggccguuaggccgaaacucuccu

SEQ ID NO: 8020 - RNA, 38 nt, Artificial Sequence
  Description of Artificial Sequence:  Enzymatic Nucleic Acid
uauggagacugaugaggccguuaggccgaaaacucucc

SEQ ID NO: 8021 - RNA, 38 nt, Artificial Sequence
  Description of Artificial Sequence:  Enzymatic Nucleic Acid
auauggagcugaugaggccguuaggccgaaaaacucuc

SEQ ID NO: 8022 - RNA, 38 nt, Artificial Sequence
  Description of Artificial Sequence:  Enzymatic Nucleic Acid
gauauggacugaugaggccguuaggccgaaaaaacucu

SEQ ID NO: 8023 - RNA, 38 nt, Artificial Sequence
  Description of Artificial Sequence:  Enzymatic Nucleic Acid
uugauaugcugaugaggccguuaggccgaaagaaaacu

SEQ ID NO: 8024 - RNA, 38 nt, Artificial Sequence
  Description of Artificial Sequence:  Enzymatic Nucleic Acid
cguuuugacugaugaggccguuaggccgaaauggagaa

SEQ ID NO: 8025 - RNA, 38 nt, Artificial Sequence
  Description of Artificial Sequence:  Enzymatic Nucleic Acid
cucguuuucugaugaggccguuaggccgaaauauggag

SEQ ID NO: 8026 - RNA, 38 nt, Artificial Sequence
  Description of Artificial Sequence:  Enzymatic Nucleic Acid
accuuauucugaugaggccguuaggccgaaaccuuuuu

SEQ ID NO: 8027 - RNA, 38 nt, Artificial Sequence
  Description of Artificial Sequence:  Enzymatic Nucleic Acid
cuugaccucugaugaggccguuaggccgaaauugaccu

SEQ ID NO: 8028 - RNA, 38 nt, Artificial Sequence
  Description of Artificial Sequence:  Enzymatic Nucleic Acid
cuucccuucugaugaggccguuaggccgaaaccuuauu

SEQ ID NO: 8029 - RNA, 38 nt, Artificial Sequence
  Description of Artificial Sequence:  Enzymatic Nucleic Acid
gguauagacugaugaggccguuaggccgaaacgggguc

SEQ ID NO: 8030 - RNA, 38 nt, Artificial Sequence
  Description of Artificial Sequence:  Enzymatic Nucleic Acid
uugguauacugaugaggccguuaggccgaaagacgggg

SEQ ID NO: 8031 - RNA, 38 nt, Artificial Sequence
  Description of Artificial Sequence:  Enzymatic Nucleic Acid
gguugguacugaugaggccguuaggccgaaagagacgg

SEQ ID NO: 8032 - RNA, 38 nt, Artificial Sequence
  Description of Artificial Sequence:  Enzymatic Nucleic Acid
uugguuggcugaugaggccguuaggccgaaauagagac

SEQ ID NO: 8033 - RNA, 38 nt, Artificial Sequence
  Description of Artificial Sequence:  Enzymatic Nucleic Acid
uguuggugcugaugaggccguuaggccgaaauugguuu

SEQ ID NO: 8034 - RNA, 38 nt, Artificial Sequence
  Description of Artificial Sequence:  Enzymatic Nucleic Acid
guguuggucugaugaggccguuaggccgaaaauugguu

SEQ ID NO: 8035 - RNA, 38 nt, Artificial Sequence
  Description of Artificial Sequence:  Enzymatic Nucleic Acid
uggguccccugaugaggccguuaggccgaaacuguguu

SEQ ID NO: 8036 - RNA, 38 nt, Artificial Sequence
  Description of Artificial Sequence:  Enzymatic Nucleic Acid
acgugacucugaugaggccguuaggccgaaacuuccug

SEQ ID NO: 8037 - RNA, 38 nt, Artificial Sequence
  Description of Artificial Sequence:  Enzymatic Nucleic Acid
ggaaacgucugaugaggccguuaggccgaaacugacuu

SEQ ID NO: 8038 - RNA, 38 nt, Artificial Sequence
  Description of Artificial Sequence:  Enzymatic Nucleic Acid
gaaaaggacugaugaggccguuaggccgaaacgugacu

SEQ ID NO: 8039 - RNA, 38 nt, Artificial Sequence
  Description of Artificial Sequence:  Enzymatic Nucleic Acid
ugaaaaggcugaugaggccguuaggccgaaaacgugac

SEQ ID NO: 8040 - RNA, 38 nt, Artificial Sequence
  Description of Artificial Sequence:  Enzymatic Nucleic Acid
augaaaagcugaugaggccguuaggccgaaaaacguga

SEQ ID NO: 8041 - RNA, 38 nt, Artificial Sequence
  Description of Artificial Sequence:  Enzymatic Nucleic Acid
uaaaugaacugaugaggccguuaggccgaaaggaaacg

SEQ ID NO: 8042 - RNA, 38 nt, Artificial Sequence
  Description of Artificial Sequence:  Enzymatic Nucleic Acid
uuaaaugacugaugaggccguuaggccgaaaaggaaac

SEQ ID NO: 8043 - RNA, 38 nt, Artificial Sequence
  Description of Artificial Sequence:  Enzymatic Nucleic Acid
auuaaaugcugaugaggccguuaggccgaaaaaggaaa

SEQ ID NO: 8044 - RNA, 38 nt, Artificial Sequence
  Description of Artificial Sequence:  Enzymatic Nucleic Acid
cauuaaaucugaugaggccguuaggccgaaaaaaggaa

SEQ ID NO: 8045 - RNA, 38 nt, Artificial Sequence
  Description of Artificial Sequence:  Enzymatic Nucleic Acid
ccccauuacugaugaggccguuaggccgaaaugaaaag

SEQ ID NO: 8046 - RNA, 38 nt, Artificial Sequence
  Description of Artificial Sequence:  Enzymatic Nucleic Acid
uccccauucugaugaggccguuaggccgaaaaugaaaa

SEQ ID NO: 8047 - RNA, 38 nt, Artificial Sequence
  Description of Artificial Sequence:  Enzymatic Nucleic Acid
auccccaucugaugaggccguuaggccgaaaaaugaaa

SEQ ID NO: 8048 - RNA, 38 nt, Artificial Sequence
  Description of Artificial Sequence:  Enzymatic Nucleic Acid
gauaguggcugaugaggccguuaggccgaaauccccau

SEQ ID NO: 8049 - RNA, 38 nt, Artificial Sequence
  Description of Artificial Sequence:  Enzymatic Nucleic Acid
agauagugcugaugaggccguuaggccgaaaaucccca

SEQ ID NO: 8050 - RNA, 38 nt, Artificial Sequence
  Description of Artificial Sequence:  Enzymatic Nucleic Acid
gugugagacugaugaggccguuaggccgaaaguggaau

SEQ ID NO: 8051 - RNA, 38 nt, Artificial Sequence
  Description of Artificial Sequence:  Enzymatic Nucleic Acid
uagugugacugaugaggccguuaggccgaaauagugga

SEQ ID NO: 8052 - RNA, 38 nt, Artificial Sequence
  Description of Artificial Sequence:  Enzymatic Nucleic Acid
auuagugucugaugaggccguuaggccgaaagauagug

SEQ ID NO: 8053 - RNA, 38 nt, Artificial Sequence
  Description of Artificial Sequence:  Enzymatic Nucleic Acid
uuucagaucugaugaggccguuaggccgaaagugugag

SEQ ID NO: 8054 - RNA, 38 nt, Artificial Sequence
  Description of Artificial Sequence:  Enzymatic Nucleic Acid
uccuuucacugaugaggccguuaggccgaaauuagugu

SEQ ID NO: 8055 - RNA, 38 nt, Artificial Sequence
  Description of Artificial Sequence:  Enzymatic Nucleic Acid
cgccagcucugaugaggccguuaggccgaaaugcucuu

SEQ ID NO: 8056 - RNA, 38 nt, Artificial Sequence
  Description of Artificial Sequence:  Enzymatic Nucleic Acid
gcgccagccugaugaggccguuaggccgaaaaugcucu

SEQ ID NO: 8057 - RNA, 38 nt, Artificial Sequence
  Description of Artificial Sequence:  Enzymatic Nucleic Acid
gugcuuaacugaugaggccguuaggccgaaaugcgcca

SEQ ID NO: 8058 - RNA, 38 nt, Artificial Sequence
  Description of Artificial Sequence:  Enzymatic Nucleic Acid
aagugcuucugaugaggccguuaggccgaaauaugcgc

SEQ ID NO: 8059 - RNA, 38 nt, Artificial Sequence
  Description of Artificial Sequence:  Enzymatic Nucleic Acid
aaagugcucugaugaggccguuaggccgaaaauaugcg

SEQ ID NO: 8060 - RNA, 38 nt, Artificial Sequence
  Description of Artificial Sequence:  Enzymatic Nucleic Acid
ggagcuuacugaugaggccguuaggccgaaagugcuua

SEQ ID NO: 8061 - RNA, 38 nt, Artificial Sequence
  Description of Artificial Sequence:  Enzymatic Nucleic Acid
aggagcuucugaugaggccguuaggccgaaaagugcuu

SEQ ID NO: 8062 - RNA, 38 nt, Artificial Sequence
  Description of Artificial Sequence:  Enzymatic Nucleic Acid
aaggagcucugaugaggccguuaggccgaaaaagugcu

SEQ ID NO: 8063 - RNA, 38 nt, Artificial Sequence
  Description of Artificial Sequence:  Enzymatic Nucleic Acid
uacucaagcugaugaggccguuaggccgaaagcuuaaa

SEQ ID NO: 8064 - RNA, 38 nt, Artificial Sequence
  Description of Artificial Sequence:  Enzymatic Nucleic Acid
uuuuacuccugaugaggccguuaggccgaaaggagcuu

SEQ ID NO: 8065 - RNA, 38 nt, Artificial Sequence
  Description of Artificial Sequence:  Enzymatic Nucleic Acid
caccuuuucugaugaggccguuaggccgaaacucaagg

SEQ ID NO: 8066 - RNA, 38 nt, Artificial Sequence
  Description of Artificial Sequence:  Enzymatic Nucleic Acid
aaauuacacugaugaggccguuaggccgaaaccaccuu

SEQ ID NO: 8067 - RNA, 38 nt, Artificial Sequence
  Description of Artificial Sequence:  Enzymatic Nucleic Acid
gcauaaaucugaugaggccguuaggccgaaacauacca

SEQ ID NO: 8068 - RNA, 38 nt, Artificial Sequence
  Description of Artificial Sequence:  Enzymatic Nucleic Acid
cuugcauacugaugaggccguuaggccgaaauuacaua

SEQ ID NO: 8069 - RNA, 38 nt, Artificial Sequence
  Description of Artificial Sequence:  Enzymatic Nucleic Acid
ccuugcaucugaugaggccguuaggccgaaaauuacau

SEQ ID NO: 8070 - RNA, 38 nt, Artificial Sequence
  Description of Artificial Sequence:  Enzymatic Nucleic Acid
accuugcacugaugaggccguuaggccgaaaaauuaca

SEQ ID NO: 8071 - RNA, 38 nt, Artificial Sequence
  Description of Artificial Sequence:  Enzymatic Nucleic Acid
uggagaaacugaugaggccguuaggccgaaaccuugca

SEQ ID NO: 8072 - RNA, 38 nt, Artificial Sequence
  Description of Artificial Sequence:  Enzymatic Nucleic Acid
acuggagacugaugaggccguuaggccgaaauaccuug

SEQ ID NO: 8073 - RNA, 38 nt, Artificial Sequence
  Description of Artificial Sequence:  Enzymatic Nucleic Acid
aacuggagcugaugaggccguuaggccgaaaauaccuu

SEQ ID NO: 8074 - RNA, 38 nt, Artificial Sequence
  Description of Artificial Sequence:  Enzymatic Nucleic Acid
caacuggacugaugaggccguuaggccgaaaaauaccu

SEQ ID NO: 8075 - RNA, 38 nt, Artificial Sequence
  Description of Artificial Sequence:  Enzymatic Nucleic Acid
cccaacugcugaugaggccguuaggccgaaagaaauac

SEQ ID NO: 8076 - RNA, 38 nt, Artificial Sequence
  Description of Artificial Sequence:  Enzymatic Nucleic Acid
ugaguccccugaugaggccguuaggccgaaacuggaga

SEQ ID NO: 8077 - RNA, 38 nt, Artificial Sequence
  Description of Artificial Sequence:  Enzymatic Nucleic Acid
aauauccucugaugaggccguuaggccgaaagucccaa

SEQ ID NO: 8078 - RNA, 38 nt, Artificial Sequence
  Description of Artificial Sequence:  Enzymatic Nucleic Acid
uuaacuaacugaugaggccguuaggccgaaauccugag

SEQ ID NO: 8079 - RNA, 38 nt, Artificial Sequence
  Description of Artificial Sequence:  Enzymatic Nucleic Acid
cauuaacucugaugaggccguuaggccgaaauauccug

SEQ ID NO: 8080 - RNA, 38 nt, Artificial Sequence
  Description of Artificial Sequence:  Enzymatic Nucleic Acid
ucauuaaccugaugaggccguuaggccgaaaauauccu

SEQ ID NO: 8081 - RNA, 38 nt, Artificial Sequence
  Description of Artificial Sequence:  Enzymatic Nucleic Acid
ggcucauucugaugaggccguuaggccgaaacuaauau

SEQ ID NO: 8082 - RNA, 38 nt, Artificial Sequence
  Description of Artificial Sequence:  Enzymatic Nucleic Acid
uggcucaucugaugaggccguuaggccgaaaacuaaua

SEQ ID NO: 8083 - RNA, 38 nt, Artificial Sequence
  Description of Artificial Sequence:  Enzymatic Nucleic Acid
cuucuagucugaugaggccguuaggccgaaauggcuca

SEQ ID NO: 8084 - RNA, 38 nt, Artificial Sequence
  Description of Artificial Sequence:  Enzymatic Nucleic Acid
uuuucuuccugaugaggccguuaggccgaaagugaugg

SEQ ID NO: 8085 - RNA, 38 nt, Artificial Sequence
  Description of Artificial Sequence:  Enzymatic Nucleic Acid
caguugaacugaugaggccguuaggccgaaaugggcuu

SEQ ID NO: 8086 - RNA, 38 nt, Artificial Sequence
  Description of Artificial Sequence:  Enzymatic Nucleic Acid
gcaguugacugaugaggccguuaggccgaaaaugggcu

SEQ ID NO: 8087 - RNA, 38 nt, Artificial Sequence
  Description of Artificial Sequence:  Enzymatic Nucleic Acid
agcaguugcugaugaggccguuaggccgaaaaaugggc

SEQ ID NO: 8088 - RNA, 38 nt, Artificial Sequence
  Description of Artificial Sequence:  Enzymatic Nucleic Acid
aagcaguucugaugaggccguuaggccgaaaaaauggg

SEQ ID NO: 8089 - RNA, 38 nt, Artificial Sequence
  Description of Artificial Sequence:  Enzymatic Nucleic Acid
aaguuucacugaugaggccguuaggccgaaagcaguug

SEQ ID NO: 8090 - RNA, 38 nt, Artificial Sequence
  Description of Artificial Sequence:  Enzymatic Nucleic Acid
caaguuuccugaugaggccguuaggccgaaaagcaguu

SEQ ID NO: 8091 - RNA, 38 nt, Artificial Sequence
  Description of Artificial Sequence:  Enzymatic Nucleic Acid
ccccaggccugaugaggccguuaggccgaaaguuucaa

SEQ ID NO: 8092 - RNA, 38 nt, Artificial Sequence
  Description of Artificial Sequence:  Enzymatic Nucleic Acid
caugcucacugaugaggccguuaggccgaaaccccagg

SEQ ID NO: 8093 - RNA, 38 nt, Artificial Sequence
  Description of Artificial Sequence:  Enzymatic Nucleic Acid
ugucuccccugaugaggccguuaggccgaaauucccau

SEQ ID NO: 8094 - RNA, 38 nt, Artificial Sequence
  Description of Artificial Sequence:  Enzymatic Nucleic Acid
cccuuucccugaugaggccguuaggccgaaacccuguc

SEQ ID NO: 8095 - RNA, 38 nt, Artificial Sequence
  Description of Artificial Sequence:  Enzymatic Nucleic Acid
cugaagagcugaugaggccguuaggccgaaaggcgccc

SEQ ID NO: 8096 - RNA, 38 nt, Artificial Sequence
  Description of Artificial Sequence:  Enzymatic Nucleic Acid
acccugaacugaugaggccguuaggccgaaaguaggcg

SEQ ID NO: 8097 - RNA, 38 nt, Artificial Sequence
  Description of Artificial Sequence:  Enzymatic Nucleic Acid
agacccugcugaugaggccguuaggccgaaagaguagg

SEQ ID NO: 8098 - RNA, 38 nt, Artificial Sequence
  Description of Artificial Sequence:  Enzymatic Nucleic Acid
uagacccucugaugaggccguuaggccgaaaagaguag

SEQ ID NO: 8099 - RNA, 38 nt, Artificial Sequence
  Description of Artificial Sequence:  Enzymatic Nucleic Acid
gaucuuuacugaugaggccguuaggccgaaacccugaa

SEQ ID NO: 8100 - RNA, 38 nt, Artificial Sequence
  Description of Artificial Sequence:  Enzymatic Nucleic Acid
uugaucuucugaugaggccguuaggccgaaagacccug

SEQ ID NO: 8101 - RNA, 38 nt, Artificial Sequence
  Description of Artificial Sequence:  Enzymatic Nucleic Acid
gcccacuucugaugaggccguuaggccgaaaucuuuag

SEQ ID NO: 8102 - RNA, 38 nt, Artificial Sequence
  Description of Artificial Sequence:  Enzymatic Nucleic Acid
agcgaucccugaugaggccguuaggccgaaaggcccac

SEQ ID NO: 8103 - RNA, 38 nt, Artificial Sequence
  Description of Artificial Sequence:  Enzymatic Nucleic Acid
agcuuagccugaugaggccguuaggccgaaauccaagg

SEQ ID NO: 8104 - RNA, 38 nt, Artificial Sequence
  Description of Artificial Sequence:  Enzymatic Nucleic Acid
agccagcucugaugaggccguuaggccgaaagcgaucc

SEQ ID NO: 8105 - RNA, 38 nt, Artificial Sequence
  Description of Artificial Sequence:  Enzymatic Nucleic Acid
aucaaacacugaugaggccguuaggccgaaagccagcu

SEQ ID NO: 8106 - RNA, 38 nt, Artificial Sequence
  Description of Artificial Sequence:  Enzymatic Nucleic Acid
uagcaucacugaugaggccguuaggccgaaacagagcc

SEQ ID NO: 8107 - RNA, 38 nt, Artificial Sequence
  Description of Artificial Sequence:  Enzymatic Nucleic Acid
auagcauccugaugaggccguuaggccgaaaacagagc

SEQ ID NO: 8108 - RNA, 38 nt, Artificial Sequence
  Description of Artificial Sequence:  Enzymatic Nucleic Acid
ugcauaaacugaugaggccguuaggccgaaagcaucaa

SEQ ID NO: 8109 - RNA, 38 nt, Artificial Sequence
  Description of Artificial Sequence:  Enzymatic Nucleic Acid
cuugcauacugaugaggccguuaggccgaaauagcauc

SEQ ID NO: 8110 - RNA, 38 nt, Artificial Sequence
  Description of Artificial Sequence:  Enzymatic Nucleic Acid
acuugcaucugaugaggccguuaggccgaaaauagcau

SEQ ID NO: 8111 - RNA, 38 nt, Artificial Sequence
  Description of Artificial Sequence:  Enzymatic Nucleic Acid
aacuugcacugaugaggccguuaggccgaaaaauagca

SEQ ID NO: 8112 - RNA, 38 nt, Artificial Sequence
  Description of Artificial Sequence:  Enzymatic Nucleic Acid
uagacccucugaugaggccguuaggccgaaacuugcau

SEQ ID NO: 8113 - RNA, 38 nt, Artificial Sequence
  Description of Artificial Sequence:  Enzymatic Nucleic Acid
auagaccccugaugaggccguuaggccgaaaacuugca

SEQ ID NO: 8114 - RNA, 38 nt, Artificial Sequence
  Description of Artificial Sequence:  Enzymatic Nucleic Acid
aauacauacugaugaggccguuaggccgaaacccuaac

SEQ ID NO: 8115 - RNA, 38 nt, Artificial Sequence
  Description of Artificial Sequence:  Enzymatic Nucleic Acid
uaaauacacugaugaggccguuaggccgaaagacccua

SEQ ID NO: 8116 - RNA, 38 nt, Artificial Sequence
  Description of Artificial Sequence:  Enzymatic Nucleic Acid
auccuaaacugaugaggccguuaggccgaaacauagac

SEQ ID NO: 8117 - RNA, 38 nt, Artificial Sequence
  Description of Artificial Sequence:  Enzymatic Nucleic Acid
gcauccuacugaugaggccguuaggccgaaauacauag

SEQ ID NO: 8118 - RNA, 38 nt, Artificial Sequence
  Description of Artificial Sequence:  Enzymatic Nucleic Acid
cgcauccucugaugaggccguuaggccgaaaauacaua

SEQ ID NO: 8119 - RNA, 38 nt, Artificial Sequence
  Description of Artificial Sequence:  Enzymatic Nucleic Acid
gcgcaucccugaugaggccguuaggccgaaaaauacau

SEQ ID NO: 8120 - RNA, 38 nt, Artificial Sequence
  Description of Artificial Sequence:  Enzymatic Nucleic Acid
cugaagagcugaugaggccguuaggccgaaaggcgcau

SEQ ID NO: 8121 - RNA, 38 nt, Artificial Sequence
  Description of Artificial Sequence:  Enzymatic Nucleic Acid
acauccuacugaugaggccguuaggccgaaauacauag

SEQ ID NO: 8122 - RNA, 38 nt, Artificial Sequence
  Description of Artificial Sequence:  Enzymatic Nucleic Acid
gacauccucugaugaggccguuaggccgaaaauacaua

SEQ ID NO: 8123 - RNA, 38 nt, Artificial Sequence
  Description of Artificial Sequence:  Enzymatic Nucleic Acid
agacaucccugaugaggccguuaggccgaaaaauacau

SEQ ID NO: 8124 - RNA, 38 nt, Artificial Sequence
  Description of Artificial Sequence:  Enzymatic Nucleic Acid
aaggugcacugaugaggccguuaggccgaaacauccua

SEQ ID NO: 8125 - RNA, 38 nt, Artificial Sequence
  Description of Artificial Sequence:  Enzymatic Nucleic Acid
ggcugcagcugaugaggccguuaggccgaaaggugcag

SEQ ID NO: 8126 - RNA, 38 nt, Artificial Sequence
  Description of Artificial Sequence:  Enzymatic Nucleic Acid
uggcugcacugaugaggccguuaggccgaaaaggugca

SEQ ID NO: 8127 - RNA, 38 nt, Artificial Sequence
  Description of Artificial Sequence:  Enzymatic Nucleic Acid
cagcuucucugaugaggccguuaggccgaaacuggcug

SEQ ID NO: 8128 - RNA, 38 nt, Artificial Sequence
  Description of Artificial Sequence:  Enzymatic Nucleic Acid
gaagcagccugaugaggccguuaggccgaaauccacug

SEQ ID NO: 8129 - RNA, 38 nt, Artificial Sequence
  Description of Artificial Sequence:  Enzymatic Nucleic Acid
uccccaagcugaugaggccguuaggccgaaagcagcaa

SEQ ID NO: 8130 - RNA, 38 nt, Artificial Sequence
  Description of Artificial Sequence:  Enzymatic Nucleic Acid
cuccccaacugaugaggccguuaggccgaaaagcagca

SEQ ID NO: 8131 - RNA, 38 nt, Artificial Sequence
  Description of Artificial Sequence:  Enzymatic Nucleic Acid
uucucccccugaugaggccguuaggccgaaagaagcag

SEQ ID NO: 8132 - RNA, 38 nt, Artificial Sequence
  Description of Artificial Sequence:  Enzymatic Nucleic Acid
aggaagcacugaugaggccguuaggccgaaacucuucu

SEQ ID NO: 8133 - RNA, 38 nt, Artificial Sequence
  Description of Artificial Sequence:  Enzymatic Nucleic Acid
auaaaaggcugaugaggccguuaggccgaaagcauacu

SEQ ID NO: 8134 - RNA, 38 nt, Artificial Sequence
  Description of Artificial Sequence:  Enzymatic Nucleic Acid
gauaaaagcugaugaggccguuaggccgaaaagcauac

SEQ ID NO: 8135 - RNA, 38 nt, Artificial Sequence
  Description of Artificial Sequence:  Enzymatic Nucleic Acid
auggauaacugaugaggccguuaggccgaaaggaagca

SEQ ID NO: 8136 - RNA, 38 nt, Artificial Sequence
  Description of Artificial Sequence:  Enzymatic Nucleic Acid
cauggauacugaugaggccguuaggccgaaaaggaagc

SEQ ID NO: 8137 - RNA, 38 nt, Artificial Sequence
  Description of Artificial Sequence:  Enzymatic Nucleic Acid
acauggaucugaugaggccguuaggccgaaaaaggaag

SEQ ID NO: 8138 - RNA, 38 nt, Artificial Sequence
  Description of Artificial Sequence:  Enzymatic Nucleic Acid
uacauggacugaugaggccguuaggccgaaaaaaggaa

SEQ ID NO: 8139 - RNA, 38 nt, Artificial Sequence
  Description of Artificial Sequence:  Enzymatic Nucleic Acid
auuacaugcugaugaggccguuaggccgaaauaaaagg

SEQ ID NO: 8140 - RNA, 38 nt, Artificial Sequence
  Description of Artificial Sequence:  Enzymatic Nucleic Acid
aguuaaaucugaugaggccguuaggccgaaacauggau

SEQ ID NO: 8141 - RNA, 38 nt, Artificial Sequence
  Description of Artificial Sequence:  Enzymatic Nucleic Acid
uacaguuacugaugaggccguuaggccgaaauuacaug

SEQ ID NO: 8142 - RNA, 38 nt, Artificial Sequence
  Description of Artificial Sequence:  Enzymatic Nucleic Acid
cuacaguucugaugaggccguuaggccgaaaauuacau

SEQ ID NO: 8143 - RNA, 38 nt, Artificial Sequence
  Description of Artificial Sequence:  Enzymatic Nucleic Acid
ucuacagucugaugaggccguuaggccgaaaaauuaca

SEQ ID NO: 8144 - RNA, 38 nt, Artificial Sequence
  Description of Artificial Sequence:  Enzymatic Nucleic Acid
ucagguuccugaugaggccguuaggccgaaacaguuaa

SEQ ID NO: 8145 - RNA, 38 nt, Artificial Sequence
  Description of Artificial Sequence:  Enzymatic Nucleic Acid
guuacuuacugaugaggccguuaggccgaaagcucagg

SEQ ID NO: 8146 - RNA, 38 nt, Artificial Sequence
  Description of Artificial Sequence:  Enzymatic Nucleic Acid
cgguuacucugaugaggccguuaggccgaaagagcuca

SEQ ID NO: 8147 - RNA, 38 nt, Artificial Sequence
  Description of Artificial Sequence:  Enzymatic Nucleic Acid
ucuucggucugaugaggccguuaggccgaaacuuagag

SEQ ID NO: 8148 - RNA, 38 nt, Artificial Sequence
  Description of Artificial Sequence:  Enzymatic Nucleic Acid
cagaggcacugaugaggccguuaggccgaaacauucuu

SEQ ID NO: 8149 - RNA, 38 nt, Artificial Sequence
  Description of Artificial Sequence:  Enzymatic Nucleic Acid
uaagaacacugaugaggccguuaggccgaaaggcauac

SEQ ID NO: 8150 - RNA, 38 nt, Artificial Sequence
  Description of Artificial Sequence:  Enzymatic Nucleic Acid
cacauaagcugaugaggccguuaggccgaaacagaggc

SEQ ID NO: 8151 - RNA, 38 nt, Artificial Sequence
  Description of Artificial Sequence:  Enzymatic Nucleic Acid
gcacauaacugaugaggccguuaggccgaaaacagagg

SEQ ID NO: 8152 - RNA, 38 nt, Artificial Sequence
  Description of Artificial Sequence:  Enzymatic Nucleic Acid
uggcacaucugaugaggccguuaggccgaaagaacaga

SEQ ID NO: 8153 - RNA, 38 nt, Artificial Sequence
  Description of Artificial Sequence:  Enzymatic Nucleic Acid
guggcacacugaugaggccguuaggccgaaaagaacag

SEQ ID NO: 8154 - RNA, 38 nt, Artificial Sequence
  Description of Artificial Sequence:  Enzymatic Nucleic Acid
uaaacaagcugaugaggccguuaggccgaaauguggca

SEQ ID NO: 8155 - RNA, 38 nt, Artificial Sequence
  Description of Artificial Sequence:  Enzymatic Nucleic Acid
cuuuaaaccugaugaggccguuaggccgaaaggaugug

SEQ ID NO: 8156 - RNA, 38 nt, Artificial Sequence
  Description of Artificial Sequence:  Enzymatic Nucleic Acid
agccuuuacugaugaggccguuaggccgaaacaaggau

SEQ ID NO: 8157 - RNA, 38 nt, Artificial Sequence
  Description of Artificial Sequence:  Enzymatic Nucleic Acid
gagccuuucugaugaggccguuaggccgaaaacaagga

SEQ ID NO: 8158 - RNA, 38 nt, Artificial Sequence
  Description of Artificial Sequence:  Enzymatic Nucleic Acid
agagccuucugaugaggccguuaggccgaaaaacaagg

SEQ ID NO: 8159 - RNA, 38 nt, Artificial Sequence
  Description of Artificial Sequence:  Enzymatic Nucleic Acid
cauacagacugaugaggccguuaggccgaaagccuuua

SEQ ID NO: 8160 - RNA, 38 nt, Artificial Sequence
  Description of Artificial Sequence:  Enzymatic Nucleic Acid
uucauacacugaugaggccguuaggccgaaagagccuu

SEQ ID NO: 8161 - RNA, 38 nt, Artificial Sequence
  Description of Artificial Sequence:  Enzymatic Nucleic Acid
ucucuucacugaugaggccguuaggccgaaacagagag

SEQ ID NO: 8162 - RNA, 38 nt, Artificial Sequence
  Description of Artificial Sequence:  Enzymatic Nucleic Acid
gugcugaucugaugaggccguuaggccgaaacgguccc

SEQ ID NO: 8163 - RNA, 38 nt, Artificial Sequence
  Description of Artificial Sequence:  Enzymatic Nucleic Acid
aaugugcucugaugaggccguuaggccgaaaugacggu

SEQ ID NO: 8164 - RNA, 38 nt, Artificial Sequence
  Description of Artificial Sequence:  Enzymatic Nucleic Acid
cacuagggcugaugaggccguuaggccgaaaugugcug

SEQ ID NO: 8165 - RNA, 38 nt, Artificial Sequence
  Description of Artificial Sequence:  Enzymatic Nucleic Acid
ucacuaggcugaugaggccguuaggccgaaaaugugcu

SEQ ID NO: 8166 - RNA, 38 nt, Artificial Sequence
  Description of Artificial Sequence:  Enzymatic Nucleic Acid
aggcucaccugaugaggccguuaggccgaaagggaaug

SEQ ID NO: 8167 - RNA, 38 nt, Artificial Sequence
  Description of Artificial Sequence:  Enzymatic Nucleic Acid
ggagccagcugaugaggccguuaggccgaaaggcucac

SEQ ID NO: 8168 - RNA, 38 nt, Artificial Sequence
  Description of Artificial Sequence:  Enzymatic Nucleic Acid
gcugccagcugaugaggccguuaggccgaaagccagua

SEQ ID NO: 8169 - RNA, 38 nt, Artificial Sequence
  Description of Artificial Sequence:  Enzymatic Nucleic Acid
uuccacaacugaugaggccguuaggccgaaagccgcug

SEQ ID NO: 8170 - RNA, 38 nt, Artificial Sequence
  Description of Artificial Sequence:  Enzymatic Nucleic Acid
cuuccacacugaugaggccguuaggccgaaaagccgcu

SEQ ID NO: 8171 - RNA, 38 nt, Artificial Sequence
  Description of Artificial Sequence:  Enzymatic Nucleic Acid
ucuuccaccugaugaggccguuaggccgaaaaagccgc

SEQ ID NO: 8172 - RNA, 38 nt, Artificial Sequence
  Description of Artificial Sequence:  Enzymatic Nucleic Acid
uggcuagucugaugaggccguuaggccgaaagucuucc

SEQ ID NO: 8173 - RNA, 38 nt, Artificial Sequence
  Description of Artificial Sequence:  Enzymatic Nucleic Acid
cuucuggccugaugaggccguuaggccgaaagugaguc

SEQ ID NO: 8174 - RNA, 38 nt, Artificial Sequence
  Description of Artificial Sequence:  Enzymatic Nucleic Acid
guggagagcugaugaggccguuaggccgaaacuguccc

SEQ ID NO: 8175 - RNA, 38 nt, Artificial Sequence
  Description of Artificial Sequence:  Enzymatic Nucleic Acid
uugguggacugaugaggccguuaggccgaaaggacugu

SEQ ID NO: 8176 - RNA, 38 nt, Artificial Sequence
  Description of Artificial Sequence:  Enzymatic Nucleic Acid
ucuuggugcugaugaggccguuaggccgaaagaggacu

SEQ ID NO: 8177 - RNA, 38 nt, Artificial Sequence
  Description of Artificial Sequence:  Enzymatic Nucleic Acid
uggauuuacugaugaggccguuaggccgaaaucuuggu

SEQ ID NO: 8178 - RNA, 38 nt, Artificial Sequence
  Description of Artificial Sequence:  Enzymatic Nucleic Acid
uuuggauucugaugaggccguuaggccgaaagaucuug

SEQ ID NO: 8179 - RNA, 38 nt, Artificial Sequence
  Description of Artificial Sequence:  Enzymatic Nucleic Acid
uuuguuugcugaugaggccguuaggccgaaauuuagau

SEQ ID NO: 8180 - RNA, 38 nt, Artificial Sequence
  Description of Artificial Sequence:  Enzymatic Nucleic Acid
ucuggcuccugaugaggccguuaggccgaaagccugcu

SEQ ID NO: 8181 - RNA, 38 nt, Artificial Sequence
  Description of Artificial Sequence:  Enzymatic Nucleic Acid
acaacaaacugaugaggccguuaggccgaaauuugucc

SEQ ID NO: 8182 - RNA, 38 nt, Artificial Sequence
  Description of Artificial Sequence:  Enzymatic Nucleic Acid
gaacaacacugaugaggccguuaggccgaaagauuugu

SEQ ID NO: 8183 - RNA, 38 nt, Artificial Sequence
  Description of Artificial Sequence:  Enzymatic Nucleic Acid
ggaacaaccugaugaggccguuaggccgaaaagauuug

SEQ ID NO: 8184 - RNA, 38 nt, Artificial Sequence
  Description of Artificial Sequence:  Enzymatic Nucleic Acid
agaggaaccugaugaggccguuaggccgaaacaaagau

SEQ ID NO: 8185 - RNA, 38 nt, Artificial Sequence
  Description of Artificial Sequence:  Enzymatic Nucleic Acid
agaagaggcugaugaggccguuaggccgaaacaacaaa

SEQ ID NO: 8186 - RNA, 38 nt, Artificial Sequence
  Description of Artificial Sequence:  Enzymatic Nucleic Acid
aagaagagcugaugaggccguuaggccgaaaacaacaa

SEQ ID NO: 8187 - RNA, 38 nt, Artificial Sequence
  Description of Artificial Sequence:  Enzymatic Nucleic Acid
guaaagaacugaugaggccguuaggccgaaaggaacaa

SEQ ID NO: 8188 - RNA, 38 nt, Artificial Sequence
  Description of Artificial Sequence:  Enzymatic Nucleic Acid
guguaaagcugaugaggccguuaggccgaaagaggaac

SEQ ID NO: 8189 - RNA, 38 nt, Artificial Sequence
  Description of Artificial Sequence:  Enzymatic Nucleic Acid
uguguaaacugaugaggccguuaggccgaaaagaggaa

SEQ ID NO: 8190 - RNA, 38 nt, Artificial Sequence
  Description of Artificial Sequence:  Enzymatic Nucleic Acid
uauguguacugaugaggccguuaggccgaaagaagagg

SEQ ID NO: 8191 - RNA, 38 nt, Artificial Sequence
  Description of Artificial Sequence:  Enzymatic Nucleic Acid
guaugugucugaugaggccguuaggccgaaaagaagag

SEQ ID NO: 8192 - RNA, 38 nt, Artificial Sequence
  Description of Artificial Sequence:  Enzymatic Nucleic Acid
cguaugugcugaugaggccguuaggccgaaaaagaaga

SEQ ID NO: 8193 - RNA, 38 nt, Artificial Sequence
  Description of Artificial Sequence:  Enzymatic Nucleic Acid
gguuugcgcugaugaggccguuaggccgaaauguguaa

SEQ ID NO: 8194 - RNA, 38 nt, Artificial Sequence
  Description of Artificial Sequence:  Enzymatic Nucleic Acid
auuuauaacugaugaggccguuaggccgaaauugccag

SEQ ID NO: 8195 - RNA, 38 nt, Artificial Sequence
  Description of Artificial Sequence:  Enzymatic Nucleic Acid
gauuuauacugaugaggccguuaggccgaaaauugcca

SEQ ID NO: 8196 - RNA, 38 nt, Artificial Sequence
  Description of Artificial Sequence:  Enzymatic Nucleic Acid
ugauuuaucugaugaggccguuaggccgaaaaauugcc

SEQ ID NO: 8197 - RNA, 38 nt, Artificial Sequence
  Description of Artificial Sequence:  Enzymatic Nucleic Acid
cugauuuacugaugaggccguuaggccgaaaaaauugc

SEQ ID NO: 8198 - RNA, 38 nt, Artificial Sequence
  Description of Artificial Sequence:  Enzymatic Nucleic Acid
accugauucugaugaggccguuaggccgaaauaaaauu

SEQ ID NO: 8199 - RNA, 38 nt, Artificial Sequence
  Description of Artificial Sequence:  Enzymatic Nucleic Acid
aguuaccucugaugaggccguuaggccgaaauuuauaa

SEQ ID NO: 8200 - RNA, 38 nt, Artificial Sequence
  Description of Artificial Sequence:  Enzymatic Nucleic Acid
cuuccagucugaugaggccguuaggccgaaaccugauu

SEQ ID NO: 8201 - RNA, 38 nt, Artificial Sequence
  Description of Artificial Sequence:  Enzymatic Nucleic Acid
cugaguuucugaugaggccguuaggccgaaaccuccuu

SEQ ID NO: 8202 - RNA, 38 nt, Artificial Sequence
  Description of Artificial Sequence:  Enzymatic Nucleic Acid
ucugaguucugaugaggccguuaggccgaaaaccuccu

SEQ ID NO: 8203 - RNA, 38 nt, Artificial Sequence
  Description of Artificial Sequence:  Enzymatic Nucleic Acid
uuuuuucucugaugaggccguuaggccgaaaguuuaac

SEQ ID NO: 8204 - RNA, 38 nt, Artificial Sequence
  Description of Artificial Sequence:  Enzymatic Nucleic Acid
aauugacucugaugaggccguuaggccgaaaggucuuc

SEQ ID NO: 8205 - RNA, 38 nt, Artificial Sequence
  Description of Artificial Sequence:  Enzymatic Nucleic Acid
agagaauucugaugaggccguuaggccgaaacugaggu

SEQ ID NO: 8206 - RNA, 38 nt, Artificial Sequence
  Description of Artificial Sequence:  Enzymatic Nucleic Acid
aaguagagcugaugaggccguuaggccgaaauugacug

SEQ ID NO: 8207 - RNA, 38 nt, Artificial Sequence
  Description of Artificial Sequence:  Enzymatic Nucleic Acid
aaaguagacugaugaggccguuaggccgaaaauugacu

SEQ ID NO: 8208 - RNA, 38 nt, Artificial Sequence
  Description of Artificial Sequence:  Enzymatic Nucleic Acid
aaaaaguacugaugaggccguuaggccgaaagaauuga

SEQ ID NO: 8209 - RNA, 38 nt, Artificial Sequence
  Description of Artificial Sequence:  Enzymatic Nucleic Acid
aaaaaaagcugaugaggccguuaggccgaaagagaauu

SEQ ID NO: 8210 - RNA, 38 nt, Artificial Sequence
  Description of Artificial Sequence:  Enzymatic Nucleic Acid
aaaaaaaacugaugaggccguuaggccgaaaguagaga

SEQ ID NO: 8211 - RNA, 38 nt, Artificial Sequence
  Description of Artificial Sequence:  Enzymatic Nucleic Acid
aaaaaaaacugaugaggccguuaggccgaaaaguagag

SEQ ID NO: 8212 - RNA, 38 nt, Artificial Sequence
  Description of Artificial Sequence:  Enzymatic Nucleic Acid
aaaaaaaacugaugaggccguuaggccgaaaaaguaga

SEQ ID NO: 8213 - RNA, 38 nt, Artificial Sequence
  Description of Artificial Sequence:  Enzymatic Nucleic Acid
aaaaaaaacugaugaggccguuaggccgaaaaaaguag

SEQ ID NO: 8214 - RNA, 38 nt, Artificial Sequence
  Description of Artificial Sequence:  Enzymatic Nucleic Acid
aaaaaaaacugaugaggccguuaggccgaaaaaaagua

SEQ ID NO: 8215 - RNA, 38 nt, Artificial Sequence
  Description of Artificial Sequence:  Enzymatic Nucleic Acid
aaaaaaaacugaugaggccguuaggccgaaaaaaaagu

SEQ ID NO: 8216 - RNA, 38 nt, Artificial Sequence
  Description of Artificial Sequence:  Enzymatic Nucleic Acid
aaaaaaaacugaugaggccguuaggccgaaaaaaaaag

SEQ ID NO: 8217 - RNA, 38 nt, Artificial Sequence
  Description of Artificial Sequence:  Enzymatic Nucleic Acid
gaaaaaaacugaugaggccguuaggccgaaaaaaaaaa

SEQ ID NO: 8218 - RNA, 38 nt, Artificial Sequence
  Description of Artificial Sequence:  Enzymatic Nucleic Acid
ggaaaaaacugaugaggccguuaggccgaaaaaaaaaa

SEQ ID NO: 8219 - RNA, 38 nt, Artificial Sequence
  Description of Artificial Sequence:  Enzymatic Nucleic Acid
uggaaaaacugaugaggccguuaggccgaaaaaaaaaa

SEQ ID NO: 8220 - RNA, 38 nt, Artificial Sequence
  Description of Artificial Sequence:  Enzymatic Nucleic Acid
uuggaaaacugaugaggccguuaggccgaaaaaaaaaa

SEQ ID NO: 8221 - RNA, 38 nt, Artificial Sequence
  Description of Artificial Sequence:  Enzymatic Nucleic Acid
uuuggaaacugaugaggccguuaggccgaaaaaaaaaa

SEQ ID NO: 8222 - RNA, 38 nt, Artificial Sequence
  Description of Artificial Sequence:  Enzymatic Nucleic Acid
auuuggaacugaugaggccguuaggccgaaaaaaaaaa

SEQ ID NO: 8223 - RNA, 38 nt, Artificial Sequence
  Description of Artificial Sequence:  Enzymatic Nucleic Acid
gauuuggacugaugaggccguuaggccgaaaaaaaaaa

SEQ ID NO: 8224 - RNA, 38 nt, Artificial Sequence
  Description of Artificial Sequence:  Enzymatic Nucleic Acid
ugauuuggcugaugaggccguuaggccgaaaaaaaaaa

SEQ ID NO: 8225 - RNA, 38 nt, Artificial Sequence
  Description of Artificial Sequence:  Enzymatic Nucleic Acid
cugauuugcugaugaggccguuaggccgaaaaaaaaaa

SEQ ID NO: 8226 - RNA, 38 nt, Artificial Sequence
  Description of Artificial Sequence:  Enzymatic Nucleic Acid
uauuaucucugaugaggccguuaggccgaaauuuggaa

SEQ ID NO: 8227 - RNA, 38 nt, Artificial Sequence
  Description of Artificial Sequence:  Enzymatic Nucleic Acid
ugggcuaucugaugaggccguuaggccgaaaucugauu

SEQ ID NO: 8228 - RNA, 38 nt, Artificial Sequence
  Description of Artificial Sequence:  Enzymatic Nucleic Acid
ugcugggccugaugaggccguuaggccgaaauuaucug

SEQ ID NO: 8229 - RNA, 38 nt, Artificial Sequence
  Description of Artificial Sequence:  Enzymatic Nucleic Acid
guuaucaccugaugaggccguuaggccgaaauuugcug

SEQ ID NO: 8230 - RNA, 38 nt, Artificial Sequence
  Description of Artificial Sequence:  Enzymatic Nucleic Acid
uuauuugucugaugaggccguuaggccgaaaucacuau

SEQ ID NO: 8231 - RNA, 38 nt, Artificial Sequence
  Description of Artificial Sequence:  Enzymatic Nucleic Acid
uaagguuucugaugaggccguuaggccgaaauuuguua

SEQ ID NO: 8232 - RNA, 38 nt, Artificial Sequence
  Description of Artificial Sequence:  Enzymatic Nucleic Acid
gaacagcucugaugaggccguuaggccgaaagguuuua

SEQ ID NO: 8233 - RNA, 38 nt, Artificial Sequence
  Description of Artificial Sequence:  Enzymatic Nucleic Acid
ugaacagccugaugaggccguuaggccgaaaagguuuu

SEQ ID NO: 8234 - RNA, 38 nt, Artificial Sequence
  Description of Artificial Sequence:  Enzymatic Nucleic Acid
aagacaugcugaugaggccguuaggccgaaacagcuaa

SEQ ID NO: 8235 - RNA, 38 nt, Artificial Sequence
  Description of Artificial Sequence:  Enzymatic Nucleic Acid
caagacaucugaugaggccguuaggccgaaaacagcua

SEQ ID NO: 8236 - RNA, 38 nt, Artificial Sequence
  Description of Artificial Sequence:  Enzymatic Nucleic Acid
gaaaucaacugaugaggccguuaggccgaaacaugaac

SEQ ID NO: 8237 - RNA, 38 nt, Artificial Sequence
  Description of Artificial Sequence:  Enzymatic Nucleic Acid
uugaaauccugaugaggccguuaggccgaaagacauga

SEQ ID NO: 8238 - RNA, 38 nt, Artificial Sequence
  Description of Artificial Sequence:  Enzymatic Nucleic Acid
auuauugacugaugaggccguuaggccgaaaucaagac

SEQ ID NO: 8239 - RNA, 38 nt, Artificial Sequence
  Description of Artificial Sequence:  Enzymatic Nucleic Acid
aauuauugcugaugaggccguuaggccgaaaaucaaga

SEQ ID NO: 8240 - RNA, 38 nt, Artificial Sequence
  Description of Artificial Sequence:  Enzymatic Nucleic Acid
uaauuauucugaugaggccguuaggccgaaaaaucaag

SEQ ID NO: 8241 - RNA, 38 nt, Artificial Sequence
  Description of Artificial Sequence:  Enzymatic Nucleic Acid
gaauuaaucugaugaggccguuaggccgaaauugaaau

SEQ ID NO: 8242 - RNA, 38 nt, Artificial Sequence
  Description of Artificial Sequence:  Enzymatic Nucleic Acid
uaagaauucugaugaggccguuaggccgaaauuauuga

SEQ ID NO: 8243 - RNA, 38 nt, Artificial Sequence
  Description of Artificial Sequence:  Enzymatic Nucleic Acid
uuaagaaucugaugaggccguuaggccgaaaauuauug

SEQ ID NO: 8244 - RNA, 38 nt, Artificial Sequence
  Description of Artificial Sequence:  Enzymatic Nucleic Acid
ugauuaagcugaugaggccguuaggccgaaauuaauua

SEQ ID NO: 8245 - RNA, 38 nt, Artificial Sequence
  Description of Artificial Sequence:  Enzymatic Nucleic Acid
augauuaacugaugaggccguuaggccgaaaauuaauu

SEQ ID NO: 8246 - RNA, 38 nt, Artificial Sequence
  Description of Artificial Sequence:  Enzymatic Nucleic Acid
uaaugauucugaugaggccguuaggccgaaagaauuaa

SEQ ID NO: 8247 - RNA, 38 nt, Artificial Sequence
  Description of Artificial Sequence:  Enzymatic Nucleic Acid
uuaaugaucugaugaggccguuaggccgaaaagaauua

SEQ ID NO: 8248 - RNA, 38 nt, Artificial Sequence
  Description of Artificial Sequence:  Enzymatic Nucleic Acid
cucuuaaucugaugaggccguuaggccgaaauuaagaa

SEQ ID NO: 8249 - RNA, 38 nt, Artificial Sequence
  Description of Artificial Sequence:  Enzymatic Nucleic Acid
ggucucuucugaugaggccguuaggccgaaaugauuaa

SEQ ID NO: 8250 - RNA, 38 nt, Artificial Sequence
  Description of Artificial Sequence:  Enzymatic Nucleic Acid
uggucucucugaugaggccguuaggccgaaaaugauua

SEQ ID NO: 8251 - RNA, 38 nt, Artificial Sequence
  Description of Artificial Sequence:  Enzymatic Nucleic Acid
guauuuaucugaugaggccguuaggccgaaauggucuc

SEQ ID NO: 8252 - RNA, 38 nt, Artificial Sequence
  Description of Artificial Sequence:  Enzymatic Nucleic Acid
ggaguauucugaugaggccguuaggccgaaauuauggu

SEQ ID NO: 8253 - RNA, 38 nt, Artificial Sequence
  Description of Artificial Sequence:  Enzymatic Nucleic Acid
aaaaggagcugaugaggccguuaggccgaaauuuauua

SEQ ID NO: 8254 - RNA, 38 nt, Artificial Sequence
  Description of Artificial Sequence:  Enzymatic Nucleic Acid
uugaaaagcugaugaggccguuaggccgaaaguauuua

SEQ ID NO: 8255 - RNA, 38 nt, Artificial Sequence
  Description of Artificial Sequence:  Enzymatic Nucleic Acid
cucuugaacugaugaggccguuaggccgaaaggaguau

SEQ ID NO: 8256 - RNA, 38 nt, Artificial Sequence
  Description of Artificial Sequence:  Enzymatic Nucleic Acid
ucucuugacugaugaggccguuaggccgaaaaggagua

SEQ ID NO: 8257 - RNA, 38 nt, Artificial Sequence
  Description of Artificial Sequence:  Enzymatic Nucleic Acid
uucucuugcugaugaggccguuaggccgaaaaaggagu

SEQ ID NO: 8258 - RNA, 38 nt, Artificial Sequence
  Description of Artificial Sequence:  Enzymatic Nucleic Acid
uuucucuucugaugaggccguuaggccgaaaaaaggag

SEQ ID NO: 8259 - RNA, 38 nt, Artificial Sequence
  Description of Artificial Sequence:  Enzymatic Nucleic Acid
acaauucucugaugaggccguuaggccgaaaugguuuu

SEQ ID NO: 8260 - RNA, 38 nt, Artificial Sequence
  Description of Artificial Sequence:  Enzymatic Nucleic Acid
aacaauuccugaugaggccguuaggccgaaaaugguuu

SEQ ID NO: 8261 - RNA, 38 nt, Artificial Sequence
  Description of Artificial Sequence:  Enzymatic Nucleic Acid
ugaguaaccugaugaggccguuaggccgaaauucuaau

SEQ ID NO: 8262 - RNA, 38 nt, Artificial Sequence
  Description of Artificial Sequence:  Enzymatic Nucleic Acid
agcugagucugaugaggccguuaggccgaaacaauucu

SEQ ID NO: 8263 - RNA, 38 nt, Artificial Sequence
  Description of Artificial Sequence:  Enzymatic Nucleic Acid
gagcugagcugaugaggccguuaggccgaaaacaauuc

SEQ ID NO: 8264 - RNA, 38 nt, Artificial Sequence
  Description of Artificial Sequence:  Enzymatic Nucleic Acid
aaggagcucugaugaggccguuaggccgaaaguaacaa

SEQ ID NO: 8265 - RNA, 38 nt, Artificial Sequence
  Description of Artificial Sequence:  Enzymatic Nucleic Acid
guuugaagcugaugaggccguuaggccgaaagcugagu

SEQ ID NO: 8266 - RNA, 38 nt, Artificial Sequence
  Description of Artificial Sequence:  Enzymatic Nucleic Acid
ugaguuugcugaugaggccguuaggccgaaaggagcug

SEQ ID NO: 8267 - RNA, 38 nt, Artificial Sequence
  Description of Artificial Sequence:  Enzymatic Nucleic Acid
cugaguuucugaugaggccguuaggccgaaaaggagcu

SEQ ID NO: 8268 - RNA, 38 nt, Artificial Sequence
  Description of Artificial Sequence:  Enzymatic Nucleic Acid
acaaaccucugaugaggccguuaggccgaaaguuugaa

SEQ ID NO: 8269 - RNA, 38 nt, Artificial Sequence
  Description of Artificial Sequence:  Enzymatic Nucleic Acid
augcuacacugaugaggccguuaggccgaaaccugagu

SEQ ID NO: 8270 - RNA, 38 nt, Artificial Sequence
  Description of Artificial Sequence:  Enzymatic Nucleic Acid
uaugcuaccugaugaggccguuaggccgaaaaccugag

SEQ ID NO: 8271 - RNA, 38 nt, Artificial Sequence
  Description of Artificial Sequence:  Enzymatic Nucleic Acid
auguaugccugaugaggccguuaggccgaaacaaaccu

SEQ ID NO: 8272 - RNA, 38 nt, Artificial Sequence
  Description of Artificial Sequence:  Enzymatic Nucleic Acid
gacucaugcugaugaggccguuaggccgaaaugcuaca

SEQ ID NO: 8273 - RNA, 38 nt, Artificial Sequence
  Description of Artificial Sequence:  Enzymatic Nucleic Acid
gauggaugcugaugaggccguuaggccgaaacucaugu

SEQ ID NO: 8274 - RNA, 38 nt, Artificial Sequence
  Description of Artificial Sequence:  Enzymatic Nucleic Acid
gacugaugcugaugaggccguuaggccgaaauggacuc

SEQ ID NO: 8275 - RNA, 38 nt, Artificial Sequence
  Description of Artificial Sequence:  Enzymatic Nucleic Acid
cuuugacucugaugaggccguuaggccgaaauggaugg

SEQ ID NO: 8276 - RNA, 38 nt, Artificial Sequence
  Description of Artificial Sequence:  Enzymatic Nucleic Acid
cauucuuucugaugaggccguuaggccgaaacugaugg

SEQ ID NO: 8277 - RNA, 38 nt, Artificial Sequence
  Description of Artificial Sequence:  Enzymatic Nucleic Acid
ccagauggcugaugaggccguuaggccgaaaccauucu

SEQ ID NO: 8278 - RNA, 38 nt, Artificial Sequence
  Description of Artificial Sequence:  Enzymatic Nucleic Acid
uccagaugcugaugaggccguuaggccgaaaaccauuc

SEQ ID NO: 8279 - RNA, 38 nt, Artificial Sequence
  Description of Artificial Sequence:  Enzymatic Nucleic Acid
agacuccacugaugaggccguuaggccgaaauggaacc

SEQ ID NO: 8280 - RNA, 38 nt, Artificial Sequence
  Description of Artificial Sequence:  Enzymatic Nucleic Acid
uacauuaacugaugaggccguuaggccgaaacuccaga

SEQ ID NO: 8281 - RNA, 38 nt, Artificial Sequence
  Description of Artificial Sequence:  Enzymatic Nucleic Acid
ucuacauucugaugaggccguuaggccgaaagacucca

SEQ ID NO: 8282 - RNA, 38 nt, Artificial Sequence
  Description of Artificial Sequence:  Enzymatic Nucleic Acid
uucuacaucugaugaggccguuaggccgaaaagacucc

SEQ ID NO: 8283 - RNA, 38 nt, Artificial Sequence
  Description of Artificial Sequence:  Enzymatic Nucleic Acid
uuucuuuccugaugaggccguuaggccgaaacauuaag

SEQ ID NO: 8284 - RNA, 38 nt, Artificial Sequence
  Description of Artificial Sequence:  Enzymatic Nucleic Acid
auuauuaccugaugaggccguuaggccgaaagucucca

SEQ ID NO: 8285 - RNA, 38 nt, Artificial Sequence
  Description of Artificial Sequence:  Enzymatic Nucleic Acid
cucauuaucugaugaggccguuaggccgaaacaagucu

SEQ ID NO: 8286 - RNA, 38 nt, Artificial Sequence
  Description of Artificial Sequence:  Enzymatic Nucleic Acid
uagcucaucugaugaggccguuaggccgaaauuacaag

SEQ ID NO: 8287 - RNA, 38 nt, Artificial Sequence
  Description of Artificial Sequence:  Enzymatic Nucleic Acid
uuuguaaccugaugaggccguuaggccgaaagcucauu

SEQ ID NO: 8288 - RNA, 38 nt, Artificial Sequence
  Description of Artificial Sequence:  Enzymatic Nucleic Acid
cacuuugucugaugaggccguuaggccgaaacuagcuc

SEQ ID NO: 8289 - RNA, 38 nt, Artificial Sequence
  Description of Artificial Sequence:  Enzymatic Nucleic Acid
gcacuuugcugaugaggccguuaggccgaaaacuagcu

SEQ ID NO: 8290 - RNA, 38 nt, Artificial Sequence
  Description of Artificial Sequence:  Enzymatic Nucleic Acid
uaaugaaccugaugaggccguuaggccgaaagcacuuu

SEQ ID NO: 8291 - RNA, 38 nt, Artificial Sequence
  Description of Artificial Sequence:  Enzymatic Nucleic Acid
uuuuaaugcugaugaggccguuaggccgaaacaagcac

SEQ ID NO: 8292 - RNA, 38 nt, Artificial Sequence
  Description of Artificial Sequence:  Enzymatic Nucleic Acid
auuuuaaucugaugaggccguuaggccgaaaacaagca

SEQ ID NO: 8293 - RNA, 38 nt, Artificial Sequence
  Description of Artificial Sequence:  Enzymatic Nucleic Acid
gcuauuuucugaugaggccguuaggccgaaaugaacaa

SEQ ID NO: 8294 - RNA, 38 nt, Artificial Sequence
  Description of Artificial Sequence:  Enzymatic Nucleic Acid
ugcuauuucugaugaggccguuaggccgaaaaugaaca

SEQ ID NO: 8295 - RNA, 38 nt, Artificial Sequence
  Description of Artificial Sequence:  Enzymatic Nucleic Acid
uucagugccugaugaggccguuaggccgaaauuuuaau

SEQ ID NO: 8296 - RNA, 38 nt, Artificial Sequence
  Description of Artificial Sequence:  Enzymatic Nucleic Acid
cauguuuccugaugaggccguuaggccgaaauuuucag

SEQ ID NO: 8297 - RNA, 38 nt, Artificial Sequence
  Description of Artificial Sequence:  Enzymatic Nucleic Acid
uaucaguucugaugaggccguuaggccgaaauucaugu

SEQ ID NO: 8298 - RNA, 38 nt, Artificial Sequence
  Description of Artificial Sequence:  Enzymatic Nucleic Acid
uuaucagucugaugaggccguuaggccgaaaauucaug

SEQ ID NO: 8299 - RNA, 38 nt, Artificial Sequence
  Description of Artificial Sequence:  Enzymatic Nucleic Acid
uggaauaucugaugaggccguuaggccgaaaucaguua

SEQ ID NO: 8300 - RNA, 38 nt, Artificial Sequence
  Description of Artificial Sequence:  Enzymatic Nucleic Acid
gauuggaacugaugaggccguuaggccgaaauuaucag

SEQ ID NO: 8301 - RNA, 38 nt, Artificial Sequence
  Description of Artificial Sequence:  Enzymatic Nucleic Acid
augauuggcugaugaggccguuaggccgaaauauuauc

SEQ ID NO: 8302 - RNA, 38 nt, Artificial Sequence
  Description of Artificial Sequence:  Enzymatic Nucleic Acid
aaugauugcugaugaggccguuaggccgaaaauauuau

SEQ ID NO: 8303 - RNA, 38 nt, Artificial Sequence
  Description of Artificial Sequence:  Enzymatic Nucleic Acid
uggcaaaucugaugaggccguuaggccgaaauuggaau

SEQ ID NO: 8304 - RNA, 38 nt, Artificial Sequence
  Description of Artificial Sequence:  Enzymatic Nucleic Acid
aaauggcacugaugaggccguuaggccgaaaugauugg

SEQ ID NO: 8305 - RNA, 38 nt, Artificial Sequence
  Description of Artificial Sequence:  Enzymatic Nucleic Acid
uaaauggccugaugaggccguuaggccgaaaaugauug

SEQ ID NO: 8306 - RNA, 38 nt, Artificial Sequence
  Description of Artificial Sequence:  Enzymatic Nucleic Acid
uugucauacugaugaggccguuaggccgaaauggcaaa

SEQ ID NO: 8307 - RNA, 38 nt, Artificial Sequence
  Description of Artificial Sequence:  Enzymatic Nucleic Acid
uuugucaucugaugaggccguuaggccgaaaauggcaa

SEQ ID NO: 8308 - RNA, 38 nt, Artificial Sequence
  Description of Artificial Sequence:  Enzymatic Nucleic Acid
uuuugucacugaugaggccguuaggccgaaaaauggca

SEQ ID NO: 8309 - RNA, 38 nt, Artificial Sequence
  Description of Artificial Sequence:  Enzymatic Nucleic Acid
uuagugcccugaugaggccguuaggccgaaaccauuuu

SEQ ID NO: 8310 - RNA, 38 nt, Artificial Sequence
  Description of Artificial Sequence:  Enzymatic Nucleic Acid
uucuuugucugaugaggccguuaggccgaaagugccaa

SEQ ID NO: 8311 - RNA, 38 nt, Artificial Sequence
  Description of Artificial Sequence:  Enzymatic Nucleic Acid
cugaaaggcugaugaggccguuaggccgaaagugcucg

SEQ ID NO: 8312 - RNA, 38 nt, Artificial Sequence
  Description of Artificial Sequence:  Enzymatic Nucleic Acid
ucugaaagcugaugaggccguuaggccgaaaagugcuc

SEQ ID NO: 8313 - RNA, 38 nt, Artificial Sequence
  Description of Artificial Sequence:  Enzymatic Nucleic Acid
aacucugacugaugaggccguuaggccgaaaggaagug

SEQ ID NO: 8314 - RNA, 38 nt, Artificial Sequence
  Description of Artificial Sequence:  Enzymatic Nucleic Acid
aaacucugcugaugaggccguuaggccgaaaaggaagu

SEQ ID NO: 8315 - RNA, 38 nt, Artificial Sequence
  Description of Artificial Sequence:  Enzymatic Nucleic Acid
gaaacucucugaugaggccguuaggccgaaaaaggaag

SEQ ID NO: 8316 - RNA, 38 nt, Artificial Sequence
  Description of Artificial Sequence:  Enzymatic Nucleic Acid
aucucagacugaugaggccguuaggccgaaacucugaa

SEQ ID NO: 8317 - RNA, 38 nt, Artificial Sequence
  Description of Artificial Sequence:  Enzymatic Nucleic Acid
uaucucagcugaugaggccguuaggccgaaaacucuga

SEQ ID NO: 8318 - RNA, 38 nt, Artificial Sequence
  Description of Artificial Sequence:  Enzymatic Nucleic Acid
uuaucucacugaugaggccguuaggccgaaaaacucug

SEQ ID NO: 8319 - RNA, 38 nt, Artificial Sequence
  Description of Artificial Sequence:  Enzymatic Nucleic Acid
acguacaucugaugaggccguuaggccgaaaucucaga

SEQ ID NO: 8320 - RNA, 38 nt, Artificial Sequence
  Description of Artificial Sequence:  Enzymatic Nucleic Acid
guuccacgcugaugaggccguuaggccgaaacauuauc

SEQ ID NO: 8321 - RNA, 38 nt, Artificial Sequence
  Description of Artificial Sequence:  Enzymatic Nucleic Acid
uccacccacugaugaggccguuaggccgaaacuguucc

SEQ ID NO: 8322 - RNA, 38 nt, Artificial Sequence
  Description of Artificial Sequence:  Enzymatic Nucleic Acid
aagacacacugaugaggccguuaggccgaaacuugcac

SEQ ID NO: 8323 - RNA, 38 nt, Artificial Sequence
  Description of Artificial Sequence:  Enzymatic Nucleic Acid
acugacaacugaugaggccguuaggccgaaacacagac

SEQ ID NO: 8324 - RNA, 38 nt, Artificial Sequence
  Description of Artificial Sequence:  Enzymatic Nucleic Acid
ggacugaccugaugaggccguuaggccgaaagacacag

SEQ ID NO: 8325 - RNA, 38 nt, Artificial Sequence
  Description of Artificial Sequence:  Enzymatic Nucleic Acid
cuuggacucugaugaggccguuaggccgaaacaagaca

SEQ ID NO: 8326 - RNA, 38 nt, Artificial Sequence
  Description of Artificial Sequence:  Enzymatic Nucleic Acid
acuucuugcugaugaggccguuaggccgaaacugacaa

SEQ ID NO: 8327 - RNA, 38 nt, Artificial Sequence
  Description of Artificial Sequence:  Enzymatic Nucleic Acid
cuaaaauucugaugaggccguuaggccgaaacaucucg

SEQ ID NO: 8328 - RNA, 38 nt, Artificial Sequence
  Description of Artificial Sequence:  Enzymatic Nucleic Acid
ccuaaaaucugaugaggccguuaggccgaaaacaucuc

SEQ ID NO: 8329 - RNA, 38 nt, Artificial Sequence
  Description of Artificial Sequence:  Enzymatic Nucleic Acid
gucccuaacugaugaggccguuaggccgaaauuaacau

SEQ ID NO: 8330 - RNA, 38 nt, Artificial Sequence
  Description of Artificial Sequence:  Enzymatic Nucleic Acid
ggucccuacugaugaggccguuaggccgaaaauuaaca

SEQ ID NO: 8331 - RNA, 38 nt, Artificial Sequence
  Description of Artificial Sequence:  Enzymatic Nucleic Acid
gggucccucugaugaggccguuaggccgaaaaauuaac

SEQ ID NO: 8332 - RNA, 38 nt, Artificial Sequence
  Description of Artificial Sequence:  Enzymatic Nucleic Acid
cggguccccugaugaggccguuaggccgaaaaaauuaa

SEQ ID NO: 8333 - RNA, 38 nt, Artificial Sequence
  Description of Artificial Sequence:  Enzymatic Nucleic Acid
uaggaaaccugaugaggccguuaggccgaaaggcacgg

SEQ ID NO: 8334 - RNA, 38 nt, Artificial Sequence
  Description of Artificial Sequence:  Enzymatic Nucleic Acid
ggcuaggacugaugaggccguuaggccgaaacaaggca

SEQ ID NO: 8335 - RNA, 38 nt, Artificial Sequence
  Description of Artificial Sequence:  Enzymatic Nucleic Acid
gggcuaggcugaugaggccguuaggccgaaaacaaggc

SEQ ID NO: 8336 - RNA, 38 nt, Artificial Sequence
  Description of Artificial Sequence:  Enzymatic Nucleic Acid
ugggcuagcugaugaggccguuaggccgaaaaacaagg

SEQ ID NO: 8337 - RNA, 38 nt, Artificial Sequence
  Description of Artificial Sequence:  Enzymatic Nucleic Acid
uugugggccugaugaggccguuaggccgaaaggaaaca

SEQ ID NO: 8338 - RNA, 38 nt, Artificial Sequence
  Description of Artificial Sequence:  Enzymatic Nucleic Acid
aucuguuucugaugaggccguuaggccgaaauguuugc

SEQ ID NO: 8339 - RNA, 38 nt, Artificial Sequence
  Description of Artificial Sequence:  Enzymatic Nucleic Acid
cuagcgagcugaugaggccguuaggccgaaaucuguuu

SEQ ID NO: 8340 - RNA, 38 nt, Artificial Sequence
  Description of Artificial Sequence:  Enzymatic Nucleic Acid
aggcuagccugaugaggccguuaggccgaaaguaucug

SEQ ID NO: 8341 - RNA, 38 nt, Artificial Sequence
  Description of Artificial Sequence:  Enzymatic Nucleic Acid
aaugaggccugaugaggccguuaggccgaaagcgagua

SEQ ID NO: 8342 - RNA, 38 nt, Artificial Sequence
  Description of Artificial Sequence:  Enzymatic Nucleic Acid
auuuaaaucugaugaggccguuaggccgaaaggcuagc

SEQ ID NO: 8343 - RNA, 38 nt, Artificial Sequence
  Description of Artificial Sequence:  Enzymatic Nucleic Acid
ucaauuuacugaugaggccguuaggccgaaaugaggcu

SEQ ID NO: 8344 - RNA, 38 nt, Artificial Sequence
  Description of Artificial Sequence:  Enzymatic Nucleic Acid
aucaauuucugaugaggccguuaggccgaaaaugaggc

SEQ ID NO: 8345 - RNA, 38 nt, Artificial Sequence
  Description of Artificial Sequence:  Enzymatic Nucleic Acid
aaucaauucugaugaggccguuaggccgaaaaaugagg

SEQ ID NO: 8346 - RNA, 38 nt, Artificial Sequence
  Description of Artificial Sequence:  Enzymatic Nucleic Acid
cuuuaauccugaugaggccguuaggccgaaauuuaaau

SEQ ID NO: 8347 - RNA, 38 nt, Artificial Sequence
  Description of Artificial Sequence:  Enzymatic Nucleic Acid
ccuccuuucugaugaggccguuaggccgaaaucaauuu

SEQ ID NO: 8348 - RNA, 38 nt, Artificial Sequence
  Description of Artificial Sequence:  Enzymatic Nucleic Acid
uccuccuucugaugaggccguuaggccgaaaaucaauu

SEQ ID NO: 8349 - RNA, 38 nt, Artificial Sequence
  Description of Artificial Sequence:  Enzymatic Nucleic Acid
cggccaaacugaugaggccguuaggccgaaaugcacuc

SEQ ID NO: 8350 - RNA, 38 nt, Artificial Sequence
  Description of Artificial Sequence:  Enzymatic Nucleic Acid
gucggccacugaugaggccguuaggccgaaagaugcac

SEQ ID NO: 8351 - RNA, 38 nt, Artificial Sequence
  Description of Artificial Sequence:  Enzymatic Nucleic Acid
ugucggcccugaugaggccguuaggccgaaaagaugca

SEQ ID NO: 8352 - RNA, 38 nt, Artificial Sequence
  Description of Artificial Sequence:  Enzymatic Nucleic Acid
cacacagucugaugaggccguuaggccgaaacaccacu

SEQ ID NO: 8353 - RNA, 38 nt, Artificial Sequence
  Description of Artificial Sequence:  Enzymatic Nucleic Acid
aacacacacugaugaggccguuaggccgaaacacccac

SEQ ID NO: 8354 - RNA, 38 nt, Artificial Sequence
  Description of Artificial Sequence:  Enzymatic Nucleic Acid
augcacaacugaugaggccguuaggccgaaacacacau

SEQ ID NO: 8355 - RNA, 38 nt, Artificial Sequence
  Description of Artificial Sequence:  Enzymatic Nucleic Acid
uaugcacacugaugaggccguuaggccgaaaacacaca

SEQ ID NO: 8356 - RNA, 38 nt, Artificial Sequence
  Description of Artificial Sequence:  Enzymatic Nucleic Acid
uuaugcaccugaugaggccguuaggccgaaaaacacac

SEQ ID NO: 8357 - RNA, 38 nt, Artificial Sequence
  Description of Artificial Sequence:  Enzymatic Nucleic Acid
uaaauagucugaugaggccguuaggccgaaaugcacaa

SEQ ID NO: 8358 - RNA, 38 nt, Artificial Sequence
  Description of Artificial Sequence:  Enzymatic Nucleic Acid
uccuuaaacugaugaggccguuaggccgaaaguuaugc

SEQ ID NO: 8359 - RNA, 38 nt, Artificial Sequence
  Description of Artificial Sequence:  Enzymatic Nucleic Acid
uuuccuuacugaugaggccguuaggccgaaauaguuau

SEQ ID NO: 8360 - RNA, 38 nt, Artificial Sequence
  Description of Artificial Sequence:  Enzymatic Nucleic Acid
guuuccuucugaugaggccguuaggccgaaaauaguua

SEQ ID NO: 8361 - RNA, 38 nt, Artificial Sequence
  Description of Artificial Sequence:  Enzymatic Nucleic Acid
aguuuccucugaugaggccguuaggccgaaaaauaguu

SEQ ID NO: 8362 - RNA, 38 nt, Artificial Sequence
  Description of Artificial Sequence:  Enzymatic Nucleic Acid
aacuuuaacugaugaggccguuaggccgaaauuccagu

SEQ ID NO: 8363 - RNA, 38 nt, Artificial Sequence
  Description of Artificial Sequence:  Enzymatic Nucleic Acid
uaacuuuacugaugaggccguuaggccgaaaauuccag

SEQ ID NO: 8364 - RNA, 38 nt, Artificial Sequence
  Description of Artificial Sequence:  Enzymatic Nucleic Acid
guaacuuucugaugaggccguuaggccgaaaaauucca

SEQ ID NO: 8365 - RNA, 38 nt, Artificial Sequence
  Description of Artificial Sequence:  Enzymatic Nucleic Acid
aguaacuucugaugaggccguuaggccgaaaaaauucc

SEQ ID NO: 8366 - RNA, 38 nt, Artificial Sequence
  Description of Artificial Sequence:  Enzymatic Nucleic Acid
auaaaagucugaugaggccguuaggccgaaacuuuaaa

SEQ ID NO: 8367 - RNA, 38 nt, Artificial Sequence
  Description of Artificial Sequence:  Enzymatic Nucleic Acid
uauaaaagcugaugaggccguuaggccgaaaacuuuaa

SEQ ID NO: 8368 - RNA, 38 nt, Artificial Sequence
  Description of Artificial Sequence:  Enzymatic Nucleic Acid
uuguauaacugaugaggccguuaggccgaaaguaacuu

SEQ ID NO: 8369 - RNA, 38 nt, Artificial Sequence
  Description of Artificial Sequence:  Enzymatic Nucleic Acid
uuuguauacugaugaggccguuaggccgaaaaguaacu

SEQ ID NO: 8370 - RNA, 38 nt, Artificial Sequence
  Description of Artificial Sequence:  Enzymatic Nucleic Acid
guuuguaucugaugaggccguuaggccgaaaaaguaac

SEQ ID NO: 8371 - RNA, 38 nt, Artificial Sequence
  Description of Artificial Sequence:  Enzymatic Nucleic Acid
gguuuguacugaugaggccguuaggccgaaaaaaguaa

SEQ ID NO: 8372 - RNA, 38 nt, Artificial Sequence
  Description of Artificial Sequence:  Enzymatic Nucleic Acid
uugguuugcugaugaggccguuaggccgaaauaaaagu

SEQ ID NO: 8373 - RNA, 38 nt, Artificial Sequence
  Description of Artificial Sequence:  Enzymatic Nucleic Acid
guagcauacugaugaggccguuaggccgaaauucuugg

SEQ ID NO: 8374 - RNA, 38 nt, Artificial Sequence
  Description of Artificial Sequence:  Enzymatic Nucleic Acid
cuguagcacugaugaggccguuaggccgaaauauucuu

SEQ ID NO: 8375 - RNA, 38 nt, Artificial Sequence
  Description of Artificial Sequence:  Enzymatic Nucleic Acid
uauaucugcugaugaggccguuaggccgaaagcauaua

SEQ ID NO: 8376 - RNA, 38 nt, Artificial Sequence
  Description of Artificial Sequence:  Enzymatic Nucleic Acid
cugucuuacugaugaggccguuaggccgaaaucuguag

SEQ ID NO: 8377 - RNA, 38 nt, Artificial Sequence
  Description of Artificial Sequence:  Enzymatic Nucleic Acid
gucugucucugaugaggccguuaggccgaaauaucugu

SEQ ID NO: 8378 - RNA, 38 nt, Artificial Sequence
  Description of Artificial Sequence:  Enzymatic Nucleic Acid
uaggaccacugaugaggccguuaggccgaaaccauguc

SEQ ID NO: 8379 - RNA, 38 nt, Artificial Sequence
  Description of Artificial Sequence:  Enzymatic Nucleic Acid
auaggacccugaugaggccguuaggccgaaaaccaugu

SEQ ID NO: 8380 - RNA, 38 nt, Artificial Sequence
  Description of Artificial Sequence:  Enzymatic Nucleic Acid
aaauauagcugaugaggccguuaggccgaaaccaaacc

SEQ ID NO: 8381 - RNA, 38 nt, Artificial Sequence
  Description of Artificial Sequence:  Enzymatic Nucleic Acid
uagaaauacugaugaggccguuaggccgaaaggaccaa

SEQ ID NO: 8382 - RNA, 38 nt, Artificial Sequence
  Description of Artificial Sequence:  Enzymatic Nucleic Acid
acuagaaacugaugaggccguuaggccgaaauaggacc

SEQ ID NO: 8383 - RNA, 38 nt, Artificial Sequence
  Description of Artificial Sequence:  Enzymatic Nucleic Acid
ugacuagacugaugaggccguuaggccgaaauauagga

SEQ ID NO: 8384 - RNA, 38 nt, Artificial Sequence
  Description of Artificial Sequence:  Enzymatic Nucleic Acid
augacuagcugaugaggccguuaggccgaaaauauagg

SEQ ID NO: 8385 - RNA, 38 nt, Artificial Sequence
  Description of Artificial Sequence:  Enzymatic Nucleic Acid
caugacuacugaugaggccguuaggccgaaaaauauag

SEQ ID NO: 8386 - RNA, 38 nt, Artificial Sequence
  Description of Artificial Sequence:  Enzymatic Nucleic Acid
aucaugaccugaugaggccguuaggccgaaagaaauau

SEQ ID NO: 8387 - RNA, 38 nt, Artificial Sequence
  Description of Artificial Sequence:  Enzymatic Nucleic Acid
uucaucaucugaugaggccguuaggccgaaacuagaaa

SEQ ID NO: 8388 - RNA, 38 nt, Artificial Sequence
  Description of Artificial Sequence:  Enzymatic Nucleic Acid
auacaaaacugaugaggccguuaggccgaaacauucau

SEQ ID NO: 8389 - RNA, 38 nt, Artificial Sequence
  Description of Artificial Sequence:  Enzymatic Nucleic Acid
guauacaacugaugaggccguuaggccgaaauacauuc

SEQ ID NO: 8390 - RNA, 38 nt, Artificial Sequence
  Description of Artificial Sequence:  Enzymatic Nucleic Acid
gguauacacugaugaggccguuaggccgaaaauacauu

SEQ ID NO: 8391 - RNA, 38 nt, Artificial Sequence
  Description of Artificial Sequence:  Enzymatic Nucleic Acid
ugguauaccugaugaggccguuaggccgaaaaauacau

SEQ ID NO: 8392 - RNA, 38 nt, Artificial Sequence
  Description of Artificial Sequence:  Enzymatic Nucleic Acid
agaugguacugaugaggccguuaggccgaaacaaaaua

SEQ ID NO: 8393 - RNA, 38 nt, Artificial Sequence
  Description of Artificial Sequence:  Enzymatic Nucleic Acid
gaagauggcugaugaggccguuaggccgaaauacaaaa

SEQ ID NO: 8394 - RNA, 38 nt, Artificial Sequence
  Description of Artificial Sequence:  Enzymatic Nucleic Acid
uauaugaacugaugaggccguuaggccgaaaugguaua

SEQ ID NO: 8395 - RNA, 38 nt, Artificial Sequence
  Description of Artificial Sequence:  Enzymatic Nucleic Acid
auuauaugcugaugaggccguuaggccgaaagauggua

SEQ ID NO: 8396 - RNA, 38 nt, Artificial Sequence
  Description of Artificial Sequence:  Enzymatic Nucleic Acid
uauuauaucugaugaggccguuaggccgaaaagauggu

SEQ ID NO: 8397 - RNA, 38 nt, Artificial Sequence
  Description of Artificial Sequence:  Enzymatic Nucleic Acid
guauauuacugaugaggccguuaggccgaaaugaagau

SEQ ID NO: 8398 - RNA, 38 nt, Artificial Sequence
  Description of Artificial Sequence:  Enzymatic Nucleic Acid
aaguauaucugaugaggccguuaggccgaaauaugaag

SEQ ID NO: 8399 - RNA, 38 nt, Artificial Sequence
  Description of Artificial Sequence:  Enzymatic Nucleic Acid
uuuaaguacugaugaggccguuaggccgaaauuauaug

SEQ ID NO: 8400 - RNA, 38 nt, Artificial Sequence
  Description of Artificial Sequence:  Enzymatic Nucleic Acid
uuuuuaagcugaugaggccguuaggccgaaauauuaua

SEQ ID NO: 8401 - RNA, 38 nt, Artificial Sequence
  Description of Artificial Sequence:  Enzymatic Nucleic Acid
auauuuuucugaugaggccguuaggccgaaaguauauu

SEQ ID NO: 8402 - RNA, 38 nt, Artificial Sequence
  Description of Artificial Sequence:  Enzymatic Nucleic Acid
aauauuuucugaugaggccguuaggccgaaaaguauau

SEQ ID NO: 8403 - RNA, 38 nt, Artificial Sequence
  Description of Artificial Sequence:  Enzymatic Nucleic Acid
uuaagaaacugaugaggccguuaggccgaaauuuuuaa

SEQ ID NO: 8404 - RNA, 38 nt, Artificial Sequence
  Description of Artificial Sequence:  Enzymatic Nucleic Acid
aauuaagacugaugaggccguuaggccgaaauauuuuu

SEQ ID NO: 8405 - RNA, 38 nt, Artificial Sequence
  Description of Artificial Sequence:  Enzymatic Nucleic Acid
caauuaagcugaugaggccguuaggccgaaaauauuuu

SEQ ID NO: 8406 - RNA, 38 nt, Artificial Sequence
  Description of Artificial Sequence:  Enzymatic Nucleic Acid
ccaauuaacugaugaggccguuaggccgaaaaauauuu

SEQ ID NO: 8407 - RNA, 38 nt, Artificial Sequence
  Description of Artificial Sequence:  Enzymatic Nucleic Acid
ucccaauucugaugaggccguuaggccgaaagaaauau

SEQ ID NO: 8408 - RNA, 38 nt, Artificial Sequence
  Description of Artificial Sequence:  Enzymatic Nucleic Acid
aucccaaucugaugaggccguuaggccgaaaagaaaua

SEQ ID NO: 8409 - RNA, 38 nt, Artificial Sequence
  Description of Artificial Sequence:  Enzymatic Nucleic Acid
caaauccccugaugaggccguuaggccgaaauuaagaa

SEQ ID NO: 8410 - RNA, 38 nt, Artificial Sequence
  Description of Artificial Sequence:  Enzymatic Nucleic Acid
cgauuacacugaugaggccguuaggccgaaaucccaau

SEQ ID NO: 8411 - RNA, 38 nt, Artificial Sequence
  Description of Artificial Sequence:  Enzymatic Nucleic Acid
acgauuaccugaugaggccguuaggccgaaaaucccaa

SEQ ID NO: 8412 - RNA, 38 nt, Artificial Sequence
  Description of Artificial Sequence:  Enzymatic Nucleic Acid
gguacgaucugaugaggccguuaggccgaaacaaaucc

SEQ ID NO: 8413 - RNA, 38 nt, Artificial Sequence
  Description of Artificial Sequence:  Enzymatic Nucleic Acid
guugguaccugaugaggccguuaggccgaaauuacaaa

SEQ ID NO: 8414 - RNA, 38 nt, Artificial Sequence
  Description of Artificial Sequence:  Enzymatic Nucleic Acid
uaaguuggcugaugaggccguuaggccgaaacgauuac

SEQ ID NO: 8415 - RNA, 38 nt, Artificial Sequence
  Description of Artificial Sequence:  Enzymatic Nucleic Acid
uaucaauucugaugaggccguuaggccgaaaguuggua

SEQ ID NO: 8416 - RNA, 38 nt, Artificial Sequence
  Description of Artificial Sequence:  Enzymatic Nucleic Acid
uuaucaaucugaugaggccguuaggccgaaaaguuggu

SEQ ID NO: 8417 - RNA, 38 nt, Artificial Sequence
  Description of Artificial Sequence:  Enzymatic Nucleic Acid
aguuuauccugaugaggccguuaggccgaaauuaaguu

SEQ ID NO: 8418 - RNA, 38 nt, Artificial Sequence
  Description of Artificial Sequence:  Enzymatic Nucleic Acid
gccaaguucugaugaggccguuaggccgaaaucaauua

SEQ ID NO: 8419 - RNA, 38 nt, Artificial Sequence
  Description of Artificial Sequence:  Enzymatic Nucleic Acid
caguugcccugaugaggccguuaggccgaaaguuuauc

SEQ ID NO: 8420 - RNA, 38 nt, Artificial Sequence
  Description of Artificial Sequence:  Enzymatic Nucleic Acid
gaacauaacugaugaggccguuaggccgaaagcaguug

SEQ ID NO: 8421 - RNA, 38 nt, Artificial Sequence
  Description of Artificial Sequence:  Enzymatic Nucleic Acid
agaacauacugaugaggccguuaggccgaaaagcaguu

SEQ ID NO: 8422 - RNA, 38 nt, Artificial Sequence
  Description of Artificial Sequence:  Enzymatic Nucleic Acid
cagaacaucugaugaggccguuaggccgaaaaagcagu

SEQ ID NO: 8423 - RNA, 38 nt, Artificial Sequence
  Description of Artificial Sequence:  Enzymatic Nucleic Acid
acagaacacugaugaggccguuaggccgaaaaaagcag

SEQ ID NO: 8424 - RNA, 38 nt, Artificial Sequence
  Description of Artificial Sequence:  Enzymatic Nucleic Acid
ggagacagcugaugaggccguuaggccgaaacauaaaa

SEQ ID NO: 8425 - RNA, 38 nt, Artificial Sequence
  Description of Artificial Sequence:  Enzymatic Nucleic Acid
aggagacacugaugaggccguuaggccgaaaacauaaa

SEQ ID NO: 8426 - RNA, 38 nt, Artificial Sequence
  Description of Artificial Sequence:  Enzymatic Nucleic Acid
uggaaggacugaugaggccguuaggccgaaacagaaca

SEQ ID NO: 8427 - RNA, 38 nt, Artificial Sequence
  Description of Artificial Sequence:  Enzymatic Nucleic Acid
uauggaagcugaugaggccguuaggccgaaagacagaa

SEQ ID NO: 8428 - RNA, 38 nt, Artificial Sequence
  Description of Artificial Sequence:  Enzymatic Nucleic Acid
auuuauggcugaugaggccguuaggccgaaaggagaca

SEQ ID NO: 8429 - RNA, 38 nt, Artificial Sequence
  Description of Artificial Sequence:  Enzymatic Nucleic Acid
aauuuaugcugaugaggccguuaggccgaaaaggagac

SEQ ID NO: 8430 - RNA, 38 nt, Artificial Sequence
  Description of Artificial Sequence:  Enzymatic Nucleic Acid
gaaaaauucugaugaggccguuaggccgaaauggaagg

SEQ ID NO: 8431 - RNA, 38 nt, Artificial Sequence
  Description of Artificial Sequence:  Enzymatic Nucleic Acid
uuuugaaacugaugaggccguuaggccgaaauuuaugg

SEQ ID NO: 8432 - RNA, 38 nt, Artificial Sequence
  Description of Artificial Sequence:  Enzymatic Nucleic Acid
auuuugaacugaugaggccguuaggccgaaaauuuaug

SEQ ID NO: 8433 - RNA, 38 nt, Artificial Sequence
  Description of Artificial Sequence:  Enzymatic Nucleic Acid
uauuuugacugaugaggccguuaggccgaaaaauuuau

SEQ ID NO: 8434 - RNA, 38 nt, Artificial Sequence
  Description of Artificial Sequence:  Enzymatic Nucleic Acid
guauuuugcugaugaggccguuaggccgaaaaaauuua

SEQ ID NO: 8435 - RNA, 38 nt, Artificial Sequence
  Description of Artificial Sequence:  Enzymatic Nucleic Acid
aguauuuucugaugaggccguuaggccgaaaaaaauuu

SEQ ID NO: 8436 - RNA, 38 nt, Artificial Sequence
  Description of Artificial Sequence:  Enzymatic Nucleic Acid
ugaauuagcugaugaggccguuaggccgaaauuuugaa

SEQ ID NO: 8437 - RNA, 38 nt, Artificial Sequence
  Description of Artificial Sequence:  Enzymatic Nucleic Acid
uguugaaucugaugaggccguuaggccgaaaguauuuu

SEQ ID NO: 8438 - RNA, 38 nt, Artificial Sequence
  Description of Artificial Sequence:  Enzymatic Nucleic Acid
cuuuguugcugaugaggccguuaggccgaaauuaguau

SEQ ID NO: 8439 - RNA, 38 nt, Artificial Sequence
  Description of Artificial Sequence:  Enzymatic Nucleic Acid
ucuuuguucugaugaggccguuaggccgaaaauuagua

SEQ ID NO: 8440 - RNA, 38 nt, Artificial Sequence
  Description of Artificial Sequence:  Enzymatic Nucleic Acid
aaaaaaaacugaugaggccguuaggccgaaagcuuuuu

SEQ ID NO: 8441 - RNA, 38 nt, Artificial Sequence
  Description of Artificial Sequence:  Enzymatic Nucleic Acid
ggaaaaaacugaugaggccguuaggccgaaagagcuuu

SEQ ID NO: 8442 - RNA, 38 nt, Artificial Sequence
  Description of Artificial Sequence:  Enzymatic Nucleic Acid
aggaaaaacugaugaggccguuaggccgaaaagagcuu

SEQ ID NO: 8443 - RNA, 38 nt, Artificial Sequence
  Description of Artificial Sequence:  Enzymatic Nucleic Acid
uaggaaaacugaugaggccguuaggccgaaaaagagcu

SEQ ID NO: 8444 - RNA, 38 nt, Artificial Sequence
  Description of Artificial Sequence:  Enzymatic Nucleic Acid
uuaggaaacugaugaggccguuaggccgaaaaaagagc

SEQ ID NO: 8445 - RNA, 38 nt, Artificial Sequence
  Description of Artificial Sequence:  Enzymatic Nucleic Acid
uuuaggaacugaugaggccguuaggccgaaaaaaagag

SEQ ID NO: 8446 - RNA, 38 nt, Artificial Sequence
  Description of Artificial Sequence:  Enzymatic Nucleic Acid
uuuuaggacugaugaggccguuaggccgaaaaaaaaga

SEQ ID NO: 8447 - RNA, 38 nt, Artificial Sequence
  Description of Artificial Sequence:  Enzymatic Nucleic Acid
auuuuaggcugaugaggccguuaggccgaaaaaaaaag

SEQ ID NO: 8448 - RNA, 38 nt, Artificial Sequence
  Description of Artificial Sequence:  Enzymatic Nucleic Acid
uauuuuagcugaugaggccguuaggccgaaaaaaaaaa

SEQ ID NO: 8449 - RNA, 38 nt, Artificial Sequence
  Description of Artificial Sequence:  Enzymatic Nucleic Acid
guuuauuucugaugaggccguuaggccgaaaggaaaaa

SEQ ID NO: 8450 - RNA, 38 nt, Artificial Sequence
  Description of Artificial Sequence:  Enzymatic Nucleic Acid
uuugaguucugaugaggccguuaggccgaaauuuuagg

SEQ ID NO: 8451 - RNA, 38 nt, Artificial Sequence
  Description of Artificial Sequence:  Enzymatic Nucleic Acid
auaaauuucugaugaggccguuaggccgaaaguuuauu

SEQ ID NO: 8452 - RNA, 38 nt, Artificial Sequence
  Description of Artificial Sequence:  Enzymatic Nucleic Acid
caaggauacugaugaggccguuaggccgaaauuugagu

SEQ ID NO: 8453 - RNA, 38 nt, Artificial Sequence
  Description of Artificial Sequence:  Enzymatic Nucleic Acid
acaaggaucugaugaggccguuaggccgaaaauuugag

SEQ ID NO: 8454 - RNA, 38 nt, Artificial Sequence
  Description of Artificial Sequence:  Enzymatic Nucleic Acid
aacaaggacugaugaggccguuaggccgaaaaauuuga

SEQ ID NO: 8455 - RNA, 38 nt, Artificial Sequence
  Description of Artificial Sequence:  Enzymatic Nucleic Acid
uaaacaagcugaugaggccguuaggccgaaauaaauuu

SEQ ID NO: 8456 - RNA, 38 nt, Artificial Sequence
  Description of Artificial Sequence:  Enzymatic Nucleic Acid
cucuaaaccugaugaggccguuaggccgaaaggauaaa

SEQ ID NO: 8457 - RNA, 38 nt, Artificial Sequence
  Description of Artificial Sequence:  Enzymatic Nucleic Acid
cugcucuacugaugaggccguuaggccgaaacaaggau

SEQ ID NO: 8458 - RNA, 38 nt, Artificial Sequence
  Description of Artificial Sequence:  Enzymatic Nucleic Acid
ucugcucucugaugaggccguuaggccgaaaacaagga

SEQ ID NO: 8459 - RNA, 38 nt, Artificial Sequence
  Description of Artificial Sequence:  Enzymatic Nucleic Acid
cucugcuccugaugaggccguuaggccgaaaaacaagg

SEQ ID NO: 8460 - RNA, 38 nt, Artificial Sequence
  Description of Artificial Sequence:  Enzymatic Nucleic Acid
uuuuucuucugaugaggccguuaggccgaaauuuuucu

SEQ ID NO: 8461 - RNA, 38 nt, Artificial Sequence
  Description of Artificial Sequence:  Enzymatic Nucleic Acid
guuuuucucugaugaggccguuaggccgaaaauuuuuc

SEQ ID NO: 8462 - RNA, 38 nt, Artificial Sequence
  Description of Artificial Sequence:  Enzymatic Nucleic Acid
ccauuucacugaugaggccguuaggccgaaaguuuuuc

SEQ ID NO: 8463 - RNA, 38 nt, Artificial Sequence
  Description of Artificial Sequence:  Enzymatic Nucleic Acid
accauuuccugaugaggccguuaggccgaaaaguuuuu

SEQ ID NO: 8464 - RNA, 38 nt, Artificial Sequence
  Description of Artificial Sequence:  Enzymatic Nucleic Acid
uuuuuugacugaugaggccguuaggccgaaaccauuuc

SEQ ID NO: 8465 - RNA, 38 nt, Artificial Sequence
  Description of Artificial Sequence:  Enzymatic Nucleic Acid
aauuuuuucugaugaggccguuaggccgaaagaccauu

SEQ ID NO: 8466 - RNA, 38 nt, Artificial Sequence
  Description of Artificial Sequence:  Enzymatic Nucleic Acid
uauuuagccugaugaggccguuaggccgaaauuuuuug

SEQ ID NO: 8467 - RNA, 38 nt, Artificial Sequence
  Description of Artificial Sequence:  Enzymatic Nucleic Acid
aaaauauucugaugaggccguuaggccgaaagcaauuu

SEQ ID NO: 8468 - RNA, 38 nt, Artificial Sequence
  Description of Artificial Sequence:  Enzymatic Nucleic Acid
auugaaaacugaugaggccguuaggccgaaauuuagca

SEQ ID NO: 8469 - RNA, 38 nt, Artificial Sequence
  Description of Artificial Sequence:  Enzymatic Nucleic Acid
ccauugaacugaugaggccguuaggccgaaauauuuag

SEQ ID NO: 8470 - RNA, 38 nt, Artificial Sequence
  Description of Artificial Sequence:  Enzymatic Nucleic Acid
uccauugacugaugaggccguuaggccgaaaauauuua

SEQ ID NO: 8471 - RNA, 38 nt, Artificial Sequence
  Description of Artificial Sequence:  Enzymatic Nucleic Acid
uuccauugcugaugaggccguuaggccgaaaaauauuu

SEQ ID NO: 8472 - RNA, 38 nt, Artificial Sequence
  Description of Artificial Sequence:  Enzymatic Nucleic Acid
uuuccauucugaugaggccguuaggccgaaaaaauauu

SEQ ID NO: 8473 - RNA, 38 nt, Artificial Sequence
  Description of Artificial Sequence:  Enzymatic Nucleic Acid
cuaacauucugaugaggccguuaggccgaaaguuuucc

SEQ ID NO: 8474 - RNA, 38 nt, Artificial Sequence
  Description of Artificial Sequence:  Enzymatic Nucleic Acid
gcuaaacucugaugaggccguuaggccgaaacauuuag

SEQ ID NO: 8475 - RNA, 38 nt, Artificial Sequence
  Description of Artificial Sequence:  Enzymatic Nucleic Acid
agcuaaaccugaugaggccguuaggccgaaaacauuua

SEQ ID NO: 8476 - RNA, 38 nt, Artificial Sequence
  Description of Artificial Sequence:  Enzymatic Nucleic Acid
aucagcuacugaugaggccguuaggccgaaacuaacau

SEQ ID NO: 8477 - RNA, 38 nt, Artificial Sequence
  Description of Artificial Sequence:  Enzymatic Nucleic Acid
aaucagcucugaugaggccguuaggccgaaaacuaaca

SEQ ID NO: 8478 - RNA, 38 nt, Artificial Sequence
  Description of Artificial Sequence:  Enzymatic Nucleic Acid
caaucagccugaugaggccguuaggccgaaaaacuaac

SEQ ID NO: 8479 - RNA, 38 nt, Artificial Sequence
  Description of Artificial Sequence:  Enzymatic Nucleic Acid
ccccauaccugaugaggccguuaggccgaaaucagcua

SEQ ID NO: 8480 - RNA, 38 nt, Artificial Sequence
  Description of Artificial Sequence:  Enzymatic Nucleic Acid
aaaccccacugaugaggccguuaggccgaaacaaucag

SEQ ID NO: 8481 - RNA, 38 nt, Artificial Sequence
  Description of Artificial Sequence:  Enzymatic Nucleic Acid
gguucgaacugaugaggccguuaggccgaaaccccaua

SEQ ID NO: 8482 - RNA, 38 nt, Artificial Sequence
  Description of Artificial Sequence:  Enzymatic Nucleic Acid
agguucgacugaugaggccguuaggccgaaaaccccau

SEQ ID NO: 8483 - RNA, 38 nt, Artificial Sequence
  Description of Artificial Sequence:  Enzymatic Nucleic Acid
aagguucgcugaugaggccguuaggccgaaaaacccca

SEQ ID NO: 8484 - RNA, 38 nt, Artificial Sequence
  Description of Artificial Sequence:  Enzymatic Nucleic Acid
aaagguuccugaugaggccguuaggccgaaaaaacccc

SEQ ID NO: 8485 - RNA, 38 nt, Artificial Sequence
  Description of Artificial Sequence:  Enzymatic Nucleic Acid
aaaagugacugaugaggccguuaggccgaaagguucga

SEQ ID NO: 8486 - RNA, 38 nt, Artificial Sequence
  Description of Artificial Sequence:  Enzymatic Nucleic Acid
aaaaagugcugaugaggccguuaggccgaaaagguucg

SEQ ID NO: 8487 - RNA, 38 nt, Artificial Sequence
  Description of Artificial Sequence:  Enzymatic Nucleic Acid
caaaaagucugaugaggccguuaggccgaaaaagguuc

SEQ ID NO: 8488 - RNA, 38 nt, Artificial Sequence
  Description of Artificial Sequence:  Enzymatic Nucleic Acid
caaacaaacugaugaggccguuaggccgaaagugaaag

SEQ ID NO: 8489 - RNA, 38 nt, Artificial Sequence
  Description of Artificial Sequence:  Enzymatic Nucleic Acid
acaaacaacugaugaggccguuaggccgaaaagugaaa

SEQ ID NO: 8490 - RNA, 38 nt, Artificial Sequence
  Description of Artificial Sequence:  Enzymatic Nucleic Acid
aacaaacacugaugaggccguuaggccgaaaaagugaa

SEQ ID NO: 8491 - RNA, 38 nt, Artificial Sequence
  Description of Artificial Sequence:  Enzymatic Nucleic Acid
aaacaaaccugaugaggccguuaggccgaaaaaaguga

SEQ ID NO: 8492 - RNA, 38 nt, Artificial Sequence
  Description of Artificial Sequence:  Enzymatic Nucleic Acid
guaaaacacugaugaggccguuaggccgaaacaaaaag

SEQ ID NO: 8493 - RNA, 38 nt, Artificial Sequence
  Description of Artificial Sequence:  Enzymatic Nucleic Acid
gguaaaaccugaugaggccguuaggccgaaaacaaaaa

SEQ ID NO: 8494 - RNA, 38 nt, Artificial Sequence
  Description of Artificial Sequence:  Enzymatic Nucleic Acid
auagguaacugaugaggccguuaggccgaaacaaacaa

SEQ ID NO: 8495 - RNA, 38 nt, Artificial Sequence
  Description of Artificial Sequence:  Enzymatic Nucleic Acid
aauagguacugaugaggccguuaggccgaaaacaaaca

SEQ ID NO: 8496 - RNA, 38 nt, Artificial Sequence
  Description of Artificial Sequence:  Enzymatic Nucleic Acid
aaauaggucugaugaggccguuaggccgaaaaacaaac

SEQ ID NO: 8497 - RNA, 38 nt, Artificial Sequence
  Description of Artificial Sequence:  Enzymatic Nucleic Acid
gaaauaggcugaugaggccguuaggccgaaaaaacaaa

SEQ ID NO: 8498 - RNA, 38 nt, Artificial Sequence
  Description of Artificial Sequence:  Enzymatic Nucleic Acid
uugugaaacugaugaggccguuaggccgaaagguaaaa

SEQ ID NO: 8499 - RNA, 38 nt, Artificial Sequence
  Description of Artificial Sequence:  Enzymatic Nucleic Acid
aguugugacugaugaggccguuaggccgaaauagguaa

SEQ ID NO: 8500 - RNA, 38 nt, Artificial Sequence
  Description of Artificial Sequence:  Enzymatic Nucleic Acid
caguugugcugaugaggccguuaggccgaaaauaggua

SEQ ID NO: 8501 - RNA, 38 nt, Artificial Sequence
  Description of Artificial Sequence:  Enzymatic Nucleic Acid
acaguugucugaugaggccguuaggccgaaaaauaggu

SEQ ID NO: 8502 - RNA, 38 nt, Artificial Sequence
  Description of Artificial Sequence:  Enzymatic Nucleic Acid
uggcaauucugaugaggccguuaggccgaaacacaguu

SEQ ID NO: 8503 - RNA, 38 nt, Artificial Sequence
  Description of Artificial Sequence:  Enzymatic Nucleic Acid
uuauuggccugaugaggccguuaggccgaaauuuacac

SEQ ID NO: 8504 - RNA, 38 nt, Artificial Sequence
  Description of Artificial Sequence:  Enzymatic Nucleic Acid
acaggaaucugaugaggccguuaggccgaaauuggcaa

SEQ ID NO: 8505 - RNA, 38 nt, Artificial Sequence
  Description of Artificial Sequence:  Enzymatic Nucleic Acid
uggacaggcugaugaggccguuaggccgaaauuauugg

SEQ ID NO: 8506 - RNA, 38 nt, Artificial Sequence
  Description of Artificial Sequence:  Enzymatic Nucleic Acid
auggacagcugaugaggccguuaggccgaaaauuauug

SEQ ID NO: 8507 - RNA, 38 nt, Artificial Sequence
  Description of Artificial Sequence:  Enzymatic Nucleic Acid
uuuucaugcugaugaggccguuaggccgaaacaggaau

SEQ ID NO: 8508 - RNA, 38 nt, Artificial Sequence
  Description of Artificial Sequence:  Enzymatic Nucleic Acid
cacuggaucugaugaggccguuaggccgaaauuugcau

SEQ ID NO: 8509 - RNA, 38 nt, Artificial Sequence
  Description of Artificial Sequence:  Enzymatic Nucleic Acid
acacuggacugaugaggccguuaggccgaaaauuugca

SEQ ID NO: 8510 - RNA, 38 nt, Artificial Sequence
  Description of Artificial Sequence:  Enzymatic Nucleic Acid
cuacacugcugaugaggccguuaggccgaaauaauuug

SEQ ID NO: 8511 - RNA, 38 nt, Artificial Sequence
  Description of Artificial Sequence:  Enzymatic Nucleic Acid
aauauauccugaugaggccguuaggccgaaacacugga

SEQ ID NO: 8512 - RNA, 38 nt, Artificial Sequence
  Description of Artificial Sequence:  Enzymatic Nucleic Acid
gucaaauacugaugaggccguuaggccgaaaucuacac

SEQ ID NO: 8513 - RNA, 38 nt, Artificial Sequence
  Description of Artificial Sequence:  Enzymatic Nucleic Acid
uggucaaacugaugaggccguuaggccgaaauaucuac

SEQ ID NO: 8514 - RNA, 38 nt, Artificial Sequence
  Description of Artificial Sequence:  Enzymatic Nucleic Acid
gauggucacugaugaggccguuaggccgaaauauaucu

SEQ ID NO: 8515 - RNA, 38 nt, Artificial Sequence
  Description of Artificial Sequence:  Enzymatic Nucleic Acid
ugaugguccugaugaggccguuaggccgaaaauauauc

SEQ ID NO: 8516 - RNA, 38 nt, Artificial Sequence
  Description of Artificial Sequence:  Enzymatic Nucleic Acid
cauagggucugaugaggccguuaggccgaaauggucaa

SEQ ID NO: 8517 - RNA, 38 nt, Artificial Sequence
  Description of Artificial Sequence:  Enzymatic Nucleic Acid
aauauccacugaugaggccguuaggccgaaagggugau

SEQ ID NO: 8518 - RNA, 38 nt, Artificial Sequence
  Description of Artificial Sequence:  Enzymatic Nucleic Acid
cuagccaacugaugaggccguuaggccgaaauccauag

SEQ ID NO: 8519 - RNA, 38 nt, Artificial Sequence
  Description of Artificial Sequence:  Enzymatic Nucleic Acid
aacuagcccugaugaggccguuaggccgaaauauccau

SEQ ID NO: 8520 - RNA, 38 nt, Artificial Sequence
  Description of Artificial Sequence:  Enzymatic Nucleic Acid
ggcaaaaccugaugaggccguuaggccgaaagccaaua

SEQ ID NO: 8521 - RNA, 38 nt, Artificial Sequence
  Description of Artificial Sequence:  Enzymatic Nucleic Acid
aaaggcaacugaugaggccguuaggccgaaacuagcca

SEQ ID NO: 8522 - RNA, 38 nt, Artificial Sequence
  Description of Artificial Sequence:  Enzymatic Nucleic Acid
uaaaggcacugaugaggccguuaggccgaaaacuagcc

SEQ ID NO: 8523 - RNA, 38 nt, Artificial Sequence
  Description of Artificial Sequence:  Enzymatic Nucleic Acid
auaaaggccugaugaggccguuaggccgaaaaacuagc

SEQ ID NO: 8524 - RNA, 38 nt, Artificial Sequence
  Description of Artificial Sequence:  Enzymatic Nucleic Acid
gcuuaauacugaugaggccguuaggccgaaaggcaaaa

SEQ ID NO: 8525 - RNA, 38 nt, Artificial Sequence
  Description of Artificial Sequence:  Enzymatic Nucleic Acid
ugcuuaaucugaugaggccguuaggccgaaaaggcaaa

SEQ ID NO: 8526 - RNA, 38 nt, Artificial Sequence
  Description of Artificial Sequence:  Enzymatic Nucleic Acid
uugcuuaacugaugaggccguuaggccgaaaaaggcaa

SEQ ID NO: 8527 - RNA, 38 nt, Artificial Sequence
  Description of Artificial Sequence:  Enzymatic Nucleic Acid
auuugcuucugaugaggccguuaggccgaaauaaaggc

SEQ ID NO: 8528 - RNA, 38 nt, Artificial Sequence
  Description of Artificial Sequence:  Enzymatic Nucleic Acid
aauuugcucugaugaggccguuaggccgaaaauaaagg

SEQ ID NO: 8529 - RNA, 38 nt, Artificial Sequence
  Description of Artificial Sequence:  Enzymatic Nucleic Acid
cugaaaugcugaugaggccguuaggccgaaauuugcuu

SEQ ID NO: 8530 - RNA, 38 nt, Artificial Sequence
  Description of Artificial Sequence:  Enzymatic Nucleic Acid
gcugaaaucugaugaggccguuaggccgaaaauuugcu

SEQ ID NO: 8531 - RNA, 38 nt, Artificial Sequence
  Description of Artificial Sequence:  Enzymatic Nucleic Acid
caggcugacugaugaggccguuaggccgaaaugaauuu

SEQ ID NO: 8532 - RNA, 38 nt, Artificial Sequence
  Description of Artificial Sequence:  Enzymatic Nucleic Acid
ucaggcugcugaugaggccguuaggccgaaaaugaauu

SEQ ID NO: 8533 - RNA, 38 nt, Artificial Sequence
  Description of Artificial Sequence:  Enzymatic Nucleic Acid
uucaggcucugaugaggccguuaggccgaaaaaugaau

SEQ ID NO: 8534 - RNA, 38 nt, Artificial Sequence
  Description of Artificial Sequence:  Enzymatic Nucleic Acid
uauaggcacugaugaggccguuaggccgaaacauucag

SEQ ID NO: 8535 - RNA, 38 nt, Artificial Sequence
  Description of Artificial Sequence:  Enzymatic Nucleic Acid
agaauauacugaugaggccguuaggccgaaaggcagac

SEQ ID NO: 8536 - RNA, 38 nt, Artificial Sequence
  Description of Artificial Sequence:  Enzymatic Nucleic Acid
agagaauacugaugaggccguuaggccgaaauaggcag

SEQ ID NO: 8537 - RNA, 38 nt, Artificial Sequence
  Description of Artificial Sequence:  Enzymatic Nucleic Acid
gcagagaacugaugaggccguuaggccgaaauauaggc

SEQ ID NO: 8538 - RNA, 38 nt, Artificial Sequence
  Description of Artificial Sequence:  Enzymatic Nucleic Acid
gagcagagcugaugaggccguuaggccgaaauauauag

SEQ ID NO: 8539 - RNA, 38 nt, Artificial Sequence
  Description of Artificial Sequence:  Enzymatic Nucleic Acid
agagcagacugaugaggccguuaggccgaaaauauaua

SEQ ID NO: 8540 - RNA, 38 nt, Artificial Sequence
  Description of Artificial Sequence:  Enzymatic Nucleic Acid
aaagagcacugaugaggccguuaggccgaaagaauaua

SEQ ID NO: 8541 - RNA, 38 nt, Artificial Sequence
  Description of Artificial Sequence:  Enzymatic Nucleic Acid
aauacaaacugaugaggccguuaggccgaaagcagaga

SEQ ID NO: 8542 - RNA, 38 nt, Artificial Sequence
  Description of Artificial Sequence:  Enzymatic Nucleic Acid
agaauacacugaugaggccguuaggccgaaagagcaga

SEQ ID NO: 8543 - RNA, 38 nt, Artificial Sequence
  Description of Artificial Sequence:  Enzymatic Nucleic Acid
gagaauaccugaugaggccguuaggccgaaaagagcag

SEQ ID NO: 8544 - RNA, 38 nt, Artificial Sequence
  Description of Artificial Sequence:  Enzymatic Nucleic Acid
aaggagaacugaugaggccguuaggccgaaacaaagag

SEQ ID NO: 8545 - RNA, 38 nt, Artificial Sequence
  Description of Artificial Sequence:  Enzymatic Nucleic Acid
caaaggagcugaugaggccguuaggccgaaauacaaag

SEQ ID NO: 8546 - RNA, 38 nt, Artificial Sequence
  Description of Artificial Sequence:  Enzymatic Nucleic Acid
ucaaaggacugaugaggccguuaggccgaaaauacaaa

SEQ ID NO: 8547 - RNA, 38 nt, Artificial Sequence
  Description of Artificial Sequence:  Enzymatic Nucleic Acid
guucaaagcugaugaggccguuaggccgaaagaauaca

SEQ ID NO: 8548 - RNA, 38 nt, Artificial Sequence
  Description of Artificial Sequence:  Enzymatic Nucleic Acid
cggguucacugaugaggccguuaggccgaaaggagaau

SEQ ID NO: 8549 - RNA, 38 nt, Artificial Sequence
  Description of Artificial Sequence:  Enzymatic Nucleic Acid
acggguuccugaugaggccguuaggccgaaaaggagaa

SEQ ID NO: 8550 - RNA, 38 nt, Artificial Sequence
  Description of Artificial Sequence:  Enzymatic Nucleic Acid
gauguuuucugaugaggccguuaggccgaaacggguuc

SEQ ID NO: 8551 - RNA, 38 nt, Artificial Sequence
  Description of Artificial Sequence:  Enzymatic Nucleic Acid
ggauguuucugaugaggccguuaggccgaaaacggguu

SEQ ID NO: 8552 - RNA, 38 nt, Artificial Sequence
  Description of Artificial Sequence:  Enzymatic Nucleic Acid
ugccacagcugaugaggccguuaggccgaaauguuuua

SEQ ID NO: 8553 - RNA, 54 nt, Artificial Sequence
  Description of Artificial Sequence:  Enzymatic Nucleic Acid
cggggaggagaagagaggaccagagaaacacacguugugguacauuaccuggua

SEQ ID NO: 8554 - RNA, 54 nt, Artificial Sequence
  Description of Artificial Sequence:  Enzymatic Nucleic Acid
ccgcuccgagaagccgccaccagagaaacacacguugugguacauuaccuggua

SEQ ID NO: 8555 - RNA, 54 nt, Artificial Sequence
  Description of Artificial Sequence:  Enzymatic Nucleic Acid
ccgccagaagaaguccucaccagagaaacacacguugugguacauuaccuggua

SEQ ID NO: 8556 - RNA, 54 nt, Artificial Sequence
  Description of Artificial Sequence:  Enzymatic Nucleic Acid
aacgacccagaagccagaaccagagaaacacacguugugguacauuaccuggua

SEQ ID NO: 8557 - RNA, 54 nt, Artificial Sequence
  Description of Artificial Sequence:  Enzymatic Nucleic Acid
gcgcgcacagaaggacccaccagagaaacacacguugugguacauuaccuggua

SEQ ID NO: 8558 - RNA, 54 nt, Artificial Sequence
  Description of Artificial Sequence:  Enzymatic Nucleic Acid
gacagcugagaagcgcgcaccagagaaacacacguugugguacauuaccuggua

SEQ ID NO: 8559 - RNA, 54 nt, Artificial Sequence
  Description of Artificial Sequence:  Enzymatic Nucleic Acid
aagcagacagaagagcagaccagagaaacacacguugugguacauuaccuggua

SEQ ID NO: 8560 - RNA, 54 nt, Artificial Sequence
  Description of Artificial Sequence:  Enzymatic Nucleic Acid
gagaagcaagaagcugagaccagagaaacacacguugugguacauuaccuggua

SEQ ID NO: 8561 - RNA, 54 nt, Artificial Sequence
  Description of Artificial Sequence:  Enzymatic Nucleic Acid
cugugagaagaagacagcaccagagaaacacacguugugguacauuaccuggua

SEQ ID NO: 8562 - RNA, 54 nt, Artificial Sequence
  Description of Artificial Sequence:  Enzymatic Nucleic Acid
cauuuaugagaagcuuccaccagagaaacacacguugugguacauuaccuggua

SEQ ID NO: 8563 - RNA, 54 nt, Artificial Sequence
  Description of Artificial Sequence:  Enzymatic Nucleic Acid
cuuccacaagaagauuuaaccagagaaacacacguugugguacauuaccuggua

SEQ ID NO: 8564 - RNA, 54 nt, Artificial Sequence
  Description of Artificial Sequence:  Enzymatic Nucleic Acid
uuugcuugagaaguguucaccagagaaacacacguugugguacauuaccuggua

SEQ ID NO: 8565 - RNA, 54 nt, Artificial Sequence
  Description of Artificial Sequence:  Enzymatic Nucleic Acid
auauuugcagaaguagaaaccagagaaacacacguugugguacauuaccuggua

SEQ ID NO: 8566 - RNA, 54 nt, Artificial Sequence
  Description of Artificial Sequence:  Enzymatic Nucleic Acid
cguaacccagaagggaauaccagagaaacacacguugugguacauuaccuggua

SEQ ID NO: 8567 - RNA, 54 nt, Artificial Sequence
  Description of Artificial Sequence:  Enzymatic Nucleic Acid
cguuuuccagaagggaucaccagagaaacacacguugugguacauuaccuggua

SEQ ID NO: 8568 - RNA, 54 nt, Artificial Sequence
  Description of Artificial Sequence:  Enzymatic Nucleic Acid
cuucacagagaagaagccaccagagaaacacacguugugguacauuaccuggua

SEQ ID NO: 8569 - RNA, 54 nt, Artificial Sequence
  Description of Artificial Sequence:  Enzymatic Nucleic Acid
uuuuuuucagaaggguaaaccagagaaacacacguugugguacauuaccuggua

SEQ ID NO: 8570 - RNA, 54 nt, Artificial Sequence
  Description of Artificial Sequence:  Enzymatic Nucleic Acid
gccgguaaagaagcuugcaccagagaaacacacguugugguacauuaccuggua

SEQ ID NO: 8571 - RNA, 54 nt, Artificial Sequence
  Description of Artificial Sequence:  Enzymatic Nucleic Acid
ucauagagagaagguaagaccagagaaacacacguugugguacauuaccuggua

SEQ ID NO: 8572 - RNA, 54 nt, Artificial Sequence
  Description of Artificial Sequence:  Enzymatic Nucleic Acid
aaauagcgagaagauuucaccagagaaacacacguugugguacauuaccuggua

SEQ ID NO: 8573 - RNA, 54 nt, Artificial Sequence
  Description of Artificial Sequence:  Enzymatic Nucleic Acid
uuucguaaagaagggguuaccagagaaacacacguugugguacauuaccuggua

SEQ ID NO: 8574 - RNA, 54 nt, Artificial Sequence
  Description of Artificial Sequence:  Enzymatic Nucleic Acid
agagccggagaaggaaacaccagagaaacacacguugugguacauuaccuggua

SEQ ID NO: 8575 - RNA, 54 nt, Artificial Sequence
  Description of Artificial Sequence:  Enzymatic Nucleic Acid
ggguagagagaagggucuaccagagaaacacacguugugguacauuaccuggua

SEQ ID NO: 8576 - RNA, 54 nt, Artificial Sequence
  Description of Artificial Sequence:  Enzymatic Nucleic Acid
cgguacaaagaaggauuuaccagagaaacacacguugugguacauuaccuggua

SEQ ID NO: 8577 - RNA, 54 nt, Artificial Sequence
  Description of Artificial Sequence:  Enzymatic Nucleic Acid
auucuagaagaagccacaaccagagaaacacacguugugguacauuaccuggua

SEQ ID NO: 8578 - RNA, 54 nt, Artificial Sequence
  Description of Artificial Sequence:  Enzymatic Nucleic Acid
uuuggcacagaagugauaaccagagaaacacacguugugguacauuaccuggua

SEQ ID NO: 8579 - RNA, 54 nt, Artificial Sequence
  Description of Artificial Sequence:  Enzymatic Nucleic Acid
cuccuuccagaagcauuuaccagagaaacacacguugugguacauuaccuggua

SEQ ID NO: 8580 - RNA, 54 nt, Artificial Sequence
  Description of Artificial Sequence:  Enzymatic Nucleic Acid
cugugcaaagaaguuucaaccagagaaacacacguugugguacauuaccuggua

SEQ ID NO: 8581 - RNA, 54 nt, Artificial Sequence
  Description of Artificial Sequence:  Enzymatic Nucleic Acid
agugguggagaagcugauaccagagaaacacacguugugguacauuaccuggua

SEQ ID NO: 8582 - RNA, 54 nt, Artificial Sequence
  Description of Artificial Sequence:  Enzymatic Nucleic Acid
accaagugagaagaggcuaccagagaaacacacguugugguacauuaccuggua

SEQ ID NO: 8583 - RNA, 54 nt, Artificial Sequence
  Description of Artificial Sequence:  Enzymatic Nucleic Acid
uuucaauaagaagcgugcaccagagaaacacacguugugguacauuaccuggua

SEQ ID NO: 8584 - RNA, 54 nt, Artificial Sequence
  Description of Artificial Sequence:  Enzymatic Nucleic Acid
guuccuugagaagugaggaccagagaaacacacguugugguacauuaccuggua

SEQ ID NO: 8585 - RNA, 54 nt, Artificial Sequence
  Description of Artificial Sequence:  Enzymatic Nucleic Acid
uuagagugagaagcuccaaccagagaaacacacguugugguacauuaccuggua

SEQ ID NO: 8586 - RNA, 54 nt, Artificial Sequence
  Description of Artificial Sequence:  Enzymatic Nucleic Acid
gauagguaagaagucuuuaccagagaaacacacguugugguacauuaccuggua

SEQ ID NO: 8587 - RNA, 54 nt, Artificial Sequence
  Description of Artificial Sequence:  Enzymatic Nucleic Acid
ggaacuucagaaggguccaccagagaaacacacguugugguacauuaccuggua

SEQ ID NO: 8588 - RNA, 54 nt, Artificial Sequence
  Description of Artificial Sequence:  Enzymatic Nucleic Acid
cauaagggagaagcucacaccagagaaacacacguugugguacauuaccuggua

SEQ ID NO: 8589 - RNA, 54 nt, Artificial Sequence
  Description of Artificial Sequence:  Enzymatic Nucleic Acid
cagccacaagaaggcacgaccagagaaacacacguugugguacauuaccuggua

SEQ ID NO: 8590 - RNA, 54 nt, Artificial Sequence
  Description of Artificial Sequence:  Enzymatic Nucleic Acid
gcucagucagaagagcuuaccagagaaacacacguugugguacauuaccuggua

SEQ ID NO: 8591 - RNA, 54 nt, Artificial Sequence
  Description of Artificial Sequence:  Enzymatic Nucleic Acid
aggcucccagaagguuaaaccagagaaacacacguugugguacauuaccuggua

SEQ ID NO: 8592 - RNA, 54 nt, Artificial Sequence
  Description of Artificial Sequence:  Enzymatic Nucleic Acid
caaucaccagaagaggccaccagagaaacacacguugugguacauuaccuggua

SEQ ID NO: 8593 - RNA, 54 nt, Artificial Sequence
  Description of Artificial Sequence:  Enzymatic Nucleic Acid
uuccugaaagaaggagcuaccagagaaacacacguugugguacauuaccuggua

SEQ ID NO: 8594 - RNA, 54 nt, Artificial Sequence
  Description of Artificial Sequence:  Enzymatic Nucleic Acid
uagaaaccagaagaauccaccagagaaacacacguugugguacauuaccuggua

SEQ ID NO: 8595 - RNA, 54 nt, Artificial Sequence
  Description of Artificial Sequence:  Enzymatic Nucleic Acid
cuuguagaagaagucagaaccagagaaacacacguugugguacauuaccuggua

SEQ ID NO: 8596 - RNA, 54 nt, Artificial Sequence
  Description of Artificial Sequence:  Enzymatic Nucleic Acid
uguaagaaagaagaucuuaccagagaaacacacguugugguacauuaccuggua

SEQ ID NO: 8597 - RNA, 54 nt, Artificial Sequence
  Description of Artificial Sequence:  Enzymatic Nucleic Acid
cacuugaaagaaguaagaaccagagaaacacacguugugguacauuaccuggua

SEQ ID NO: 8598 - RNA, 54 nt, Artificial Sequence
  Description of Artificial Sequence:  Enzymatic Nucleic Acid
uucuggaaagaaggaacuaccagagaaacacacguugugguacauuaccuggua

SEQ ID NO: 8599 - RNA, 54 nt, Artificial Sequence
  Description of Artificial Sequence:  Enzymatic Nucleic Acid
cucacauaagaaggguucaccagagaaacacacguugugguacauuaccuggua

SEQ ID NO: 8600 - RNA, 54 nt, Artificial Sequence
  Description of Artificial Sequence:  Enzymatic Nucleic Acid
ccucaggcagaagcaaaaaccagagaaacacacguugugguacauuaccuggua

SEQ ID NO: 8601 - RNA, 54 nt, Artificial Sequence
  Description of Artificial Sequence:  Enzymatic Nucleic Acid
ccagcaugagaagauagaaccagagaaacacacguugugguacauuaccuggua

SEQ ID NO: 8602 - RNA, 54 nt, Artificial Sequence
  Description of Artificial Sequence:  Enzymatic Nucleic Acid
ucugugccagaaguccagaccagagaaacacacguugugguacauuaccuggua

SEQ ID NO: 8603 - RNA, 54 nt, Artificial Sequence
  Description of Artificial Sequence:  Enzymatic Nucleic Acid
ucagagaaagaaggaguuaccagagaaacacacguugugguacauuaccuggua

SEQ ID NO: 8604 - RNA, 54 nt, Artificial Sequence
  Description of Artificial Sequence:  Enzymatic Nucleic Acid
aacuucggagaagaaauaaccagagaaacacacguugugguacauuaccuggua

SEQ ID NO: 8605 - RNA, 54 nt, Artificial Sequence
  Description of Artificial Sequence:  Enzymatic Nucleic Acid
cugacaucagaagagcuuaccagagaaacacacguugugguacauuaccuggua

SEQ ID NO: 8606 - RNA, 54 nt, Artificial Sequence
  Description of Artificial Sequence:  Enzymatic Nucleic Acid
gagaggccagaagagugcaccagagaaacacacguugugguacauuaccuggua

SEQ ID NO: 8607 - RNA, 54 nt, Artificial Sequence
  Description of Artificial Sequence:  Enzymatic Nucleic Acid
ugacaucaagaagccccgaccagagaaacacacguugugguacauuaccuggua

SEQ ID NO: 8608 - RNA, 54 nt, Artificial Sequence
  Description of Artificial Sequence:  Enzymatic Nucleic Acid
cugcugacagaagacagcaccagagaaacacacguugugguacauuaccuggua

SEQ ID NO: 8609 - RNA, 54 nt, Artificial Sequence
  Description of Artificial Sequence:  Enzymatic Nucleic Acid
auggcagaagaagggccuaccagagaaacacacguugugguacauuaccuggua

SEQ ID NO: 8610 - RNA, 54 nt, Artificial Sequence
  Description of Artificial Sequence:  Enzymatic Nucleic Acid
gugcccacagaaggaaugaccagagaaacacacguugugguacauuaccuggua

SEQ ID NO: 8611 - RNA, 54 nt, Artificial Sequence
  Description of Artificial Sequence:  Enzymatic Nucleic Acid
gggcggggagaagcacgcaccagagaaacacacguugugguacauuaccuggua

SEQ ID NO: 8612 - RNA, 54 nt, Artificial Sequence
  Description of Artificial Sequence:  Enzymatic Nucleic Acid
agucugggagaagggagcaccagagaaacacacguugugguacauuaccuggua

SEQ ID NO: 8613 - RNA, 54 nt, Artificial Sequence
  Description of Artificial Sequence:  Enzymatic Nucleic Acid
gaguuguaagaagggggcaccagagaaacacacguugugguacauuaccuggua

SEQ ID NO: 8614 - RNA, 54 nt, Artificial Sequence
  Description of Artificial Sequence:  Enzymatic Nucleic Acid
caaaaagcagaaggcuccaccagagaaacacacguugugguacauuaccuggua

SEQ ID NO: 8615 - RNA, 54 nt, Artificial Sequence
  Description of Artificial Sequence:  Enzymatic Nucleic Acid
ucacaaaaagaagcuggcaccagagaaacacacguugugguacauuaccuggua

SEQ ID NO: 8616 - RNA, 54 nt, Artificial Sequence
  Description of Artificial Sequence:  Enzymatic Nucleic Acid
gggguuggagaagggaagaccagagaaacacacguugugguacauuaccuggua

SEQ ID NO: 8617 - RNA, 54 nt, Artificial Sequence
  Description of Artificial Sequence:  Enzymatic Nucleic Acid
cucaaucaagaagguccuaccagagaaacacacguugugguacauuaccuggua

SEQ ID NO: 8618 - RNA, 54 nt, Artificial Sequence
  Description of Artificial Sequence:  Enzymatic Nucleic Acid
auugggugagaagugcagaccagagaaacacacguugugguacauuaccuggua

SEQ ID NO: 8619 - RNA, 54 nt, Artificial Sequence
  Description of Artificial Sequence:  Enzymatic Nucleic Acid
ggcugcagagaaggcccaaccagagaaacacacguugugguacauuaccuggua

SEQ ID NO: 8620 - RNA, 54 nt, Artificial Sequence
  Description of Artificial Sequence:  Enzymatic Nucleic Acid
ggguuuugagaagcagggaccagagaaacacacguugugguacauuaccuggua

SEQ ID NO: 8621 - RNA, 54 nt, Artificial Sequence
  Description of Artificial Sequence:  Enzymatic Nucleic Acid
agggucagagaagggaagaccagagaaacacacguugugguacauuaccuggua

SEQ ID NO: 8622 - RNA, 54 nt, Artificial Sequence
  Description of Artificial Sequence:  Enzymatic Nucleic Acid
guagaaggagaagagcugaccagagaaacacacguugugguacauuaccuggua

SEQ ID NO: 8623 - RNA, 54 nt, Artificial Sequence
  Description of Artificial Sequence:  Enzymatic Nucleic Acid
cgcuguccagaagcuccuaccagagaaacacacguugugguacauuaccuggua

SEQ ID NO: 8624 - RNA, 54 nt, Artificial Sequence
  Description of Artificial Sequence:  Enzymatic Nucleic Acid
cugugcaaagaagaauaaaccagagaaacacacguugugguacauuaccuggua

SEQ ID NO: 8625 - RNA, 54 nt, Artificial Sequence
  Description of Artificial Sequence:  Enzymatic Nucleic Acid
cuccucagagaagcauuuaccagagaaacacacguugugguacauuaccuggua

SEQ ID NO: 8626 - RNA, 54 nt, Artificial Sequence
  Description of Artificial Sequence:  Enzymatic Nucleic Acid
uuuccuccagaagcccucaccagagaaacacacguugugguacauuaccuggua

SEQ ID NO: 8627 - RNA, 54 nt, Artificial Sequence
  Description of Artificial Sequence:  Enzymatic Nucleic Acid
gguauagaagaagggucuaccagagaaacacacguugugguacauuaccuggua

SEQ ID NO: 8628 - RNA, 54 nt, Artificial Sequence
  Description of Artificial Sequence:  Enzymatic Nucleic Acid
ugggucccagaaguguugaccagagaaacacacguugugguacauuaccuggua

SEQ ID NO: 8629 - RNA, 54 nt, Artificial Sequence
  Description of Artificial Sequence:  Enzymatic Nucleic Acid
ugagucccagaaggagaaaccagagaaacacacguugugguacauuaccuggua

SEQ ID NO: 8630 - RNA, 54 nt, Artificial Sequence
  Description of Artificial Sequence:  Enzymatic Nucleic Acid
aguuucaaagaaguugaaaccagagaaacacacguugugguacauuaccuggua

SEQ ID NO: 8631 - RNA, 54 nt, Artificial Sequence
  Description of Artificial Sequence:  Enzymatic Nucleic Acid
uagcaucaagaagagccaaccagagaaacacacguugugguacauuaccuggua

SEQ ID NO: 8632 - RNA, 54 nt, Artificial Sequence
  Description of Artificial Sequence:  Enzymatic Nucleic Acid
ccccaagaagaagcaaucaccagagaaacacacguugugguacauuaccuggua

SEQ ID NO: 8633 - RNA, 54 nt, Artificial Sequence
  Description of Artificial Sequence:  Enzymatic Nucleic Acid
cacauaagagaagaggcaaccagagaaacacacguugugguacauuaccuggua

SEQ ID NO: 8634 - RNA, 54 nt, Artificial Sequence
  Description of Artificial Sequence:  Enzymatic Nucleic Acid
uccacaaaagaagcugccaccagagaaacacacguugugguacauuaccuggua

SEQ ID NO: 8635 - RNA, 54 nt, Artificial Sequence
  Description of Artificial Sequence:  Enzymatic Nucleic Acid
guggagagagaagucccaaccagagaaacacacguugugguacauuaccuggua

SEQ ID NO: 8636 - RNA, 54 nt, Artificial Sequence
  Description of Artificial Sequence:  Enzymatic Nucleic Acid
aaauugccagaagucacaaccagagaaacacacguugugguacauuaccuggua

SEQ ID NO: 8637 - RNA, 54 nt, Artificial Sequence
  Description of Artificial Sequence:  Enzymatic Nucleic Acid
aagacaugagaagcuaagaccagagaaacacacguugugguacauuaccuggua

SEQ ID NO: 8638 - RNA, 54 nt, Artificial Sequence
  Description of Artificial Sequence:  Enzymatic Nucleic Acid
uuugaaggagaagaguaaaccagagaaacacacguugugguacauuaccuggua

SEQ ID NO: 8639 - RNA, 54 nt, Artificial Sequence
  Description of Artificial Sequence:  Enzymatic Nucleic Acid
uccacccaagaaguuccaaccagagaaacacacguugugguacauuaccuggua

SEQ ID NO: 8640 - RNA, 54 nt, Artificial Sequence
  Description of Artificial Sequence:  Enzymatic Nucleic Acid
acuucuugagaagacaagaccagagaaacacacguugugguacauuaccuggua

SEQ ID NO: 8641 - RNA, 54 nt, Artificial Sequence
  Description of Artificial Sequence:  Enzymatic Nucleic Acid
aacauaaaagaaguugccaccagagaaacacacguugugguacauuaccuggua

SEQ ID NO: 8642 - RNA, 54 nt, Artificial Sequence
  Description of Artificial Sequence:  Enzymatic Nucleic Acid
uggaaggaagaagaacauaccagagaaacacacguugugguacauuaccuggua

SEQ ID NO: 8643 - RNA, 54 nt, Artificial Sequence
  Description of Artificial Sequence:  Enzymatic Nucleic Acid
cccauacaagaagcuaaaaccagagaaacacacguugugguacauuaccuggua

SEQ ID NO: 8644 - RNA, 54 nt, Artificial Sequence
  Description of Artificial Sequence:  Enzymatic Nucleic Acid
uuuucaugagaaggaauuaccagagaaacacacguugugguacauuaccuggua

SEQ ID NO: 8645 - RNA, 54 nt, Artificial Sequence
  Description of Artificial Sequence:  Enzymatic Nucleic Acid
gacauucaagaagaaaugaccagagaaacacacguugugguacauuaccuggua

SEQ ID NO: 8646 - RNA, 54 nt, Artificial Sequence
  Description of Artificial Sequence:  Enzymatic Nucleic Acid
aauauauaagaagacauuaccagagaaacacacguugugguacauuaccuggua

SEQ ID NO: 8647 - RNA, 54 nt, Artificial Sequence
  Description of Artificial Sequence:  Enzymatic Nucleic Acid
auacaaagagaagagaauaccagagaaacacacguugugguacauuaccuggua

SEQ ID NO: 8648 - RNA, 38 nt, Artificial Sequence
  Description of Artificial Sequence:  Enzymatic Nucleic Acid
cacagggccugaugaggccguuaggccgaaacggccag

SEQ ID NO: 8649 - RNA, 38 nt, Artificial Sequence
  Description of Artificial Sequence:  Enzymatic Nucleic Acid
uccacgcacugaugaggccguuaggccgaaagccacag

SEQ ID NO: 8650 - RNA, 38 nt, Artificial Sequence
  Description of Artificial Sequence:  Enzymatic Nucleic Acid
aacccacacugaugaggccguuaggccgaaaggcggcc

SEQ ID NO: 8651 - RNA, 38 nt, Artificial Sequence
  Description of Artificial Sequence:  Enzymatic Nucleic Acid
acuaggcacugaugaggccguuaggccgaaacccacag

SEQ ID NO: 8652 - RNA, 38 nt, Artificial Sequence
  Description of Artificial Sequence:  Enzymatic Nucleic Acid
cacuaggccugaugaggccguuaggccgaaaacccaca

SEQ ID NO: 8653 - RNA, 38 nt, Artificial Sequence
  Description of Artificial Sequence:  Enzymatic Nucleic Acid
agaaacaccugaugaggccguuaggccgaaaggcaaac

SEQ ID NO: 8654 - RNA, 38 nt, Artificial Sequence
  Description of Artificial Sequence:  Enzymatic Nucleic Acid
ucaagagacugaugaggccguuaggccgaaacacuagg

SEQ ID NO: 8655 - RNA, 38 nt, Artificial Sequence
  Description of Artificial Sequence:  Enzymatic Nucleic Acid
aucaagagcugaugaggccguuaggccgaaaacacuag

SEQ ID NO: 8656 - RNA, 38 nt, Artificial Sequence
  Description of Artificial Sequence:  Enzymatic Nucleic Acid
gaucaagacugaugaggccguuaggccgaaaaacacua

SEQ ID NO: 8657 - RNA, 38 nt, Artificial Sequence
  Description of Artificial Sequence:  Enzymatic Nucleic Acid
cagaucaacugaugaggccguuaggccgaaagaaacac

SEQ ID NO: 8658 - RNA, 38 nt, Artificial Sequence
  Description of Artificial Sequence:  Enzymatic Nucleic Acid
ggcagauccugaugaggccguuaggccgaaagagaaac

SEQ ID NO: 8659 - RNA, 38 nt, Artificial Sequence
  Description of Artificial Sequence:  Enzymatic Nucleic Acid
ccugggcacugaugaggccguuaggccgaaaucaagag

SEQ ID NO: 8660 - RNA, 38 nt, Artificial Sequence
  Description of Artificial Sequence:  Enzymatic Nucleic Acid
uguaugcucugaugaggccguuaggccgaaagccuggg

SEQ ID NO: 8661 - RNA, 38 nt, Artificial Sequence
  Description of Artificial Sequence:  Enzymatic Nucleic Acid
ucuuuuugcugaugaggccguuaggccgaaaugcugag

SEQ ID NO: 8662 - RNA, 38 nt, Artificial Sequence
  Description of Artificial Sequence:  Enzymatic Nucleic Acid
auuguaagcugaugaggccguuaggccgaaaugucuuu

SEQ ID NO: 8663 - RNA, 38 nt, Artificial Sequence
  Description of Artificial Sequence:  Enzymatic Nucleic Acid
uuaauugucugaugaggccguuaggccgaaaguauguc

SEQ ID NO: 8664 - RNA, 38 nt, Artificial Sequence
  Description of Artificial Sequence:  Enzymatic Nucleic Acid
cuuaauugcugaugaggccguuaggccgaaaaguaugu

SEQ ID NO: 8665 - RNA, 38 nt, Artificial Sequence
  Description of Artificial Sequence:  Enzymatic Nucleic Acid
uuagccuucugaugaggccguuaggccgaaauuguaag

SEQ ID NO: 8666 - RNA, 38 nt, Artificial Sequence
  Description of Artificial Sequence:  Enzymatic Nucleic Acid
auuagccucugaugaggccguuaggccgaaaauuguaa

SEQ ID NO: 8667 - RNA, 38 nt, Artificial Sequence
  Description of Artificial Sequence:  Enzymatic Nucleic Acid
aguuguaucugaugaggccguuaggccgaaagccuuaa

SEQ ID NO: 8668 - RNA, 38 nt, Artificial Sequence
  Description of Artificial Sequence:  Enzymatic Nucleic Acid
aagaguugcugaugaggccguuaggccgaaauuagccu

SEQ ID NO: 8669 - RNA, 38 nt, Artificial Sequence
  Description of Artificial Sequence:  Enzymatic Nucleic Acid
aauuugaacugaugaggccguuaggccgaaaguuguau

SEQ ID NO: 8670 - RNA, 38 nt, Artificial Sequence
  Description of Artificial Sequence:  Enzymatic Nucleic Acid
guaauuugcugaugaggccguuaggccgaaagaguugu

SEQ ID NO: 8671 - RNA, 38 nt, Artificial Sequence
  Description of Artificial Sequence:  Enzymatic Nucleic Acid
aguaauuucugaugaggccguuaggccgaaaagaguug

SEQ ID NO: 8672 - RNA, 38 nt, Artificial Sequence
  Description of Artificial Sequence:  Enzymatic Nucleic Acid
cugcaagucugaugaggccguuaggccgaaauuugaag

SEQ ID NO: 8673 - RNA, 38 nt, Artificial Sequence
  Description of Artificial Sequence:  Enzymatic Nucleic Acid
ccugcaagcugaugaggccguuaggccgaaaauuugaa

SEQ ID NO: 8674 - RNA, 38 nt, Artificial Sequence
  Description of Artificial Sequence:  Enzymatic Nucleic Acid
uccccugccugaugaggccguuaggccgaaaguaauuu

SEQ ID NO: 8675 - RNA, 38 nt, Artificial Sequence
  Description of Artificial Sequence:  Enzymatic Nucleic Acid
gccagucccugaugaggccguuaggccgaaagucccuc

SEQ ID NO: 8676 - RNA, 38 nt, Artificial Sequence
  Description of Artificial Sequence:  Enzymatic Nucleic Acid
uugggccacugaugaggccguuaggccgaaagccaguc

SEQ ID NO: 8677 - RNA, 38 nt, Artificial Sequence
  Description of Artificial Sequence:  Enzymatic Nucleic Acid
auugggcccugaugaggccguuaggccgaaaagccagu

SEQ ID NO: 8678 - RNA, 38 nt, Artificial Sequence
  Description of Artificial Sequence:  Enzymatic Nucleic Acid
acucugaucugaugaggccguuaggccgaaauugggcc

SEQ ID NO: 8679 - RNA, 38 nt, Artificial Sequence
  Description of Artificial Sequence:  Enzymatic Nucleic Acid
gccacucucugaugaggccguuaggccgaaauuauugg

SEQ ID NO: 8680 - RNA, 38 nt, Artificial Sequence
  Description of Artificial Sequence:  Enzymatic Nucleic Acid
uuacagaacugaugaggccguuaggccgaaaggccauc

SEQ ID NO: 8681 - RNA, 38 nt, Artificial Sequence
  Description of Artificial Sequence:  Enzymatic Nucleic Acid
ucuuacagcugaugaggccguuaggccgaaagaggcca

SEQ ID NO: 8682 - RNA, 38 nt, Artificial Sequence
  Description of Artificial Sequence:  Enzymatic Nucleic Acid
gucuuacacugaugaggccguuaggccgaaaagaggcc

SEQ ID NO: 8683 - RNA, 38 nt, Artificial Sequence
  Description of Artificial Sequence:  Enzymatic Nucleic Acid
gagugucucugaugaggccguuaggccgaaacagaaga

SEQ ID NO: 8684 - RNA, 38 nt, Artificial Sequence
  Description of Artificial Sequence:  Enzymatic Nucleic Acid
ggaauugucugaugaggccguuaggccgaaagugucuu

SEQ ID NO: 8685 - RNA, 38 nt, Artificial Sequence
  Description of Artificial Sequence:  Enzymatic Nucleic Acid
acuuuuggcugaugaggccguuaggccgaaauugugag

SEQ ID NO: 8686 - RNA, 38 nt, Artificial Sequence
  Description of Artificial Sequence:  Enzymatic Nucleic Acid
cacuuuugcugaugaggccguuaggccgaaaauuguga

SEQ ID NO: 8687 - RNA, 38 nt, Artificial Sequence
  Description of Artificial Sequence:  Enzymatic Nucleic Acid
ucauuucccugaugaggccguuaggccgaaaucacuuu

SEQ ID NO: 8688 - RNA, 38 nt, Artificial Sequence
  Description of Artificial Sequence:  Enzymatic Nucleic Acid
agcacuugcugaugaggccguuaggccgaaaggcucca

SEQ ID NO: 8689 - RNA, 38 nt, Artificial Sequence
  Description of Artificial Sequence:  Enzymatic Nucleic Acid
cccgguagcugaugaggccguuaggccgaaagcacuug

SEQ ID NO: 8690 - RNA, 38 nt, Artificial Sequence
  Description of Artificial Sequence:  Enzymatic Nucleic Acid
ucccgguacugaugaggccguuaggccgaaaagcacuu

SEQ ID NO: 8691 - RNA, 38 nt, Artificial Sequence
  Description of Artificial Sequence:  Enzymatic Nucleic Acid
uuucccggcugaugaggccguuaggccgaaagaagcac

SEQ ID NO: 8692 - RNA, 38 nt, Artificial Sequence
  Description of Artificial Sequence:  Enzymatic Nucleic Acid
ccgaggcccugaugaggccguuaggccgaaagucaguu

SEQ ID NO: 8693 - RNA, 38 nt, Artificial Sequence
  Description of Artificial Sequence:  Enzymatic Nucleic Acid
aaaugacccugaugaggccguuaggccgaaaggccaag

SEQ ID NO: 8694 - RNA, 38 nt, Artificial Sequence
  Description of Artificial Sequence:  Enzymatic Nucleic Acid
acauaaaucugaugaggccguuaggccgaaaccgaggc

SEQ ID NO: 8695 - RNA, 38 nt, Artificial Sequence
  Description of Artificial Sequence:  Enzymatic Nucleic Acid
uagacauacugaugaggccguuaggccgaaaugaccga

SEQ ID NO: 8696 - RNA, 38 nt, Artificial Sequence
  Description of Artificial Sequence:  Enzymatic Nucleic Acid
auagacaucugaugaggccguuaggccgaaaaugaccg

SEQ ID NO: 8697 - RNA, 38 nt, Artificial Sequence
  Description of Artificial Sequence:  Enzymatic Nucleic Acid
cauagacacugaugaggccguuaggccgaaaaaugacc

SEQ ID NO: 8698 - RNA, 38 nt, Artificial Sequence
  Description of Artificial Sequence:  Enzymatic Nucleic Acid
ugaacauacugaugaggccguuaggccgaaacauaaau

SEQ ID NO: 8699 - RNA, 38 nt, Artificial Sequence
  Description of Artificial Sequence:  Enzymatic Nucleic Acid
cuugaacacugaugaggccguuaggccgaaagacauaa

SEQ ID NO: 8700 - RNA, 38 nt, Artificial Sequence
  Description of Artificial Sequence:  Enzymatic Nucleic Acid
uaaucuugcugaugaggccguuaggccgaaacauagac

SEQ ID NO: 8701 - RNA, 38 nt, Artificial Sequence
  Description of Artificial Sequence:  Enzymatic Nucleic Acid
guaaucuucugaugaggccguuaggccgaaaacauaga

SEQ ID NO: 8702 - RNA, 38 nt, Artificial Sequence
  Description of Artificial Sequence:  Enzymatic Nucleic Acid
agaucugucugaugaggccguuaggccgaaaucuugaa

SEQ ID NO: 8703 - RNA, 38 nt, Artificial Sequence
  Description of Artificial Sequence:  Enzymatic Nucleic Acid
gagaucugcugaugaggccguuaggccgaaaaucuuga

SEQ ID NO: 8704 - RNA, 38 nt, Artificial Sequence
  Description of Artificial Sequence:  Enzymatic Nucleic Acid
uaaauggacugaugaggccguuaggccgaaaucuguaa

SEQ ID NO: 8705 - RNA, 38 nt, Artificial Sequence
  Description of Artificial Sequence:  Enzymatic Nucleic Acid
aauaaaugcugaugaggccguuaggccgaaagaucugu

SEQ ID NO: 8706 - RNA, 38 nt, Artificial Sequence
  Description of Artificial Sequence:  Enzymatic Nucleic Acid
aagcaauacugaugaggccguuaggccgaaauggagau

SEQ ID NO: 8707 - RNA, 38 nt, Artificial Sequence
  Description of Artificial Sequence:  Enzymatic Nucleic Acid
gaagcaaucugaugaggccguuaggccgaaaauggaga

SEQ ID NO: 8708 - RNA, 38 nt, Artificial Sequence
  Description of Artificial Sequence:  Enzymatic Nucleic Acid
agaagcaacugaugaggccguuaggccgaaaaauggag

SEQ ID NO: 8709 - RNA, 38 nt, Artificial Sequence
  Description of Artificial Sequence:  Enzymatic Nucleic Acid
acagaagccugaugaggccguuaggccgaaauaaaugg

SEQ ID NO: 8710 - RNA, 38 nt, Artificial Sequence
  Description of Artificial Sequence:  Enzymatic Nucleic Acid
acuaacagcugaugaggccguuaggccgaaagcaauaa

SEQ ID NO: 8711 - RNA, 38 nt, Artificial Sequence
  Description of Artificial Sequence:  Enzymatic Nucleic Acid
cacuaacacugaugaggccguuaggccgaaaagcaaua

SEQ ID NO: 8712 - RNA, 38 nt, Artificial Sequence
  Description of Artificial Sequence:  Enzymatic Nucleic Acid
uggucacucugaugaggccguuaggccgaaacagaagc

SEQ ID NO: 8713 - RNA, 38 nt, Artificial Sequence
  Description of Artificial Sequence:  Enzymatic Nucleic Acid
uuggucaccugaugaggccguuaggccgaaaacagaag

SEQ ID NO: 8714 - RNA, 38 nt, Artificial Sequence
  Description of Artificial Sequence:  Enzymatic Nucleic Acid
auguacaccugaugaggccguuaggccgaaacuccaug

SEQ ID NO: 8715 - RNA, 38 nt, Artificial Sequence
  Description of Artificial Sequence:  Enzymatic Nucleic Acid
caguaaugcugaugaggccguuaggccgaaacacgacu

SEQ ID NO: 8716 - RNA, 38 nt, Artificial Sequence
  Description of Artificial Sequence:  Enzymatic Nucleic Acid
uucucagucugaugaggccguuaggccgaaauguacac

SEQ ID NO: 8717 - RNA, 38 nt, Artificial Sequence
  Description of Artificial Sequence:  Enzymatic Nucleic Acid
guucucagcugaugaggccguuaggccgaaaauguaca

SEQ ID NO: 8718 - RNA, 38 nt, Artificial Sequence
  Description of Artificial Sequence:  Enzymatic Nucleic Acid
agacauggcugaugaggccguuaggccgaaaucaccac

SEQ ID NO: 8719 - RNA, 38 nt, Artificial Sequence
  Description of Artificial Sequence:  Enzymatic Nucleic Acid
gagacaugcugaugaggccguuaggccgaaaaucacca

SEQ ID NO: 8720 - RNA, 38 nt, Artificial Sequence
  Description of Artificial Sequence:  Enzymatic Nucleic Acid
ggacccgacugaugaggccguuaggccgaaacauggaa

SEQ ID NO: 8721 - RNA, 38 nt, Artificial Sequence
  Description of Artificial Sequence:  Enzymatic Nucleic Acid
auggaccccugaugaggccguuaggccgaaagacaugg

SEQ ID NO: 8722 - RNA, 38 nt, Artificial Sequence
  Description of Artificial Sequence:  Enzymatic Nucleic Acid
uugaaaugcugaugaggccguuaggccgaaacccgaga

SEQ ID NO: 8723 - RNA, 38 nt, Artificial Sequence
  Description of Artificial Sequence:  Enzymatic Nucleic Acid
agauuugacugaugaggccguuaggccgaaauggaccc

SEQ ID NO: 8724 - RNA, 38 nt, Artificial Sequence
  Description of Artificial Sequence:  Enzymatic Nucleic Acid
gagauuugcugaugaggccguuaggccgaaaauggacc

SEQ ID NO: 8725 - RNA, 38 nt, Artificial Sequence
  Description of Artificial Sequence:  Enzymatic Nucleic Acid
ugagauuucugaugaggccguuaggccgaaaaauggac

SEQ ID NO: 8726 - RNA, 38 nt, Artificial Sequence
  Description of Artificial Sequence:  Enzymatic Nucleic Acid
cacguugacugaugaggccguuaggccgaaauuugaaa

SEQ ID NO: 8727 - RNA, 38 nt, Artificial Sequence
  Description of Artificial Sequence:  Enzymatic Nucleic Acid
gacacguucugaugaggccguuaggccgaaagauuuga

SEQ ID NO: 8728 - RNA, 38 nt, Artificial Sequence
  Description of Artificial Sequence:  Enzymatic Nucleic Acid
cacaaagucugaugaggccguuaggccgaaacacguug

SEQ ID NO: 8729 - RNA, 38 nt, Artificial Sequence
  Description of Artificial Sequence:  Enzymatic Nucleic Acid
cuugcacacugaugaggccguuaggccgaaagugacac

SEQ ID NO: 8730 - RNA, 38 nt, Artificial Sequence
  Description of Artificial Sequence:  Enzymatic Nucleic Acid
ucuugcaccugaugaggccguuaggccgaaaagugaca

SEQ ID NO: 8731 - RNA, 38 nt, Artificial Sequence
  Description of Artificial Sequence:  Enzymatic Nucleic Acid
uuucugggcugaugaggccguuaggccgaaaucuugca

SEQ ID NO: 8732 - RNA, 38 nt, Artificial Sequence
  Description of Artificial Sequence:  Enzymatic Nucleic Acid
caggaacacugaugaggccguuaggccgaaaucucuuu

SEQ ID NO: 8733 - RNA, 38 nt, Artificial Sequence
  Description of Artificial Sequence:  Enzymatic Nucleic Acid
ucaggaaccugaugaggccguuaggccgaaaaucucuu

SEQ ID NO: 8734 - RNA, 38 nt, Artificial Sequence
  Description of Artificial Sequence:  Enzymatic Nucleic Acid
ccaucaggcugaugaggccguuaggccgaaacaaaucu

SEQ ID NO: 8735 - RNA, 38 nt, Artificial Sequence
  Description of Artificial Sequence:  Enzymatic Nucleic Acid
accaucagcugaugaggccguuaggccgaaaacaaauc

SEQ ID NO: 8736 - RNA, 38 nt, Artificial Sequence
  Description of Artificial Sequence:  Enzymatic Nucleic Acid
aauucugucugaugaggccguuaggccgaaaccaucag

SEQ ID NO: 8737 - RNA, 38 nt, Artificial Sequence
  Description of Artificial Sequence:  Enzymatic Nucleic Acid
ucccaggacugaugaggccguuaggccgaaauucuguu

SEQ ID NO: 8738 - RNA, 38 nt, Artificial Sequence
  Description of Artificial Sequence:  Enzymatic Nucleic Acid
gucccaggcugaugaggccguuaggccgaaaauucugu

SEQ ID NO: 8739 - RNA, 38 nt, Artificial Sequence
  Description of Artificial Sequence:  Enzymatic Nucleic Acid
ugucccagcugaugaggccguuaggccgaaaaauucug

SEQ ID NO: 8740 - RNA, 38 nt, Artificial Sequence
  Description of Artificial Sequence:  Enzymatic Nucleic Acid
gaauaguacugaugaggccguuaggccgaaagcccuuc

SEQ ID NO: 8741 - RNA, 38 nt, Artificial Sequence
  Description of Artificial Sequence:  Enzymatic Nucleic Acid
ggaauagucugaugaggccguuaggccgaaaagcccuu

SEQ ID NO: 8742 - RNA, 38 nt, Artificial Sequence
  Description of Artificial Sequence:  Enzymatic Nucleic Acid
gggaauagcugaugaggccguuaggccgaaaaagcccu

SEQ ID NO: 8743 - RNA, 38 nt, Artificial Sequence
  Description of Artificial Sequence:  Enzymatic Nucleic Acid
gcugggaacugaugaggccguuaggccgaaaguaaagc

SEQ ID NO: 8744 - RNA, 38 nt, Artificial Sequence
  Description of Artificial Sequence:  Enzymatic Nucleic Acid
uagcugggcugaugaggccguuaggccgaaauaguaaa

SEQ ID NO: 8745 - RNA, 38 nt, Artificial Sequence
  Description of Artificial Sequence:  Enzymatic Nucleic Acid
guagcuggcugaugaggccguuaggccgaaaauaguaa

SEQ ID NO: 8746 - RNA, 38 nt, Artificial Sequence
  Description of Artificial Sequence:  Enzymatic Nucleic Acid
ugaucaugcugaugaggccguuaggccgaaagcuggga

SEQ ID NO: 8747 - RNA, 38 nt, Artificial Sequence
  Description of Artificial Sequence:  Enzymatic Nucleic Acid
gcauagcucugaugaggccguuaggccgaaaucaugua

SEQ ID NO: 8748 - RNA, 38 nt, Artificial Sequence
  Description of Artificial Sequence:  Enzymatic Nucleic Acid
ugccagcacugaugaggccguuaggccgaaagcugauc

SEQ ID NO: 8749 - RNA, 38 nt, Artificial Sequence
  Description of Artificial Sequence:  Enzymatic Nucleic Acid
ucacagaacugaugaggccguuaggccgaaaccaugcc

SEQ ID NO: 8750 - RNA, 38 nt, Artificial Sequence
  Description of Artificial Sequence:  Enzymatic Nucleic Acid
cuucacagcugaugaggccguuaggccgaaagaccaug

SEQ ID NO: 8751 - RNA, 38 nt, Artificial Sequence
  Description of Artificial Sequence:  Enzymatic Nucleic Acid
gcuucacacugaugaggccguuaggccgaaaagaccau

SEQ ID NO: 8752 - RNA, 38 nt, Artificial Sequence
  Description of Artificial Sequence:  Enzymatic Nucleic Acid
ucaucauucugaugaggccguuaggccgaaauuuuugc

SEQ ID NO: 8753 - RNA, 38 nt, Artificial Sequence
  Description of Artificial Sequence:  Enzymatic Nucleic Acid
uucaucaucugaugaggccguuaggccgaaaauuuuug

SEQ ID NO: 8754 - RNA, 38 nt, Artificial Sequence
  Description of Artificial Sequence:  Enzymatic Nucleic Acid
agacuggucugaugaggccguuaggccgaaacuuucau

SEQ ID NO: 8755 - RNA, 38 nt, Artificial Sequence
  Description of Artificial Sequence:  Enzymatic Nucleic Acid
uagacuggcugaugaggccguuaggccgaaaacuuuca

SEQ ID NO: 8756 - RNA, 38 nt, Artificial Sequence
  Description of Artificial Sequence:  Enzymatic Nucleic Acid
acauaauacugaugaggccguuaggccgaaacugguaa

SEQ ID NO: 8757 - RNA, 38 nt, Artificial Sequence
  Description of Artificial Sequence:  Enzymatic Nucleic Acid
guacauaacugaugaggccguuaggccgaaagacuggu

SEQ ID NO: 8758 - RNA, 38 nt, Artificial Sequence
  Description of Artificial Sequence:  Enzymatic Nucleic Acid
auguacaucugaugaggccguuaggccgaaauagacug

SEQ ID NO: 8759 - RNA, 38 nt, Artificial Sequence
  Description of Artificial Sequence:  Enzymatic Nucleic Acid
uauguacacugaugaggccguuaggccgaaaauagacu

SEQ ID NO: 8760 - RNA, 38 nt, Artificial Sequence
  Description of Artificial Sequence:  Enzymatic Nucleic Acid
caacuaugcugaugaggccguuaggccgaaacauaaua

SEQ ID NO: 8761 - RNA, 38 nt, Artificial Sequence
  Description of Artificial Sequence:  Enzymatic Nucleic Acid
acgacaaccugaugaggccguuaggccgaaauguacau

SEQ ID NO: 8762 - RNA, 38 nt, Artificial Sequence
  Description of Artificial Sequence:  Enzymatic Nucleic Acid
acaacgaccugaugaggccguuaggccgaaacuaugua

SEQ ID NO: 8763 - RNA, 38 nt, Artificial Sequence
  Description of Artificial Sequence:  Enzymatic Nucleic Acid
ccuacaaccugaugaggccguuaggccgaaacaacuau

SEQ ID NO: 8764 - RNA, 38 nt, Artificial Sequence
  Description of Artificial Sequence:  Enzymatic Nucleic Acid
uacccuaccugaugaggccguuaggccgaaacgacaac

SEQ ID NO: 8765 - RNA, 38 nt, Artificial Sequence
  Description of Artificial Sequence:  Enzymatic Nucleic Acid
cuauaccccugaugaggccguuaggccgaaacaacgac

SEQ ID NO: 8766 - RNA, 38 nt, Artificial Sequence
  Description of Artificial Sequence:  Enzymatic Nucleic Acid
aaauccuacugaugaggccguuaggccgaaacccuaca

SEQ ID NO: 8767 - RNA, 38 nt, Artificial Sequence
  Description of Artificial Sequence:  Enzymatic Nucleic Acid
auaaaucccugaugaggccguuaggccgaaauacccua

SEQ ID NO: 8768 - RNA, 38 nt, Artificial Sequence
  Description of Artificial Sequence:  Enzymatic Nucleic Acid
acaucauacugaugaggccguuaggccgaaauccuaua

SEQ ID NO: 8769 - RNA, 38 nt, Artificial Sequence
  Description of Artificial Sequence:  Enzymatic Nucleic Acid
cacaucaucugaugaggccguuaggccgaaaauccuau

SEQ ID NO: 8770 - RNA, 38 nt, Artificial Sequence
  Description of Artificial Sequence:  Enzymatic Nucleic Acid
ccacaucacugaugaggccguuaggccgaaaaauccua

SEQ ID NO: 8771 - RNA, 38 nt, Artificial Sequence
  Description of Artificial Sequence:  Enzymatic Nucleic Acid
ggacucagcugaugaggccguuaggccgaaaccacauc

SEQ ID NO: 8772 - RNA, 38 nt, Artificial Sequence
  Description of Artificial Sequence:  Enzymatic Nucleic Acid
cggacucacugaugaggccguuaggccgaaaaccacau

SEQ ID NO: 8773 - RNA, 38 nt, Artificial Sequence
  Description of Artificial Sequence:  Enzymatic Nucleic Acid
augagacgcugaugaggccguuaggccgaaacucagaa

SEQ ID NO: 8774 - RNA, 38 nt, Artificial Sequence
  Description of Artificial Sequence:  Enzymatic Nucleic Acid
uuccaugacugaugaggccguuaggccgaaacggacuc

SEQ ID NO: 8775 - RNA, 38 nt, Artificial Sequence
  Description of Artificial Sequence:  Enzymatic Nucleic Acid
aauuccaucugaugaggccguuaggccgaaagacggac

SEQ ID NO: 8776 - RNA, 38 nt, Artificial Sequence
  Description of Artificial Sequence:  Enzymatic Nucleic Acid
gauaguuccugaugaggccguuaggccgaaauuccaug

SEQ ID NO: 8777 - RNA, 38 nt, Artificial Sequence
  Description of Artificial Sequence:  Enzymatic Nucleic Acid
ccaacagacugaugaggccguuaggccgaaaguucaau

SEQ ID NO: 8778 - RNA, 38 nt, Artificial Sequence
  Description of Artificial Sequence:  Enzymatic Nucleic Acid
cuccaacacugaugaggccguuaggccgaaauaguuca

SEQ ID NO: 8779 - RNA, 38 nt, Artificial Sequence
  Description of Artificial Sequence:  Enzymatic Nucleic Acid
uuuucucccugaugaggccguuaggccgaaacagauag

SEQ ID NO: 8780 - RNA, 38 nt, Artificial Sequence
  Description of Artificial Sequence:  Enzymatic Nucleic Acid
uuuaagaccugaugaggccguuaggccgaaagcuuuuc

SEQ ID NO: 8781 - RNA, 38 nt, Artificial Sequence
  Description of Artificial Sequence:  Enzymatic Nucleic Acid
caauuuaacugaugaggccguuaggccgaaacaagcuu

SEQ ID NO: 8782 - RNA, 38 nt, Artificial Sequence
  Description of Artificial Sequence:  Enzymatic Nucleic Acid
uacaauuucugaugaggccguuaggccgaaagacaagc

SEQ ID NO: 8783 - RNA, 38 nt, Artificial Sequence
  Description of Artificial Sequence:  Enzymatic Nucleic Acid
guacaauucugaugaggccguuaggccgaaaagacaag

SEQ ID NO: 8784 - RNA, 38 nt, Artificial Sequence
  Description of Artificial Sequence:  Enzymatic Nucleic Acid
ugcuguaccugaugaggccguuaggccgaaauuuaaga

SEQ ID NO: 8785 - RNA, 38 nt, Artificial Sequence
  Description of Artificial Sequence:  Enzymatic Nucleic Acid
ucuugcugcugaugaggccguuaggccgaaacaauuua

SEQ ID NO: 8786 - RNA, 38 nt, Artificial Sequence
  Description of Artificial Sequence:  Enzymatic Nucleic Acid
cccacauucugaugaggccguuaggccgaaaguucagu

SEQ ID NO: 8787 - RNA, 38 nt, Artificial Sequence
  Description of Artificial Sequence:  Enzymatic Nucleic Acid
uugaaguccugaugaggccguuaggccgaaauccccac

SEQ ID NO: 8788 - RNA, 38 nt, Artificial Sequence
  Description of Artificial Sequence:  Enzymatic Nucleic Acid
cccaguugcugaugaggccguuaggccgaaagucaauc

SEQ ID NO: 8789 - RNA, 38 nt, Artificial Sequence
  Description of Artificial Sequence:  Enzymatic Nucleic Acid
ucccaguucugaugaggccguuaggccgaaaagucaau

SEQ ID NO: 8790 - RNA, 38 nt, Artificial Sequence
  Description of Artificial Sequence:  Enzymatic Nucleic Acid
aagaagggcugaugaggccguuaggccgaaauucccag

SEQ ID NO: 8791 - RNA, 38 nt, Artificial Sequence
  Description of Artificial Sequence:  Enzymatic Nucleic Acid
cuucgaagcugaugaggccguuaggccgaaaggguauu

SEQ ID NO: 8792 - RNA, 38 nt, Artificial Sequence
  Description of Artificial Sequence:  Enzymatic Nucleic Acid
gcuucgaacugaugaggccguuaggccgaaaaggguau

SEQ ID NO: 8793 - RNA, 38 nt, Artificial Sequence
  Description of Artificial Sequence:  Enzymatic Nucleic Acid
augcuucgcugaugaggccguuaggccgaaagaagggu

SEQ ID NO: 8794 - RNA, 38 nt, Artificial Sequence
  Description of Artificial Sequence:  Enzymatic Nucleic Acid
gaugcuuccugaugaggccguuaggccgaaaagaaggg

SEQ ID NO: 8795 - RNA, 38 nt, Artificial Sequence
  Description of Artificial Sequence:  Enzymatic Nucleic Acid
cuuaugcucugaugaggccguuaggccgaaaugcuucg

SEQ ID NO: 8796 - RNA, 38 nt, Artificial Sequence
  Description of Artificial Sequence:  Enzymatic Nucleic Acid
aaguuucucugaugaggccguuaggccgaaaugcugau

SEQ ID NO: 8797 - RNA, 38 nt, Artificial Sequence
  Description of Artificial Sequence:  Enzymatic Nucleic Acid
cgguuuaccugaugaggccguuaggccgaaaguuucuu

SEQ ID NO: 8798 - RNA, 38 nt, Artificial Sequence
  Description of Artificial Sequence:  Enzymatic Nucleic Acid
ucucgguucugaugaggccguuaggccgaaacaaguuu

SEQ ID NO: 8799 - RNA, 38 nt, Artificial Sequence
  Description of Artificial Sequence:  Enzymatic Nucleic Acid
uggguuuucugaugaggccguuaggccgaaaggucucg

SEQ ID NO: 8800 - RNA, 38 nt, Artificial Sequence
  Description of Artificial Sequence:  Enzymatic Nucleic Acid
cacucccacugaugaggccguuaggccgaaacuggguu

SEQ ID NO: 8801 - RNA, 38 nt, Artificial Sequence
  Description of Artificial Sequence:  Enzymatic Nucleic Acid
ugcucaaacugaugaggccguuaggccgaaauuucuuc

SEQ ID NO: 8802 - RNA, 38 nt, Artificial Sequence
  Description of Artificial Sequence:  Enzymatic Nucleic Acid
gugcucaacugaugaggccguuaggccgaaaauuucuu

SEQ ID NO: 8803 - RNA, 38 nt, Artificial Sequence
  Description of Artificial Sequence:  Enzymatic Nucleic Acid
ggugcucacugaugaggccguuaggccgaaaaauuucu

SEQ ID NO: 8804 - RNA, 38 nt, Artificial Sequence
  Description of Artificial Sequence:  Enzymatic Nucleic Acid
aggugcuccugaugaggccguuaggccgaaaaaauuuc

SEQ ID NO: 8805 - RNA, 38 nt, Artificial Sequence
  Description of Artificial Sequence:  Enzymatic Nucleic Acid
cuauaguucugaugaggccguuaggccgaaaggugcuc

SEQ ID NO: 8806 - RNA, 38 nt, Artificial Sequence
  Description of Artificial Sequence:  Enzymatic Nucleic Acid
ucuauagucugaugaggccguuaggccgaaaaggugcu

SEQ ID NO: 8807 - RNA, 38 nt, Artificial Sequence
  Description of Artificial Sequence:  Enzymatic Nucleic Acid
accaucuacugaugaggccguuaggccgaaaguuaagg

SEQ ID NO: 8808 - RNA, 38 nt, Artificial Sequence
  Description of Artificial Sequence:  Enzymatic Nucleic Acid
acaccauccugaugaggccguuaggccgaaauaguuaa

SEQ ID NO: 8809 - RNA, 38 nt, Artificial Sequence
  Description of Artificial Sequence:  Enzymatic Nucleic Acid
cuccgggucugaugaggccguuaggccgaaacaccauc

SEQ ID NO: 8810 - RNA, 38 nt, Artificial Sequence
  Description of Artificial Sequence:  Enzymatic Nucleic Acid
agguguaccugaugaggccguuaggccgaaauccuugg

SEQ ID NO: 8811 - RNA, 38 nt, Artificial Sequence
  Description of Artificial Sequence:  Enzymatic Nucleic Acid
cacaggugcugaugaggccguuaggccgaaacaauccu

SEQ ID NO: 8812 - RNA, 38 nt, Artificial Sequence
  Description of Artificial Sequence:  Enzymatic Nucleic Acid
gcccacugcugaugaggccguuaggccgaaaugcugca

SEQ ID NO: 8813 - RNA, 38 nt, Artificial Sequence
  Description of Artificial Sequence:  Enzymatic Nucleic Acid
cccugacacugaugaggccguuaggccgaaaugugcug

SEQ ID NO: 8814 - RNA, 38 nt, Artificial Sequence
  Description of Artificial Sequence:  Enzymatic Nucleic Acid
acccugaccugaugaggccguuaggccgaaaaugugcu

SEQ ID NO: 8815 - RNA, 38 nt, Artificial Sequence
  Description of Artificial Sequence:  Enzymatic Nucleic Acid
uggacccucugaugaggccguuaggccgaaacaaaugu

SEQ ID NO: 8816 - RNA, 38 nt, Artificial Sequence
  Description of Artificial Sequence:  Enzymatic Nucleic Acid
uuuucaugcugaugaggccguuaggccgaaacccugac

SEQ ID NO: 8817 - RNA, 38 nt, Artificial Sequence
  Description of Artificial Sequence:  Enzymatic Nucleic Acid
agcaacaacugaugaggccguuaggccgaaagguuuuu

SEQ ID NO: 8818 - RNA, 38 nt, Artificial Sequence
  Description of Artificial Sequence:  Enzymatic Nucleic Acid
aagcaacacugaugaggccguuaggccgaaaagguuuu

SEQ ID NO: 8819 - RNA, 38 nt, Artificial Sequence
  Description of Artificial Sequence:  Enzymatic Nucleic Acid
aaagcaaccugaugaggccguuaggccgaaaaagguuu

SEQ ID NO: 8820 - RNA, 38 nt, Artificial Sequence
  Description of Artificial Sequence:  Enzymatic Nucleic Acid
ccaaaagccugaugaggccguuaggccgaaacaaaagg

SEQ ID NO: 8821 - RNA, 38 nt, Artificial Sequence
  Description of Artificial Sequence:  Enzymatic Nucleic Acid
acuuccaacugaugaggccguuaggccgaaagcaacaa

SEQ ID NO: 8822 - RNA, 38 nt, Artificial Sequence
  Description of Artificial Sequence:  Enzymatic Nucleic Acid
cacuuccacugaugaggccguuaggccgaaaagcaaca

SEQ ID NO: 8823 - RNA, 38 nt, Artificial Sequence
  Description of Artificial Sequence:  Enzymatic Nucleic Acid
ccacuucccugaugaggccguuaggccgaaaaagcaac

SEQ ID NO: 8824 - RNA, 38 nt, Artificial Sequence
  Description of Artificial Sequence:  Enzymatic Nucleic Acid
ccaccagacugaugaggccguuaggccgaaauuccaug

SEQ ID NO: 8825 - RNA, 38 nt, Artificial Sequence
  Description of Artificial Sequence:  Enzymatic Nucleic Acid
uuccaccacugaugaggccguuaggccgaaagauucca

SEQ ID NO: 8826 - RNA, 38 nt, Artificial Sequence
  Description of Artificial Sequence:  Enzymatic Nucleic Acid
gggauucucugaugaggccguuaggccgaaacacgcuc

SEQ ID NO: 8827 - RNA, 38 nt, Artificial Sequence
  Description of Artificial Sequence:  Enzymatic Nucleic Acid
uucgcaggcugaugaggccguuaggccgaaauucugac

SEQ ID NO: 8828 - RNA, 38 nt, Artificial Sequence
  Description of Artificial Sequence:  Enzymatic Nucleic Acid
aaccaaggcugaugaggccguuaggccgaaacuucgca

SEQ ID NO: 8829 - RNA, 38 nt, Artificial Sequence
  Description of Artificial Sequence:  Enzymatic Nucleic Acid
ggguaacccugaugaggccguuaggccgaaagguacuu

SEQ ID NO: 8830 - RNA, 38 nt, Artificial Sequence
  Description of Artificial Sequence:  Enzymatic Nucleic Acid
gggugggucugaugaggccguuaggccgaaaccaaggu

SEQ ID NO: 8831 - RNA, 38 nt, Artificial Sequence
  Description of Artificial Sequence:  Enzymatic Nucleic Acid
ggggugggcugaugaggccguuaggccgaaaaccaagg

SEQ ID NO: 8832 - RNA, 38 nt, Artificial Sequence
  Description of Artificial Sequence:  Enzymatic Nucleic Acid
uaccauuucugaugaggccguuaggccgaaauuucugg

SEQ ID NO: 8833 - RNA, 38 nt, Artificial Sequence
  Description of Artificial Sequence:  Enzymatic Nucleic Acid
cauuuuuacugaugaggccguuaggccgaaaccauuuu

SEQ ID NO: 8834 - RNA, 38 nt, Artificial Sequence
  Description of Artificial Sequence:  Enzymatic Nucleic Acid
uccauuuucugaugaggccguuaggccgaaauaccauu

SEQ ID NO: 8835 - RNA, 38 nt, Artificial Sequence
  Description of Artificial Sequence:  Enzymatic Nucleic Acid
ucaaggggcugaugaggccguuaggccgaaauuccauu

SEQ ID NO: 8836 - RNA, 38 nt, Artificial Sequence
  Description of Artificial Sequence:  Enzymatic Nucleic Acid
uuggacuccugaugaggccguuaggccgaaagggguau

SEQ ID NO: 8837 - RNA, 38 nt, Artificial Sequence
  Description of Artificial Sequence:  Enzymatic Nucleic Acid
ugugauugcugaugaggccguuaggccgaaacucaagg

SEQ ID NO: 8838 - RNA, 38 nt, Artificial Sequence
  Description of Artificial Sequence:  Enzymatic Nucleic Acid
aauugugucugaugaggccguuaggccgaaauuggacu

SEQ ID NO: 8839 - RNA, 38 nt, Artificial Sequence
  Description of Artificial Sequence:  Enzymatic Nucleic Acid
cccgcuuucugaugaggccguuaggccgaaauugugug

SEQ ID NO: 8840 - RNA, 38 nt, Artificial Sequence
  Description of Artificial Sequence:  Enzymatic Nucleic Acid
ccccgcuucugaugaggccguuaggccgaaaauugugu

SEQ ID NO: 8841 - RNA, 38 nt, Artificial Sequence
  Description of Artificial Sequence:  Enzymatic Nucleic Acid
aucgucagcugaugaggccguuaggccgaaacaugccc

SEQ ID NO: 8842 - RNA, 38 nt, Artificial Sequence
  Description of Artificial Sequence:  Enzymatic Nucleic Acid
acuuccaucugaugaggccguuaggccgaaaucgucag

SEQ ID NO: 8843 - RNA, 38 nt, Artificial Sequence
  Description of Artificial Sequence:  Enzymatic Nucleic Acid
cacuuccacugaugaggccguuaggccgaaaaucguca

SEQ ID NO: 8844 - RNA, 38 nt, Artificial Sequence
  Description of Artificial Sequence:  Enzymatic Nucleic Acid
gacagugucugaugaggccguuaggccgaaauuuccug

SEQ ID NO: 8845 - RNA, 38 nt, Artificial Sequence
  Description of Artificial Sequence:  Enzymatic Nucleic Acid
ugacagugcugaugaggccguuaggccgaaaauuuccu

SEQ ID NO: 8846 - RNA, 38 nt, Artificial Sequence
  Description of Artificial Sequence:  Enzymatic Nucleic Acid
guaaggaucugaugaggccguuaggccgaaacagugua

SEQ ID NO: 8847 - RNA, 38 nt, Artificial Sequence
  Description of Artificial Sequence:  Enzymatic Nucleic Acid
uugguaagcugaugaggccguuaggccgaaaugacagu

SEQ ID NO: 8848 - RNA, 38 nt, Artificial Sequence
  Description of Artificial Sequence:  Enzymatic Nucleic Acid
ggauuggucugaugaggccguuaggccgaaaggaugac

SEQ ID NO: 8849 - RNA, 38 nt, Artificial Sequence
  Description of Artificial Sequence:  Enzymatic Nucleic Acid
gggauuggcugaugaggccguuaggccgaaaaggauga

SEQ ID NO: 8850 - RNA, 38 nt, Artificial Sequence
  Description of Artificial Sequence:  Enzymatic Nucleic Acid
ugaaauggcugaugaggccguuaggccgaaauugguaa

SEQ ID NO: 8851 - RNA, 38 nt, Artificial Sequence
  Description of Artificial Sequence:  Enzymatic Nucleic Acid
uccuuugacugaugaggccguuaggccgaaaugggauu

SEQ ID NO: 8852 - RNA, 38 nt, Artificial Sequence
  Description of Artificial Sequence:  Enzymatic Nucleic Acid
cuccuuugcugaugaggccguuaggccgaaaaugggau

SEQ ID NO: 8853 - RNA, 38 nt, Artificial Sequence
  Description of Artificial Sequence:  Enzymatic Nucleic Acid
ucuccuuucugaugaggccguuaggccgaaaaauggga

SEQ ID NO: 8854 - RNA, 38 nt, Artificial Sequence
  Description of Artificial Sequence:  Enzymatic Nucleic Acid
accagagacugaugaggccguuaggccgaaaccacaug

SEQ ID NO: 8855 - RNA, 38 nt, Artificial Sequence
  Description of Artificial Sequence:  Enzymatic Nucleic Acid
caaccagacugaugaggccguuaggccgaaagaccaca

SEQ ID NO: 8856 - RNA, 38 nt, Artificial Sequence
  Description of Artificial Sequence:  Enzymatic Nucleic Acid
cacaaccacugaugaggccguuaggccgaaagagacca

SEQ ID NO: 8857 - RNA, 38 nt, Artificial Sequence
  Description of Artificial Sequence:  Enzymatic Nucleic Acid
acauacaccugaugaggccguuaggccgaaaccagaga

SEQ ID NO: 8858 - RNA, 38 nt, Artificial Sequence
  Description of Artificial Sequence:  Enzymatic Nucleic Acid
gugggacacugaugaggccguuaggccgaaacacaacc

SEQ ID NO: 8859 - RNA, 38 nt, Artificial Sequence
  Description of Artificial Sequence:  Enzymatic Nucleic Acid
ugggguggcugaugaggccguuaggccgaaacauacac

SEQ ID NO: 8860 - RNA, 38 nt, Artificial Sequence
  Description of Artificial Sequence:  Enzymatic Nucleic Acid
uucucacccugaugaggccguuaggccgaaaucugggg

SEQ ID NO: 8861 - RNA, 38 nt, Artificial Sequence
  Description of Artificial Sequence:  Enzymatic Nucleic Acid
agauuagacugaugaggccguuaggccgaaauuucuca

SEQ ID NO: 8862 - RNA, 38 nt, Artificial Sequence
  Description of Artificial Sequence:  Enzymatic Nucleic Acid
agagauuacugaugaggccguuaggccgaaagauuucu

SEQ ID NO: 8863 - RNA, 38 nt, Artificial Sequence
  Description of Artificial Sequence:  Enzymatic Nucleic Acid
ggagagaucugaugaggccguuaggccgaaagagauuu

SEQ ID NO: 8864 - RNA, 38 nt, Artificial Sequence
  Description of Artificial Sequence:  Enzymatic Nucleic Acid
acaggagacugaugaggccguuaggccgaaauuagaga

SEQ ID NO: 8865 - RNA, 38 nt, Artificial Sequence
  Description of Artificial Sequence:  Enzymatic Nucleic Acid
ccacaggacugaugaggccguuaggccgaaagauuaga

SEQ ID NO: 8866 - RNA, 38 nt, Artificial Sequence
  Description of Artificial Sequence:  Enzymatic Nucleic Acid
auccacagcugaugaggccguuaggccgaaagagauua

SEQ ID NO: 8867 - RNA, 38 nt, Artificial Sequence
  Description of Artificial Sequence:  Enzymatic Nucleic Acid
cugguaggcugaugaggccguuaggccgaaauccacag

SEQ ID NO: 8868 - RNA, 38 nt, Artificial Sequence
  Description of Artificial Sequence:  Enzymatic Nucleic Acid
acugguagcugaugaggccguuaggccgaaaauccaca

SEQ ID NO: 8869 - RNA, 38 nt, Artificial Sequence
  Description of Artificial Sequence:  Enzymatic Nucleic Acid
cguacuggcugaugaggccguuaggccgaaaggaaucc

SEQ ID NO: 8870 - RNA, 38 nt, Artificial Sequence
  Description of Artificial Sequence:  Enzymatic Nucleic Acid
uggugccgcugaugaggccguuaggccgaaacugguag

SEQ ID NO: 8871 - RNA, 38 nt, Artificial Sequence
  Description of Artificial Sequence:  Enzymatic Nucleic Acid
cagcguuucugaugaggccguuaggccgaaaguggugc

SEQ ID NO: 8872 - RNA, 38 nt, Artificial Sequence
  Description of Artificial Sequence:  Enzymatic Nucleic Acid
auagaccgcugaugaggccguuaggccgaaacauguca

SEQ ID NO: 8873 - RNA, 38 nt, Artificial Sequence
  Description of Artificial Sequence:  Enzymatic Nucleic Acid
auggcauacugaugaggccguuaggccgaaaccguaca

SEQ ID NO: 8874 - RNA, 38 nt, Artificial Sequence
  Description of Artificial Sequence:  Enzymatic Nucleic Acid
gaauggcacugaugaggccguuaggccgaaagaccgua

SEQ ID NO: 8875 - RNA, 38 nt, Artificial Sequence
  Description of Artificial Sequence:  Enzymatic Nucleic Acid
gggggaggcugaugaggccguuaggccgaaauggcaua

SEQ ID NO: 8876 - RNA, 38 nt, Artificial Sequence
  Description of Artificial Sequence:  Enzymatic Nucleic Acid
cgggggagcugaugaggccguuaggccgaaaauggcau

SEQ ID NO: 8877 - RNA, 38 nt, Artificial Sequence
  Description of Artificial Sequence:  Enzymatic Nucleic Acid
augcggggcugaugaggccguuaggccgaaaggaaugg

SEQ ID NO: 8878 - RNA, 38 nt, Artificial Sequence
  Description of Artificial Sequence:  Enzymatic Nucleic Acid
guggaugucugaugaggccguuaggccgaaaugcgggg

SEQ ID NO: 8879 - RNA, 38 nt, Artificial Sequence
  Description of Artificial Sequence:  Enzymatic Nucleic Acid
uaccagugcugaugaggccguuaggccgaaaugugaug

SEQ ID NO: 8880 - RNA, 38 nt, Artificial Sequence
  Description of Artificial Sequence:  Enzymatic Nucleic Acid
acugccaacugaugaggccguuaggccgaaaccagugg

SEQ ID NO: 8881 - RNA, 38 nt, Artificial Sequence
  Description of Artificial Sequence:  Enzymatic Nucleic Acid
caacugcccugaugaggccguuaggccgaaauaccagu

SEQ ID NO: 8882 - RNA, 38 nt, Artificial Sequence
  Description of Artificial Sequence:  Enzymatic Nucleic Acid
cuuccucccugaugaggccguuaggccgaaacugccaa

SEQ ID NO: 8883 - RNA, 38 nt, Artificial Sequence
  Description of Artificial Sequence:  Enzymatic Nucleic Acid
gucacugacugaugaggccguuaggccgaaacagcuug

SEQ ID NO: 8884 - RNA, 38 nt, Artificial Sequence
  Description of Artificial Sequence:  Enzymatic Nucleic Acid
uugucacucugaugaggccguuaggccgaaagacagcu

SEQ ID NO: 8885 - RNA, 38 nt, Artificial Sequence
  Description of Artificial Sequence:  Enzymatic Nucleic Acid
cacaagggcugaugaggccguuaggccgaaauggguuu

SEQ ID NO: 8886 - RNA, 38 nt, Artificial Sequence
  Description of Artificial Sequence:  Enzymatic Nucleic Acid
uucuucaccugaugaggccguuaggccgaaaggguaug

SEQ ID NO: 8887 - RNA, 38 nt, Artificial Sequence
  Description of Artificial Sequence:  Enzymatic Nucleic Acid
cucccuggcugaugaggccguuaggccgaaaguccucc

SEQ ID NO: 8888 - RNA, 38 nt, Artificial Sequence
  Description of Artificial Sequence:  Enzymatic Nucleic Acid
ccucccugcugaugaggccguuaggccgaaaaguccuc

SEQ ID NO: 8889 - RNA, 38 nt, Artificial Sequence
  Description of Artificial Sequence:  Enzymatic Nucleic Acid
uucaauuucugaugaggccguuaggccgaaauuuccuc

SEQ ID NO: 8890 - RNA, 38 nt, Artificial Sequence
  Description of Artificial Sequence:  Enzymatic Nucleic Acid
uuaacuuccugaugaggccguuaggccgaaauuuuauu

SEQ ID NO: 8891 - RNA, 38 nt, Artificial Sequence
  Description of Artificial Sequence:  Enzymatic Nucleic Acid
uuuuuauucugaugaggccguuaggccgaaacuucaau

SEQ ID NO: 8892 - RNA, 38 nt, Artificial Sequence
  Description of Artificial Sequence:  Enzymatic Nucleic Acid
auuuuuaucugaugaggccguuaggccgaaaacuucaa

SEQ ID NO: 8893 - RNA, 38 nt, Artificial Sequence
  Description of Artificial Sequence:  Enzymatic Nucleic Acid
uugauuuucugaugaggccguuaggccgaaauuaacuu

SEQ ID NO: 8894 - RNA, 38 nt, Artificial Sequence
  Description of Artificial Sequence:  Enzymatic Nucleic Acid
agcaaauucugaugaggccguuaggccgaaauuuuuau

SEQ ID NO: 8895 - RNA, 38 nt, Artificial Sequence
  Description of Artificial Sequence:  Enzymatic Nucleic Acid
uuagagcacugaugaggccguuaggccgaaauugauuu

SEQ ID NO: 8896 - RNA, 38 nt, Artificial Sequence
  Description of Artificial Sequence:  Enzymatic Nucleic Acid
auuagagccugaugaggccguuaggccgaaaauugauu

SEQ ID NO: 8897 - RNA, 38 nt, Artificial Sequence
  Description of Artificial Sequence:  Enzymatic Nucleic Acid
uucaauuacugaugaggccguuaggccgaaagcaaauu

SEQ ID NO: 8898 - RNA, 38 nt, Artificial Sequence
  Description of Artificial Sequence:  Enzymatic Nucleic Acid
ccuucaaucugaugaggccguuaggccgaaagagcaaa

SEQ ID NO: 8899 - RNA, 38 nt, Artificial Sequence
  Description of Artificial Sequence:  Enzymatic Nucleic Acid
uuuccuuccugaugaggccguuaggccgaaauuagagc

SEQ ID NO: 8900 - RNA, 38 nt, Artificial Sequence
  Description of Artificial Sequence:  Enzymatic Nucleic Acid
aggguacucugaugaggccguuaggccgaaacaguuuu

SEQ ID NO: 8901 - RNA, 38 nt, Artificial Sequence
  Description of Artificial Sequence:  Enzymatic Nucleic Acid
aacaagggcugaugaggccguuaggccgaaacuuacag

SEQ ID NO: 8902 - RNA, 38 nt, Artificial Sequence
  Description of Artificial Sequence:  Enzymatic Nucleic Acid
uggauaaccugaugaggccguuaggccgaaaggguacu

SEQ ID NO: 8903 - RNA, 38 nt, Artificial Sequence
  Description of Artificial Sequence:  Enzymatic Nucleic Acid
gcuuggaucugaugaggccguuaggccgaaacaagggu

SEQ ID NO: 8904 - RNA, 38 nt, Artificial Sequence
  Description of Artificial Sequence:  Enzymatic Nucleic Acid
cgcuuggacugaugaggccguuaggccgaaaacaaggg

SEQ ID NO: 8905 - RNA, 38 nt, Artificial Sequence
  Description of Artificial Sequence:  Enzymatic Nucleic Acid
gccgcuugcugaugaggccguuaggccgaaauaacaag

SEQ ID NO: 8906 - RNA, 38 nt, Artificial Sequence
  Description of Artificial Sequence:  Enzymatic Nucleic Acid
acaaagcucugaugaggccguuaggccgaaacacauuu

SEQ ID NO: 8907 - RNA, 38 nt, Artificial Sequence
  Description of Artificial Sequence:  Enzymatic Nucleic Acid
uuuguacacugaugaggccguuaggccgaaagcugaca

SEQ ID NO: 8908 - RNA, 38 nt, Artificial Sequence
  Description of Artificial Sequence:  Enzymatic Nucleic Acid
auuuguaccugaugaggccguuaggccgaaaagcugac

SEQ ID NO: 8909 - RNA, 38 nt, Artificial Sequence
  Description of Artificial Sequence:  Enzymatic Nucleic Acid
cacauuugcugaugaggccguuaggccgaaacaaagcu

SEQ ID NO: 8910 - RNA, 38 nt, Artificial Sequence
  Description of Artificial Sequence:  Enzymatic Nucleic Acid
acuuuguucugaugaggccguuaggccgaaaccgcuuc

SEQ ID NO: 8911 - RNA, 38 nt, Artificial Sequence
  Description of Artificial Sequence:  Enzymatic Nucleic Acid
ccucuccccugaugaggccguuaggccgaaacuuuguu

SEQ ID NO: 8912 - RNA, 38 nt, Artificial Sequence
  Description of Artificial Sequence:  Enzymatic Nucleic Acid
uggaaggacugaugaggccguuaggccgaaaucacccu

SEQ ID NO: 8913 - RNA, 38 nt, Artificial Sequence
  Description of Artificial Sequence:  Enzymatic Nucleic Acid
cguggaagcugaugaggccguuaggccgaaagaucacc

SEQ ID NO: 8914 - RNA, 38 nt, Artificial Sequence
  Description of Artificial Sequence:  Enzymatic Nucleic Acid
ucacguggcugaugaggccguuaggccgaaaggagauc

SEQ ID NO: 8915 - RNA, 38 nt, Artificial Sequence
  Description of Artificial Sequence:  Enzymatic Nucleic Acid
gucacgugcugaugaggccguuaggccgaaaaggagau

SEQ ID NO: 8916 - RNA, 38 nt, Artificial Sequence
  Description of Artificial Sequence:  Enzymatic Nucleic Acid
aauuucagcugaugaggccguuaggccgaaaccccugg

SEQ ID NO: 8917 - RNA, 38 nt, Artificial Sequence
  Description of Artificial Sequence:  Enzymatic Nucleic Acid
ugcaaagucugaugaggccguuaggccgaaauuucagg

SEQ ID NO: 8918 - RNA, 38 nt, Artificial Sequence
  Description of Artificial Sequence:  Enzymatic Nucleic Acid
uugcaaagcugaugaggccguuaggccgaaaauuucag

SEQ ID NO: 8919 - RNA, 38 nt, Artificial Sequence
  Description of Artificial Sequence:  Enzymatic Nucleic Acid
agguugcacugaugaggccguuaggccgaaaguaauuu

SEQ ID NO: 8920 - RNA, 38 nt, Artificial Sequence
  Description of Artificial Sequence:  Enzymatic Nucleic Acid
cagguugccugaugaggccguuaggccgaaaaguaauu

SEQ ID NO: 8921 - RNA, 38 nt, Artificial Sequence
  Description of Artificial Sequence:  Enzymatic Nucleic Acid
accacaaacugaugaggccguuaggccgaaacacgcuc

SEQ ID NO: 8922 - RNA, 38 nt, Artificial Sequence
  Description of Artificial Sequence:  Enzymatic Nucleic Acid
gcaccacacugaugaggccguuaggccgaaagacacgc

SEQ ID NO: 8923 - RNA, 38 nt, Artificial Sequence
  Description of Artificial Sequence:  Enzymatic Nucleic Acid
ugcaccaccugaugaggccguuaggccgaaaagacacg

SEQ ID NO: 8924 - RNA, 38 nt, Artificial Sequence
  Description of Artificial Sequence:  Enzymatic Nucleic Acid
caaacguacugaugaggccguuaggccgaaaucugucu

SEQ ID NO: 8925 - RNA, 38 nt, Artificial Sequence
  Description of Artificial Sequence:  Enzymatic Nucleic Acid
cucaaacgcugaugaggccguuaggccgaaagaucugu

SEQ ID NO: 8926 - RNA, 38 nt, Artificial Sequence
  Description of Artificial Sequence:  Enzymatic Nucleic Acid
gguucucacugaugaggccguuaggccgaaacguagau

SEQ ID NO: 8927 - RNA, 38 nt, Artificial Sequence
  Description of Artificial Sequence:  Enzymatic Nucleic Acid
agguucuccugaugaggccguuaggccgaaaacguaga

SEQ ID NO: 8928 - RNA, 38 nt, Artificial Sequence
  Description of Artificial Sequence:  Enzymatic Nucleic Acid
uaccaugucugaugaggccguuaggccgaaagguucuc

SEQ ID NO: 8929 - RNA, 38 nt, Artificial Sequence
  Description of Artificial Sequence:  Enzymatic Nucleic Acid
caagcuugcugaugaggccguuaggccgaaaccaugug

SEQ ID NO: 8930 - RNA, 38 nt, Artificial Sequence
  Description of Artificial Sequence:  Enzymatic Nucleic Acid
ugugggcccugaugaggccguuaggccgaaagcuugua

SEQ ID NO: 8931 - RNA, 38 nt, Artificial Sequence
  Description of Artificial Sequence:  Enzymatic Nucleic Acid
gauuggcacugaugaggccguuaggccgaaaggcugug

SEQ ID NO: 8932 - RNA, 38 nt, Artificial Sequence
  Description of Artificial Sequence:  Enzymatic Nucleic Acid
cccacaugcugaugaggccguuaggccgaaauuggcag

SEQ ID NO: 8933 - RNA, 38 nt, Artificial Sequence
  Description of Artificial Sequence:  Enzymatic Nucleic Acid
gugugggccugaugaggccguuaggccgaaacucuccc

SEQ ID NO: 8934 - RNA, 38 nt, Artificial Sequence
  Description of Artificial Sequence:  Enzymatic Nucleic Acid
uucuugcacugaugaggccguuaggccgaaacaggugu

SEQ ID NO: 8935 - RNA, 38 nt, Artificial Sequence
  Description of Artificial Sequence:  Enzymatic Nucleic Acid
guucuugccugaugaggccguuaggccgaaaacaggug

SEQ ID NO: 8936 - RNA, 38 nt, Artificial Sequence
  Description of Artificial Sequence:  Enzymatic Nucleic Acid
gaguaucccugaugaggccguuaggccgaaaguucuug

SEQ ID NO: 8937 - RNA, 38 nt, Artificial Sequence
  Description of Artificial Sequence:  Enzymatic Nucleic Acid
ccaaagagcugaugaggccguuaggccgaaauccaagu

SEQ ID NO: 8938 - RNA, 38 nt, Artificial Sequence
  Description of Artificial Sequence:  Enzymatic Nucleic Acid
uuuccaaacugaugaggccguuaggccgaaaguaucca

SEQ ID NO: 8939 - RNA, 38 nt, Artificial Sequence
  Description of Artificial Sequence:  Enzymatic Nucleic Acid
aauuuccacugaugaggccguuaggccgaaagaguauc

SEQ ID NO: 8940 - RNA, 38 nt, Artificial Sequence
  Description of Artificial Sequence:  Enzymatic Nucleic Acid
caauuucccugaugaggccguuaggccgaaaagaguau

SEQ ID NO: 8941 - RNA, 38 nt, Artificial Sequence
  Description of Artificial Sequence:  Enzymatic Nucleic Acid
uggcauuccugaugaggccguuaggccgaaauuuccaa

SEQ ID NO: 8942 - RNA, 38 nt, Artificial Sequence
  Description of Artificial Sequence:  Enzymatic Nucleic Acid
uauuagagcugaugaggccguuaggccgaaacauggug

SEQ ID NO: 8943 - RNA, 38 nt, Artificial Sequence
  Description of Artificial Sequence:  Enzymatic Nucleic Acid
cuauuagacugaugaggccguuaggccgaaaacauggu

SEQ ID NO: 8944 - RNA, 38 nt, Artificial Sequence
  Description of Artificial Sequence:  Enzymatic Nucleic Acid
ugcuauuacugaugaggccguuaggccgaaagaacaug

SEQ ID NO: 8945 - RNA, 38 nt, Artificial Sequence
  Description of Artificial Sequence:  Enzymatic Nucleic Acid
ugugcuaucugaugaggccguuaggccgaaagagaaca

SEQ ID NO: 8946 - RNA, 38 nt, Artificial Sequence
  Description of Artificial Sequence:  Enzymatic Nucleic Acid
auuugugccugaugaggccguuaggccgaaauuagaga

SEQ ID NO: 8947 - RNA, 38 nt, Artificial Sequence
  Description of Artificial Sequence:  Enzymatic Nucleic Acid
augaucaacugaugaggccguuaggccgaaaugucauu

SEQ ID NO: 8948 - RNA, 38 nt, Artificial Sequence
  Description of Artificial Sequence:  Enzymatic Nucleic Acid
caugaucacugaugaggccguuaggccgaaaaugucau

SEQ ID NO: 8949 - RNA, 38 nt, Artificial Sequence
  Description of Artificial Sequence:  Enzymatic Nucleic Acid
ccaugauccugaugaggccguuaggccgaaaaauguca

SEQ ID NO: 8950 - RNA, 38 nt, Artificial Sequence
  Description of Artificial Sequence:  Enzymatic Nucleic Acid
agcuccaucugaugaggccguuaggccgaaaucaaaau

SEQ ID NO: 8951 - RNA, 38 nt, Artificial Sequence
  Description of Artificial Sequence:  Enzymatic Nucleic Acid
gcauucuucugaugaggccguuaggccgaaagcuccau

SEQ ID NO: 8952 - RNA, 38 nt, Artificial Sequence
  Description of Artificial Sequence:  Enzymatic Nucleic Acid
ugcauucucugaugaggccguuaggccgaaaagcucca

SEQ ID NO: 8953 - RNA, 38 nt, Artificial Sequence
  Description of Artificial Sequence:  Enzymatic Nucleic Acid
ccugcaagcugaugaggccguuaggccgaaaugcauuc

SEQ ID NO: 8954 - RNA, 38 nt, Artificial Sequence
  Description of Artificial Sequence:  Enzymatic Nucleic Acid
gguccugccugaugaggccguuaggccgaaaggaugca

SEQ ID NO: 8955 - RNA, 38 nt, Artificial Sequence
  Description of Artificial Sequence:  Enzymatic Nucleic Acid
ggcagacacugaugaggccguuaggccgaaagucuccu

SEQ ID NO: 8956 - RNA, 38 nt, Artificial Sequence
  Description of Artificial Sequence:  Enzymatic Nucleic Acid
gcaaggcacugaugaggccguuaggccgaaacauaguc

SEQ ID NO: 8957 - RNA, 38 nt, Artificial Sequence
  Description of Artificial Sequence:  Enzymatic Nucleic Acid
ucuugagccugaugaggccguuaggccgaaaggcagac

SEQ ID NO: 8958 - RNA, 38 nt, Artificial Sequence
  Description of Artificial Sequence:  Enzymatic Nucleic Acid
ccugucuucugaugaggccguuaggccgaaagcaaggc

SEQ ID NO: 8959 - RNA, 38 nt, Artificial Sequence
  Description of Artificial Sequence:  Enzymatic Nucleic Acid
gaccacgccugaugaggccguuaggccgaaaugucuuu

SEQ ID NO: 8960 - RNA, 38 nt, Artificial Sequence
  Description of Artificial Sequence:  Enzymatic Nucleic Acid
agcugccucugaugaggccguuaggccgaaaccacgca

SEQ ID NO: 8961 - RNA, 38 nt, Artificial Sequence
  Description of Artificial Sequence:  Enzymatic Nucleic Acid
aggacugucugaugaggccguuaggccgaaagcugccu

SEQ ID NO: 8962 - RNA, 38 nt, Artificial Sequence
  Description of Artificial Sequence:  Enzymatic Nucleic Acid
cgcucuagcugaugaggccguuaggccgaaacugugag

SEQ ID NO: 8963 - RNA, 38 nt, Artificial Sequence
  Description of Artificial Sequence:  Enzymatic Nucleic Acid
acacgcuccugaugaggccguuaggccgaaaggacugu

SEQ ID NO: 8964 - RNA, 38 nt, Artificial Sequence
  Description of Artificial Sequence:  Enzymatic Nucleic Acid
uuuccugucugaugaggccguuaggccgaaaucguggg

SEQ ID NO: 8965 - RNA, 38 nt, Artificial Sequence
  Description of Artificial Sequence:  Enzymatic Nucleic Acid
ugucgucucugaugaggccguuaggccgaaauucucca

SEQ ID NO: 8966 - RNA, 38 nt, Artificial Sequence
  Description of Artificial Sequence:  Enzymatic Nucleic Acid
uuccccaacugaugaggccguuaggccgaaacuugucg

SEQ ID NO: 8967 - RNA, 38 nt, Artificial Sequence
  Description of Artificial Sequence:  Enzymatic Nucleic Acid
cuuucccccugaugaggccguuaggccgaaauacuugu

SEQ ID NO: 8968 - RNA, 38 nt, Artificial Sequence
  Description of Artificial Sequence:  Enzymatic Nucleic Acid
gagacuuccugaugaggccguuaggccgaaaugcuuuc

SEQ ID NO: 8969 - RNA, 38 nt, Artificial Sequence
  Description of Artificial Sequence:  Enzymatic Nucleic Acid
gugcaugacugaugaggccguuaggccgaaacuucgau

SEQ ID NO: 8970 - RNA, 38 nt, Artificial Sequence
  Description of Artificial Sequence:  Enzymatic Nucleic Acid
ccgugcaucugaugaggccguuaggccgaaagacuucg

SEQ ID NO: 8971 - RNA, 38 nt, Artificial Sequence
  Description of Artificial Sequence:  Enzymatic Nucleic Acid
gauucccacugaugaggccguuaggccgaaaugccgug

SEQ ID NO: 8972 - RNA, 38 nt, Artificial Sequence
  Description of Artificial Sequence:  Enzymatic Nucleic Acid
uggaggggcugaugaggccguuaggccgaaauucccag

SEQ ID NO: 8973 - RNA, 38 nt, Artificial Sequence
  Description of Artificial Sequence:  Enzymatic Nucleic Acid
gaucugugcugaugaggccguuaggccgaaagggggau

SEQ ID NO: 8974 - RNA, 38 nt, Artificial Sequence
  Description of Artificial Sequence:  Enzymatic Nucleic Acid
aaccacaucugaugaggccguuaggccgaaaucugugg

SEQ ID NO: 8975 - RNA, 38 nt, Artificial Sequence
  Description of Artificial Sequence:  Enzymatic Nucleic Acid
uaucuuuacugaugaggccguuaggccgaaaccacaug

SEQ ID NO: 8976 - RNA, 38 nt, Artificial Sequence
  Description of Artificial Sequence:  Enzymatic Nucleic Acid
uuaucuuucugaugaggccguuaggccgaaaaccacau

SEQ ID NO: 8977 - RNA, 38 nt, Artificial Sequence
  Description of Artificial Sequence:  Enzymatic Nucleic Acid
auuaucuucugaugaggccguuaggccgaaaaaccaca

SEQ ID NO: 8978 - RNA, 38 nt, Artificial Sequence
  Description of Artificial Sequence:  Enzymatic Nucleic Acid
ggucucaucugaugaggccguuaggccgaaaucuuuaa

SEQ ID NO: 8979 - RNA, 38 nt, Artificial Sequence
  Description of Artificial Sequence:  Enzymatic Nucleic Acid
ucuucuaccugaugaggccguuaggccgaaagggucuc

SEQ ID NO: 8980 - RNA, 38 nt, Artificial Sequence
  Description of Artificial Sequence:  Enzymatic Nucleic Acid
gagucuuccugaugaggccguuaggccgaaacaagggu

SEQ ID NO: 8981 - RNA, 38 nt, Artificial Sequence
  Description of Artificial Sequence:  Enzymatic Nucleic Acid
caaugccucugaugaggccguuaggccgaaagucuucu

SEQ ID NO: 8982 - RNA, 38 nt, Artificial Sequence
  Description of Artificial Sequence:  Enzymatic Nucleic Acid
uucaauaccugaugaggccguuaggccgaaaugccuga

SEQ ID NO: 8983 - RNA, 38 nt, Artificial Sequence
  Description of Artificial Sequence:  Enzymatic Nucleic Acid
uccuucaacugaugaggccguuaggccgaaacaaugcc

SEQ ID NO: 8984 - RNA, 38 nt, Artificial Sequence
  Description of Artificial Sequence:  Enzymatic Nucleic Acid
cauccuuccugaugaggccguuaggccgaaauacaaug

SEQ ID NO: 8985 - RNA, 38 nt, Artificial Sequence
  Description of Artificial Sequence:  Enzymatic Nucleic Acid
cggauagucugaugaggccguuaggccgaaagguuccg

SEQ ID NO: 8986 - RNA, 38 nt, Artificial Sequence
  Description of Artificial Sequence:  Enzymatic Nucleic Acid
ucugcggacugaugaggccguuaggccgaaagugaggu

SEQ ID NO: 8987 - RNA, 38 nt, Artificial Sequence
  Description of Artificial Sequence:  Enzymatic Nucleic Acid
acucugcgcugaugaggccguuaggccgaaauagugag

SEQ ID NO: 8988 - RNA, 38 nt, Artificial Sequence
  Description of Artificial Sequence:  Enzymatic Nucleic Acid
cagguguacugaugaggccguuaggccgaaaggccuuc

SEQ ID NO: 8989 - RNA, 38 nt, Artificial Sequence
  Description of Artificial Sequence:  Enzymatic Nucleic Acid
ggcaggugcugaugaggccguuaggccgaaagaggccu

SEQ ID NO: 8990 - RNA, 38 nt, Artificial Sequence
  Description of Artificial Sequence:  Enzymatic Nucleic Acid
cagccaagcugaugaggccguuaggccgaaacacugca

SEQ ID NO: 8991 - RNA, 38 nt, Artificial Sequence
  Description of Artificial Sequence:  Enzymatic Nucleic Acid
acagccaacugaugaggccguuaggccgaaaacacugc

SEQ ID NO: 8992 - RNA, 38 nt, Artificial Sequence
  Description of Artificial Sequence:  Enzymatic Nucleic Acid
gcacagcccugaugaggccguuaggccgaaagaacacu

SEQ ID NO: 8993 - RNA, 38 nt, Artificial Sequence
  Description of Artificial Sequence:  Enzymatic Nucleic Acid
uuaugaaacugaugaggccguuaggccgaaaugccucc

SEQ ID NO: 8994 - RNA, 38 nt, Artificial Sequence
  Description of Artificial Sequence:  Enzymatic Nucleic Acid
auuaugaacugaugaggccguuaggccgaaaaugccuc

SEQ ID NO: 8995 - RNA, 38 nt, Artificial Sequence
  Description of Artificial Sequence:  Enzymatic Nucleic Acid
uauuaugacugaugaggccguuaggccgaaaaaugccu

SEQ ID NO: 8996 - RNA, 38 nt, Artificial Sequence
  Description of Artificial Sequence:  Enzymatic Nucleic Acid
cuauuaugcugaugaggccguuaggccgaaaaaaugcc

SEQ ID NO: 8997 - RNA, 38 nt, Artificial Sequence
  Description of Artificial Sequence:  Enzymatic Nucleic Acid
ucuauuaucugaugaggccguuaggccgaaaaaaaugc

SEQ ID NO: 8998 - RNA, 38 nt, Artificial Sequence
  Description of Artificial Sequence:  Enzymatic Nucleic Acid
ccuucuaucugaugaggccguuaggccgaaaugaaaaa

SEQ ID NO: 8999 - RNA, 38 nt, Artificial Sequence
  Description of Artificial Sequence:  Enzymatic Nucleic Acid
gcaccuuccugaugaggccguuaggccgaaauuaugaa

SEQ ID NO: 9000 - RNA, 38 nt, Artificial Sequence
  Description of Artificial Sequence:  Enzymatic Nucleic Acid
ugauuucccugaugaggccguuaggccgaaaguucguc

SEQ ID NO: 9001 - RNA, 38 nt, Artificial Sequence
  Description of Artificial Sequence:  Enzymatic Nucleic Acid
agaauaaucugaugaggccguuaggccgaaauuuccaa

SEQ ID NO: 9002 - RNA, 38 nt, Artificial Sequence
  Description of Artificial Sequence:  Enzymatic Nucleic Acid
acuagaaucugaugaggccguuaggccgaaaugauuuc

SEQ ID NO: 9003 - RNA, 38 nt, Artificial Sequence
  Description of Artificial Sequence:  Enzymatic Nucleic Acid
uacuagaacugaugaggccguuaggccgaaaaugauuu

SEQ ID NO: 9004 - RNA, 38 nt, Artificial Sequence
  Description of Artificial Sequence:  Enzymatic Nucleic Acid
ccuacuagcugaugaggccguuaggccgaaauaaugau

SEQ ID NO: 9005 - RNA, 38 nt, Artificial Sequence
  Description of Artificial Sequence:  Enzymatic Nucleic Acid
gccuacuacugaugaggccguuaggccgaaaauaauga

SEQ ID NO: 9006 - RNA, 38 nt, Artificial Sequence
  Description of Artificial Sequence:  Enzymatic Nucleic Acid
gugccuaccugaugaggccguuaggccgaaagaauaau

SEQ ID NO: 9007 - RNA, 38 nt, Artificial Sequence
  Description of Artificial Sequence:  Enzymatic Nucleic Acid
gucgugcccugaugaggccguuaggccgaaacuagaau

SEQ ID NO: 9008 - RNA, 38 nt, Artificial Sequence
  Description of Artificial Sequence:  Enzymatic Nucleic Acid
aacauggccugaugaggccguuaggccgaaaucaccgu

SEQ ID NO: 9009 - RNA, 38 nt, Artificial Sequence
  Description of Artificial Sequence:  Enzymatic Nucleic Acid
gccagaagcugaugaggccguuaggccgaaacauggca

SEQ ID NO: 9010 - RNA, 38 nt, Artificial Sequence
  Description of Artificial Sequence:  Enzymatic Nucleic Acid
agccagaacugaugaggccguuaggccgaaaacauggc

SEQ ID NO: 9011 - RNA, 38 nt, Artificial Sequence
  Description of Artificial Sequence:  Enzymatic Nucleic Acid
guagccagcugaugaggccguuaggccgaaagaacaug

SEQ ID NO: 9012 - RNA, 38 nt, Artificial Sequence
  Description of Artificial Sequence:  Enzymatic Nucleic Acid
aguagccacugaugaggccguuaggccgaaaagaacau

SEQ ID NO: 9013 - RNA, 38 nt, Artificial Sequence
  Description of Artificial Sequence:  Enzymatic Nucleic Acid
acaagaagcugaugaggccguuaggccgaaagccagaa

SEQ ID NO: 9014 - RNA, 38 nt, Artificial Sequence
  Description of Artificial Sequence:  Enzymatic Nucleic Acid
augacaagcugaugaggccguuaggccgaaaguagcca

SEQ ID NO: 9015 - RNA, 38 nt, Artificial Sequence
  Description of Artificial Sequence:  Enzymatic Nucleic Acid
gaugacaacugaugaggccguuaggccgaaaaguagcc

SEQ ID NO: 9016 - RNA, 38 nt, Artificial Sequence
  Description of Artificial Sequence:  Enzymatic Nucleic Acid
augaugaccugaugaggccguuaggccgaaagaaguag

SEQ ID NO: 9017 - RNA, 38 nt, Artificial Sequence
  Description of Artificial Sequence:  Enzymatic Nucleic Acid
aggaugaucugaugaggccguuaggccgaaacaagaag

SEQ ID NO: 9018 - RNA, 38 nt, Artificial Sequence
  Description of Artificial Sequence:  Enzymatic Nucleic Acid
ccuaggaucugaugaggccguuaggccgaaaugacaag

SEQ ID NO: 9019 - RNA, 38 nt, Artificial Sequence
  Description of Artificial Sequence:  Enzymatic Nucleic Acid
gucccuagcugaugaggccguuaggccgaaaugaugac

SEQ ID NO: 9020 - RNA, 38 nt, Artificial Sequence
  Description of Artificial Sequence:  Enzymatic Nucleic Acid
acgguccccugaugaggccguuaggccgaaaggaugau

SEQ ID NO: 9021 - RNA, 38 nt, Artificial Sequence
  Description of Artificial Sequence:  Enzymatic Nucleic Acid
gcccgcuucugaugaggccguuaggccgaaacgguccc

SEQ ID NO: 9022 - RNA, 38 nt, Artificial Sequence
  Description of Artificial Sequence:  Enzymatic Nucleic Acid
ggcccgcucugaugaggccguuaggccgaaaacggucc

SEQ ID NO: 9023 - RNA, 38 nt, Artificial Sequence
  Description of Artificial Sequence:  Enzymatic Nucleic Acid
uggacaagcugaugaggccguuaggccgaaagccuguc

SEQ ID NO: 9024 - RNA, 38 nt, Artificial Sequence
  Description of Artificial Sequence:  Enzymatic Nucleic Acid
cgauggaccugaugaggccguuaggccgaaaguagccu

SEQ ID NO: 9025 - RNA, 38 nt, Artificial Sequence
  Description of Artificial Sequence:  Enzymatic Nucleic Acid
ugacgaugcugaugaggccguuaggccgaaacaaguag

SEQ ID NO: 9026 - RNA, 38 nt, Artificial Sequence
  Description of Artificial Sequence:  Enzymatic Nucleic Acid
uccaugaccugaugaggccguuaggccgaaauggacaa

SEQ ID NO: 9027 - RNA, 38 nt, Artificial Sequence
  Description of Artificial Sequence:  Enzymatic Nucleic Acid
ggauccaucugaugaggccguuaggccgaaacgaugga

SEQ ID NO: 9028 - RNA, 38 nt, Artificial Sequence
  Description of Artificial Sequence:  Enzymatic Nucleic Acid
uucaucugcugaugaggccguuaggccgaaauccauga

SEQ ID NO: 9029 - RNA, 38 nt, Artificial Sequence
  Description of Artificial Sequence:  Enzymatic Nucleic Acid
uccaauggcugaugaggccguuaggccgaaaguucauc

SEQ ID NO: 9030 - RNA, 38 nt, Artificial Sequence
  Description of Artificial Sequence:  Enzymatic Nucleic Acid
guucaucccugaugaggccguuaggccgaaaugggagu

SEQ ID NO: 9031 - RNA, 38 nt, Artificial Sequence
  Description of Artificial Sequence:  Enzymatic Nucleic Acid
ucguucaccugaugaggccguuaggccgaaauguucau

SEQ ID NO: 9032 - RNA, 38 nt, Artificial Sequence
  Description of Artificial Sequence:  Enzymatic Nucleic Acid
ggcaucaucugaugaggccguuaggccgaaaggcaguc

SEQ ID NO: 9033 - RNA, 38 nt, Artificial Sequence
  Description of Artificial Sequence:  Enzymatic Nucleic Acid
uggcaucacugaugaggccguuaggccgaaaaggcagu

SEQ ID NO: 9034 - RNA, 38 nt, Artificial Sequence
  Description of Artificial Sequence:  Enzymatic Nucleic Acid
cucuggggcugaugaggccguuaggccgaaauucccau

SEQ ID NO: 9035 - RNA, 38 nt, Artificial Sequence
  Description of Artificial Sequence:  Enzymatic Nucleic Acid
ucucugggcugaugaggccguuaggccgaaaauuccca

SEQ ID NO: 9036 - RNA, 38 nt, Artificial Sequence
  Description of Artificial Sequence:  Enzymatic Nucleic Acid
ggcuuacccugaugaggccguuaggccgaaagguucag

SEQ ID NO: 9037 - RNA, 38 nt, Artificial Sequence
  Description of Artificial Sequence:  Enzymatic Nucleic Acid
aagaggcucugaugaggccguuaggccgaaaccuaggu

SEQ ID NO: 9038 - RNA, 38 nt, Artificial Sequence
  Description of Artificial Sequence:  Enzymatic Nucleic Acid
acggccaacugaugaggccguuaggccgaaaggcuuac

SEQ ID NO: 9039 - RNA, 38 nt, Artificial Sequence
  Description of Artificial Sequence:  Enzymatic Nucleic Acid
ccacggcccugaugaggccguuaggccgaaagaggcuu

SEQ ID NO: 9040 - RNA, 38 nt, Artificial Sequence
  Description of Artificial Sequence:  Enzymatic Nucleic Acid
cuuggccacugaugaggccguuaggccgaaaggcacca

SEQ ID NO: 9041 - RNA, 38 nt, Artificial Sequence
  Description of Artificial Sequence:  Enzymatic Nucleic Acid
ucuuggcccugaugaggccguuaggccgaaaaggcacc

SEQ ID NO: 9042 - RNA, 38 nt, Artificial Sequence
  Description of Artificial Sequence:  Enzymatic Nucleic Acid
ucugcuuccugaugaggccguuaggccgaaaucucuug

SEQ ID NO: 9043 - RNA, 38 nt, Artificial Sequence
  Description of Artificial Sequence:  Enzymatic Nucleic Acid
caauuccacugaugaggccguuaggccgaaaggcaucu

SEQ ID NO: 9044 - RNA, 38 nt, Artificial Sequence
  Description of Artificial Sequence:  Enzymatic Nucleic Acid
ucaauucccugaugaggccguuaggccgaaaaggcauc

SEQ ID NO: 9045 - RNA, 38 nt, Artificial Sequence
  Description of Artificial Sequence:  Enzymatic Nucleic Acid
gucuuguccugaugaggccguuaggccgaaauuccaaa

SEQ ID NO: 9046 - RNA, 38 nt, Artificial Sequence
  Description of Artificial Sequence:  Enzymatic Nucleic Acid
uguccugccugaugaggccguuaggccgaaaguugcug

SEQ ID NO: 9047 - RNA, 38 nt, Artificial Sequence
  Description of Artificial Sequence:  Enzymatic Nucleic Acid
uugacugccugaugaggccguuaggccgaaacuguccu

SEQ ID NO: 9048 - RNA, 38 nt, Artificial Sequence
  Description of Artificial Sequence:  Enzymatic Nucleic Acid
aacauuuucugaugaggccguuaggccgaaacugcuac

SEQ ID NO: 9049 - RNA, 38 nt, Artificial Sequence
  Description of Artificial Sequence:  Enzymatic Nucleic Acid
cuucuuuccugaugaggccguuaggccgaaacauuuug

SEQ ID NO: 9050 - RNA, 38 nt, Artificial Sequence
  Description of Artificial Sequence:  Enzymatic Nucleic Acid
gagagcuccugaugaggccguuaggccgaaaugcucac

SEQ ID NO: 9051 - RNA, 38 nt, Artificial Sequence
  Description of Artificial Sequence:  Enzymatic Nucleic Acid
agacaugacugaugaggccguuaggccgaaagcucgau

SEQ ID NO: 9052 - RNA, 38 nt, Artificial Sequence
  Description of Artificial Sequence:  Enzymatic Nucleic Acid
ucagacaucugaugaggccguuaggccgaaagagcucg

SEQ ID NO: 9053 - RNA, 38 nt, Artificial Sequence
  Description of Artificial Sequence:  Enzymatic Nucleic Acid
ugaguucacugaugaggccguuaggccgaaacaugaga

SEQ ID NO: 9054 - RNA, 38 nt, Artificial Sequence
  Description of Artificial Sequence:  Enzymatic Nucleic Acid
aggaucuucugaugaggccguuaggccgaaaguucaga

SEQ ID NO: 9055 - RNA, 38 nt, Artificial Sequence
  Description of Artificial Sequence:  Enzymatic Nucleic Acid
ugaaugagcugaugaggccguuaggccgaaaucuugag

SEQ ID NO: 9056 - RNA, 38 nt, Artificial Sequence
  Description of Artificial Sequence:  Enzymatic Nucleic Acid
auaugaaucugaugaggccguuaggccgaaaggaucuu

SEQ ID NO: 9057 - RNA, 38 nt, Artificial Sequence
  Description of Artificial Sequence:  Enzymatic Nucleic Acid
ccaauaugcugaugaggccguuaggccgaaaugaggau

SEQ ID NO: 9058 - RNA, 38 nt, Artificial Sequence
  Description of Artificial Sequence:  Enzymatic Nucleic Acid
accaauaucugaugaggccguuaggccgaaaaugagga

SEQ ID NO: 9059 - RNA, 38 nt, Artificial Sequence
  Description of Artificial Sequence:  Enzymatic Nucleic Acid
gugaccaacugaugaggccguuaggccgaaaugaauga

SEQ ID NO: 9060 - RNA, 38 nt, Artificial Sequence
  Description of Artificial Sequence:  Enzymatic Nucleic Acid
uggugacccugaugaggccguuaggccgaaauaugaau

SEQ ID NO: 9061 - RNA, 38 nt, Artificial Sequence
  Description of Artificial Sequence:  Enzymatic Nucleic Acid
gagauggucugaugaggccguuaggccgaaaccaauau

SEQ ID NO: 9062 - RNA, 38 nt, Artificial Sequence
  Description of Artificial Sequence:  Enzymatic Nucleic Acid
cacauugacugaugaggccguuaggccgaaauggugac

SEQ ID NO: 9063 - RNA, 38 nt, Artificial Sequence
  Description of Artificial Sequence:  Enzymatic Nucleic Acid
accacauucugaugaggccguuaggccgaaagauggug

SEQ ID NO: 9064 - RNA, 38 nt, Artificial Sequence
  Description of Artificial Sequence:  Enzymatic Nucleic Acid
agaagguucugaugaggccguuaggccgaaaccacauu

SEQ ID NO: 9065 - RNA, 38 nt, Artificial Sequence
  Description of Artificial Sequence:  Enzymatic Nucleic Acid
gcaccuagcugaugaggccguuaggccgaaagguugac

SEQ ID NO: 9066 - RNA, 38 nt, Artificial Sequence
  Description of Artificial Sequence:  Enzymatic Nucleic Acid
ggcaccuacugaugaggccguuaggccgaaaagguuga

SEQ ID NO: 9067 - RNA, 38 nt, Artificial Sequence
  Description of Artificial Sequence:  Enzymatic Nucleic Acid
caggcacccugaugaggccguuaggccgaaagaagguu

SEQ ID NO: 9068 - RNA, 38 nt, Artificial Sequence
  Description of Artificial Sequence:  Enzymatic Nucleic Acid
uggcuuggcugaugaggccguuaggccgaaacaggcac

SEQ ID NO: 9069 - RNA, 38 nt, Artificial Sequence
  Description of Artificial Sequence:  Enzymatic Nucleic Acid
aucaccaucugaugaggccguuaggccgaaaguggccc

SEQ ID NO: 9070 - RNA, 38 nt, Artificial Sequence
  Description of Artificial Sequence:  Enzymatic Nucleic Acid
aauuccaccugaugaggccguuaggccgaaaucaccau

SEQ ID NO: 9071 - RNA, 38 nt, Artificial Sequence
  Description of Artificial Sequence:  Enzymatic Nucleic Acid
auuugcagcugaugaggccguuaggccgaaauuccaca

SEQ ID NO: 9072 - RNA, 38 nt, Artificial Sequence
  Description of Artificial Sequence:  Enzymatic Nucleic Acid
aauuugcacugaugaggccguuaggccgaaaauuccac

SEQ ID NO: 9073 - RNA, 38 nt, Artificial Sequence
  Description of Artificial Sequence:  Enzymatic Nucleic Acid
gguuuccacugaugaggccguuaggccgaaauuugcag

SEQ ID NO: 9074 - RNA, 38 nt, Artificial Sequence
  Description of Artificial Sequence:  Enzymatic Nucleic Acid
agguuucccugaugaggccguuaggccgaaaauuugca

SEQ ID NO: 9075 - RNA, 38 nt, Artificial Sequence
  Description of Artificial Sequence:  Enzymatic Nucleic Acid
gguaagugcugaugaggccguuaggccgaaacagguuu

SEQ ID NO: 9076 - RNA, 38 nt, Artificial Sequence
  Description of Artificial Sequence:  Enzymatic Nucleic Acid
ccucaggucugaugaggccguuaggccgaaaguggaca

SEQ ID NO: 9077 - RNA, 38 nt, Artificial Sequence
  Description of Artificial Sequence:  Enzymatic Nucleic Acid
uccucaggcugaugaggccguuaggccgaaaaguggac

SEQ ID NO: 9078 - RNA, 38 nt, Artificial Sequence
  Description of Artificial Sequence:  Enzymatic Nucleic Acid
aggggacacugaugaggccguuaggccgaaauucauuu

SEQ ID NO: 9079 - RNA, 38 nt, Artificial Sequence
  Description of Artificial Sequence:  Enzymatic Nucleic Acid
uaggggaccugaugaggccguuaggccgaaaauucauu

SEQ ID NO: 9080 - RNA, 38 nt, Artificial Sequence
  Description of Artificial Sequence:  Enzymatic Nucleic Acid
uuguagggcugaugaggccguuaggccgaaacaaauuc

SEQ ID NO: 9081 - RNA, 38 nt, Artificial Sequence
  Description of Artificial Sequence:  Enzymatic Nucleic Acid
uggucuugcugaugaggccguuaggccgaaaggggaca

SEQ ID NO: 9082 - RNA, 38 nt, Artificial Sequence
  Description of Artificial Sequence:  Enzymatic Nucleic Acid
cuugacggcugaugaggccguuaggccgaaaucgugcc

SEQ ID NO: 9083 - RNA, 38 nt, Artificial Sequence
  Description of Artificial Sequence:  Enzymatic Nucleic Acid
ccuugacgcugaugaggccguuaggccgaaaaucgugc

SEQ ID NO: 9084 - RNA, 38 nt, Artificial Sequence
  Description of Artificial Sequence:  Enzymatic Nucleic Acid
uuucccuucugaugaggccguuaggccgaaacggaauc

SEQ ID NO: 9085 - RNA, 38 nt, Artificial Sequence
  Description of Artificial Sequence:  Enzymatic Nucleic Acid
cuccaacgcugaugaggccguuaggccgaaagucuuuc

SEQ ID NO: 9086 - RNA, 38 nt, Artificial Sequence
  Description of Artificial Sequence:  Enzymatic Nucleic Acid
auugcucccugaugaggccguuaggccgaaacguaguc

SEQ ID NO: 9087 - RNA, 38 nt, Artificial Sequence
  Description of Artificial Sequence:  Enzymatic Nucleic Acid
uccacaggcugaugaggccguuaggccgaaauugcucc

SEQ ID NO: 9088 - RNA, 38 nt, Artificial Sequence
  Description of Artificial Sequence:  Enzymatic Nucleic Acid
ccguuucacugaugaggccguuaggccgaaauccacag

SEQ ID NO: 9089 - RNA, 38 nt, Artificial Sequence
  Description of Artificial Sequence:  Enzymatic Nucleic Acid
ugcugucccugaugaggccguuaggccgaaagcgccgu

SEQ ID NO: 9090 - RNA, 38 nt, Artificial Sequence
  Description of Artificial Sequence:  Enzymatic Nucleic Acid
cuacuggucugaugaggccguuaggccgaaaugcuguc

SEQ ID NO: 9091 - RNA, 38 nt, Artificial Sequence
  Description of Artificial Sequence:  Enzymatic Nucleic Acid
gcucuggccugaugaggccguuaggccgaaacugguga

SEQ ID NO: 9092 - RNA, 38 nt, Artificial Sequence
  Description of Artificial Sequence:  Enzymatic Nucleic Acid
agcuggcucugaugaggccguuaggccgaaagcucugg

SEQ ID NO: 9093 - RNA, 38 nt, Artificial Sequence
  Description of Artificial Sequence:  Enzymatic Nucleic Acid
caaauccacugaugaggccguuaggccgaaagcuggcu

SEQ ID NO: 9094 - RNA, 38 nt, Artificial Sequence
  Description of Artificial Sequence:  Enzymatic Nucleic Acid
ccuccacacugaugaggccguuaggccgaaauccagag

SEQ ID NO: 9095 - RNA, 38 nt, Artificial Sequence
  Description of Artificial Sequence:  Enzymatic Nucleic Acid
uccuccaccugaugaggccguuaggccgaaaauccaga

SEQ ID NO: 9096 - RNA, 38 nt, Artificial Sequence
  Description of Artificial Sequence:  Enzymatic Nucleic Acid
cacugaggcugaugaggccguuaggccgaaacuucucc

SEQ ID NO: 9097 - RNA, 38 nt, Artificial Sequence
  Description of Artificial Sequence:  Enzymatic Nucleic Acid
acaucacucugaugaggccguuaggccgaaagggacuu

SEQ ID NO: 9098 - RNA, 38 nt, Artificial Sequence
  Description of Artificial Sequence:  Enzymatic Nucleic Acid
ucuucuuccugaugaggccguuaggccgaaacaucacu

SEQ ID NO: 9099 - RNA, 38 nt, Artificial Sequence
  Description of Artificial Sequence:  Enzymatic Nucleic Acid
aucuucagcugaugaggccguuaggccgaaagcuuccu

SEQ ID NO: 9100 - RNA, 38 nt, Artificial Sequence
  Description of Artificial Sequence:  Enzymatic Nucleic Acid
cuuauacacugaugaggccguuaggccgaaaucuucag

SEQ ID NO: 9101 - RNA, 38 nt, Artificial Sequence
  Description of Artificial Sequence:  Enzymatic Nucleic Acid
aguccuuacugaugaggccguuaggccgaaacagaucu

SEQ ID NO: 9102 - RNA, 38 nt, Artificial Sequence
  Description of Artificial Sequence:  Enzymatic Nucleic Acid
gaaguccucugaugaggccguuaggccgaaauacagau

SEQ ID NO: 9103 - RNA, 38 nt, Artificial Sequence
  Description of Artificial Sequence:  Enzymatic Nucleic Acid
aggucaggcugaugaggccguuaggccgaaaguccuua

SEQ ID NO: 9104 - RNA, 38 nt, Artificial Sequence
  Description of Artificial Sequence:  Enzymatic Nucleic Acid
aaggucagcugaugaggccguuaggccgaaaaguccuu

SEQ ID NO: 9105 - RNA, 38 nt, Artificial Sequence
  Description of Artificial Sequence:  Enzymatic Nucleic Acid
gaugcucccugaugaggccguuaggccgaaaggucagg

SEQ ID NO: 9106 - RNA, 38 nt, Artificial Sequence
  Description of Artificial Sequence:  Enzymatic Nucleic Acid
acagaugacugaugaggccguuaggccgaaaugcucca

SEQ ID NO: 9107 - RNA, 38 nt, Artificial Sequence
  Description of Artificial Sequence:  Enzymatic Nucleic Acid
uaacagaucugaugaggccguuaggccgaaagaugcuc

SEQ ID NO: 9108 - RNA, 38 nt, Artificial Sequence
  Description of Artificial Sequence:  Enzymatic Nucleic Acid
cuguaacacugaugaggccguuaggccgaaaugagaug

SEQ ID NO: 9109 - RNA, 38 nt, Artificial Sequence
  Description of Artificial Sequence:  Enzymatic Nucleic Acid
gaagcugucugaugaggccguuaggccgaaacagauga

SEQ ID NO: 9110 - RNA, 38 nt, Artificial Sequence
  Description of Artificial Sequence:  Enzymatic Nucleic Acid
ggaagcugcugaugaggccguuaggccgaaaacagaug

SEQ ID NO: 9111 - RNA, 38 nt, Artificial Sequence
  Description of Artificial Sequence:  Enzymatic Nucleic Acid
ccacuuggcugaugaggccguuaggccgaaagcuguaa

SEQ ID NO: 9112 - RNA, 38 nt, Artificial Sequence
  Description of Artificial Sequence:  Enzymatic Nucleic Acid
gccacuugcugaugaggccguuaggccgaaaagcugua

SEQ ID NO: 9113 - RNA, 38 nt, Artificial Sequence
  Description of Artificial Sequence:  Enzymatic Nucleic Acid
caugcccucugaugaggccguuaggccgaaagccacuu

SEQ ID NO: 9114 - RNA, 38 nt, Artificial Sequence
  Description of Artificial Sequence:  Enzymatic Nucleic Acid
augccaagcugaugaggccguuaggccgaaacuccaug

SEQ ID NO: 9115 - RNA, 38 nt, Artificial Sequence
  Description of Artificial Sequence:  Enzymatic Nucleic Acid
gaugccaacugaugaggccguuaggccgaaaacuccau

SEQ ID NO: 9116 - RNA, 38 nt, Artificial Sequence
  Description of Artificial Sequence:  Enzymatic Nucleic Acid
gcgaugcccugaugaggccguuaggccgaaagaacucc

SEQ ID NO: 9117 - RNA, 38 nt, Artificial Sequence
  Description of Artificial Sequence:  Enzymatic Nucleic Acid
acuuucgccugaugaggccguuaggccgaaaugccaag

SEQ ID NO: 9118 - RNA, 38 nt, Artificial Sequence
  Description of Artificial Sequence:  Enzymatic Nucleic Acid
ccuguggacugaugaggccguuaggccgaaacacuuuc

SEQ ID NO: 9119 - RNA, 38 nt, Artificial Sequence
  Description of Artificial Sequence:  Enzymatic Nucleic Acid
ucccugugcugaugaggccguuaggccgaaauacacuu

SEQ ID NO: 9120 - RNA, 38 nt, Artificial Sequence
  Description of Artificial Sequence:  Enzymatic Nucleic Acid
uaagaggacugaugaggccguuaggccgaaauuucgug

SEQ ID NO: 9121 - RNA, 38 nt, Artificial Sequence
  Description of Artificial Sequence:  Enzymatic Nucleic Acid
gauaagagcugaugaggccguuaggccgaaauauuucg

SEQ ID NO: 9122 - RNA, 38 nt, Artificial Sequence
  Description of Artificial Sequence:  Enzymatic Nucleic Acid
uccgauaacugaugaggccguuaggccgaaaggauauu

SEQ ID NO: 9123 - RNA, 38 nt, Artificial Sequence
  Description of Artificial Sequence:  Enzymatic Nucleic Acid
ucuccgaucugaugaggccguuaggccgaaagaggaua

SEQ ID NO: 9124 - RNA, 38 nt, Artificial Sequence
  Description of Artificial Sequence:  Enzymatic Nucleic Acid
uucuccgacugaugaggccguuaggccgaaaagaggau

SEQ ID NO: 9125 - RNA, 38 nt, Artificial Sequence
  Description of Artificial Sequence:  Enzymatic Nucleic Acid
ucuucucccugaugaggccguuaggccgaaauaagagg

SEQ ID NO: 9126 - RNA, 38 nt, Artificial Sequence
  Description of Artificial Sequence:  Enzymatic Nucleic Acid
cagauuuucugaugaggccguuaggccgaaaccacguu

SEQ ID NO: 9127 - RNA, 38 nt, Artificial Sequence
  Description of Artificial Sequence:  Enzymatic Nucleic Acid
acagauuucugaugaggccguuaggccgaaaaccacgu

SEQ ID NO: 9128 - RNA, 38 nt, Artificial Sequence
  Description of Artificial Sequence:  Enzymatic Nucleic Acid
aagucacacugaugaggccguuaggccgaaauuuuaac

SEQ ID NO: 9129 - RNA, 38 nt, Artificial Sequence
  Description of Artificial Sequence:  Enzymatic Nucleic Acid
ccaagccacugaugaggccguuaggccgaaagucacag

SEQ ID NO: 9130 - RNA, 38 nt, Artificial Sequence
  Description of Artificial Sequence:  Enzymatic Nucleic Acid
gccaagcccugaugaggccguuaggccgaaaagucaca

SEQ ID NO: 9131 - RNA, 38 nt, Artificial Sequence
  Description of Artificial Sequence:  Enzymatic Nucleic Acid
cccgggcccugaugaggccguuaggccgaaagccaaag

SEQ ID NO: 9132 - RNA, 38 nt, Artificial Sequence
  Description of Artificial Sequence:  Enzymatic Nucleic Acid
uuuauaaacugaugaggccguuaggccgaaaucccggg

SEQ ID NO: 9133 - RNA, 38 nt, Artificial Sequence
  Description of Artificial Sequence:  Enzymatic Nucleic Acid
ucuuuauacugaugaggccguuaggccgaaauaucccg

SEQ ID NO: 9134 - RNA, 38 nt, Artificial Sequence
  Description of Artificial Sequence:  Enzymatic Nucleic Acid
aucuuuaucugaugaggccguuaggccgaaaauauccc

SEQ ID NO: 9135 - RNA, 38 nt, Artificial Sequence
  Description of Artificial Sequence:  Enzymatic Nucleic Acid
gaucuuuacugaugaggccguuaggccgaaaaauaucc

SEQ ID NO: 9136 - RNA, 38 nt, Artificial Sequence
  Description of Artificial Sequence:  Enzymatic Nucleic Acid
uggaucuucugaugaggccguuaggccgaaauaaauau

SEQ ID NO: 9137 - RNA, 38 nt, Artificial Sequence
  Description of Artificial Sequence:  Enzymatic Nucleic Acid
auaaucugcugaugaggccguuaggccgaaaucuuuau

SEQ ID NO: 9138 - RNA, 38 nt, Artificial Sequence
  Description of Artificial Sequence:  Enzymatic Nucleic Acid
ucugacaucugaugaggccguuaggccgaaaucuggau

SEQ ID NO: 9139 - RNA, 38 nt, Artificial Sequence
  Description of Artificial Sequence:  Enzymatic Nucleic Acid
uucugacacugaugaggccguuaggccgaaaaucugga

SEQ ID NO: 9140 - RNA, 38 nt, Artificial Sequence
  Description of Artificial Sequence:  Enzymatic Nucleic Acid
ccuuuucucugaugaggccguuaggccgaaacauaauc

SEQ ID NO: 9141 - RNA, 38 nt, Artificial Sequence
  Description of Artificial Sequence:  Enzymatic Nucleic Acid
agggaggccugaugaggccguuaggccgaaagcaucuc

SEQ ID NO: 9142 - RNA, 38 nt, Artificial Sequence
  Description of Artificial Sequence:  Enzymatic Nucleic Acid
uucaaaggcugaugaggccguuaggccgaaaggcgagc

SEQ ID NO: 9143 - RNA, 38 nt, Artificial Sequence
  Description of Artificial Sequence:  Enzymatic Nucleic Acid
ccauuucacugaugaggccguuaggccgaaagggaggc

SEQ ID NO: 9144 - RNA, 38 nt, Artificial Sequence
  Description of Artificial Sequence:  Enzymatic Nucleic Acid
uccauuuccugaugaggccguuaggccgaaaagggagg

SEQ ID NO: 9145 - RNA, 38 nt, Artificial Sequence
  Description of Artificial Sequence:  Enzymatic Nucleic Acid
cugucaaacugaugaggccguuaggccgaaauuguuuc

SEQ ID NO: 9146 - RNA, 38 nt, Artificial Sequence
  Description of Artificial Sequence:  Enzymatic Nucleic Acid
ucugucaacugaugaggccguuaggccgaaaauuguuu

SEQ ID NO: 9147 - RNA, 38 nt, Artificial Sequence
  Description of Artificial Sequence:  Enzymatic Nucleic Acid
cucugucacugaugaggccguuaggccgaaaaauuguu

SEQ ID NO: 9148 - RNA, 38 nt, Artificial Sequence
  Description of Artificial Sequence:  Enzymatic Nucleic Acid
acucuguccugaugaggccguuaggccgaaaaaauugu

SEQ ID NO: 9149 - RNA, 38 nt, Artificial Sequence
  Description of Artificial Sequence:  Enzymatic Nucleic Acid
ggauugugcugaugaggccguuaggccgaaacacucug

SEQ ID NO: 9150 - RNA, 38 nt, Artificial Sequence
  Description of Artificial Sequence:  Enzymatic Nucleic Acid
ucacucugcugaugaggccguuaggccgaaauugugua

SEQ ID NO: 9151 - RNA, 38 nt, Artificial Sequence
  Description of Artificial Sequence:  Enzymatic Nucleic Acid
aaagaccacugaugaggccguuaggccgaaacgucacu

SEQ ID NO: 9152 - RNA, 38 nt, Artificial Sequence
  Description of Artificial Sequence:  Enzymatic Nucleic Acid
caccaaaacugaugaggccguuaggccgaaaccagacg

SEQ ID NO: 9153 - RNA, 38 nt, Artificial Sequence
  Description of Artificial Sequence:  Enzymatic Nucleic Acid
aacaccaacugaugaggccguuaggccgaaagaccaga

SEQ ID NO: 9154 - RNA, 38 nt, Artificial Sequence
  Description of Artificial Sequence:  Enzymatic Nucleic Acid
aaacaccacugaugaggccguuaggccgaaaagaccag

SEQ ID NO: 9155 - RNA, 38 nt, Artificial Sequence
  Description of Artificial Sequence:  Enzymatic Nucleic Acid
aaaacacccugaugaggccguuaggccgaaaaagacca

SEQ ID NO: 9156 - RNA, 38 nt, Artificial Sequence
  Description of Artificial Sequence:  Enzymatic Nucleic Acid
cacagcaacugaugaggccguuaggccgaaacaccaaa

SEQ ID NO: 9157 - RNA, 38 nt, Artificial Sequence
  Description of Artificial Sequence:  Enzymatic Nucleic Acid
ccacagcacugaugaggccguuaggccgaaaacaccaa

SEQ ID NO: 9158 - RNA, 38 nt, Artificial Sequence
  Description of Artificial Sequence:  Enzymatic Nucleic Acid
cccacagccugaugaggccguuaggccgaaaaacacca

SEQ ID NO: 9159 - RNA, 38 nt, Artificial Sequence
  Description of Artificial Sequence:  Enzymatic Nucleic Acid
aaggaaaacugaugaggccguuaggccgaaauuuccca

SEQ ID NO: 9160 - RNA, 38 nt, Artificial Sequence
  Description of Artificial Sequence:  Enzymatic Nucleic Acid
cuaaggaacugaugaggccguuaggccgaaauauuucc

SEQ ID NO: 9161 - RNA, 38 nt, Artificial Sequence
  Description of Artificial Sequence:  Enzymatic Nucleic Acid
ccuaaggacugaugaggccguuaggccgaaaauauuuc

SEQ ID NO: 9162 - RNA, 38 nt, Artificial Sequence
  Description of Artificial Sequence:  Enzymatic Nucleic Acid
accuaaggcugaugaggccguuaggccgaaaaauauuu

SEQ ID NO: 9163 - RNA, 38 nt, Artificial Sequence
  Description of Artificial Sequence:  Enzymatic Nucleic Acid
caccuaagcugaugaggccguuaggccgaaaaaauauu

SEQ ID NO: 9164 - RNA, 38 nt, Artificial Sequence
  Description of Artificial Sequence:  Enzymatic Nucleic Acid
aagcaccucugaugaggccguuaggccgaaaggaaaau

SEQ ID NO: 9165 - RNA, 38 nt, Artificial Sequence
  Description of Artificial Sequence:  Enzymatic Nucleic Acid
gaagcacccugaugaggccguuaggccgaaaaggaaaa

SEQ ID NO: 9166 - RNA, 38 nt, Artificial Sequence
  Description of Artificial Sequence:  Enzymatic Nucleic Acid
auauggagcugaugaggccguuaggccgaaagcaccua

SEQ ID NO: 9167 - RNA, 38 nt, Artificial Sequence
  Description of Artificial Sequence:  Enzymatic Nucleic Acid
gauauggacugaugaggccguuaggccgaaaagcaccu

SEQ ID NO: 9168 - RNA, 38 nt, Artificial Sequence
  Description of Artificial Sequence:  Enzymatic Nucleic Acid
aggauaugcugaugaggccguuaggccgaaagaagcac

SEQ ID NO: 9169 - RNA, 38 nt, Artificial Sequence
  Description of Artificial Sequence:  Enzymatic Nucleic Acid
ccccaggacugaugaggccguuaggccgaaauggagaa

SEQ ID NO: 9170 - RNA, 38 nt, Artificial Sequence
  Description of Artificial Sequence:  Enzymatic Nucleic Acid
uaccccagcugaugaggccguuaggccgaaauauggag

SEQ ID NO: 9171 - RNA, 38 nt, Artificial Sequence
  Description of Artificial Sequence:  Enzymatic Nucleic Acid
ucaaucuucugaugaggccguuaggccgaaaccccagg

SEQ ID NO: 9172 - RNA, 38 nt, Artificial Sequence
  Description of Artificial Sequence:  Enzymatic Nucleic Acid
ucuucauccugaugaggccguuaggccgaaaucuuuac

SEQ ID NO: 9173 - RNA, 38 nt, Artificial Sequence
  Description of Artificial Sequence:  Enzymatic Nucleic Acid
gccuacaacugaugaggccguuaggccgaaauucuuca

SEQ ID NO: 9174 - RNA, 38 nt, Artificial Sequence
  Description of Artificial Sequence:  Enzymatic Nucleic Acid
cgccuacacugaugaggccguuaggccgaaaauucuuc

SEQ ID NO: 9175 - RNA, 38 nt, Artificial Sequence
  Description of Artificial Sequence:  Enzymatic Nucleic Acid
ucgccuaccugaugaggccguuaggccgaaaaauucuu

SEQ ID NO: 9176 - RNA, 38 nt, Artificial Sequence
  Description of Artificial Sequence:  Enzymatic Nucleic Acid
caaucgcccugaugaggccguuaggccgaaacaaaauu

SEQ ID NO: 9177 - RNA, 38 nt, Artificial Sequence
  Description of Artificial Sequence:  Enzymatic Nucleic Acid
cuucuuuccugaugaggccguuaggccgaaaucgccua

SEQ ID NO: 9178 - RNA, 38 nt, Artificial Sequence
  Description of Artificial Sequence:  Enzymatic Nucleic Acid
ccucauuccugaugaggccguuaggccgaaaguuccuu

SEQ ID NO: 9179 - RNA, 38 nt, Artificial Sequence
  Description of Artificial Sequence:  Enzymatic Nucleic Acid
uguaguaucugaugaggccguuaggccgaaaucagggg

SEQ ID NO: 9180 - RNA, 38 nt, Artificial Sequence
  Description of Artificial Sequence:  Enzymatic Nucleic Acid
guguaguacugaugaggccguuaggccgaaaaucaggg

SEQ ID NO: 9181 - RNA, 38 nt, Artificial Sequence
  Description of Artificial Sequence:  Enzymatic Nucleic Acid
ugguguagcugaugaggccguuaggccgaaauaaucag

SEQ ID NO: 9182 - RNA, 38 nt, Artificial Sequence
  Description of Artificial Sequence:  Enzymatic Nucleic Acid
uucuggugcugaugaggccguuaggccgaaaguauaau

SEQ ID NO: 9183 - RNA, 38 nt, Artificial Sequence
  Description of Artificial Sequence:  Enzymatic Nucleic Acid
uggucuggcugaugaggccguuaggccgaaacauuucu

SEQ ID NO: 9184 - RNA, 38 nt, Artificial Sequence
  Description of Artificial Sequence:  Enzymatic Nucleic Acid
gggucucucugaugaggccguuaggccgaaacugggcu

SEQ ID NO: 9185 - RNA, 38 nt, Artificial Sequence
  Description of Artificial Sequence:  Enzymatic Nucleic Acid
acucugaacugaugaggccguuaggccgaaacgugggu

SEQ ID NO: 9186 - RNA, 38 nt, Artificial Sequence
  Description of Artificial Sequence:  Enzymatic Nucleic Acid
aacucugacugaugaggccguuaggccgaaaacguggg

SEQ ID NO: 9187 - RNA, 38 nt, Artificial Sequence
  Description of Artificial Sequence:  Enzymatic Nucleic Acid
caacucugcugaugaggccguuaggccgaaaaacgugg

SEQ ID NO: 9188 - RNA, 38 nt, Artificial Sequence
  Description of Artificial Sequence:  Enzymatic Nucleic Acid
ccaacucucugaugaggccguuaggccgaaaaaacgug

SEQ ID NO: 9189 - RNA, 38 nt, Artificial Sequence
  Description of Artificial Sequence:  Enzymatic Nucleic Acid
guuccacccugaugaggccguuaggccgaaacucugaa

SEQ ID NO: 9190 - RNA, 38 nt, Artificial Sequence
  Description of Artificial Sequence:  Enzymatic Nucleic Acid
auuucccacugaugaggccguuaggccgaaauguucca

SEQ ID NO: 9191 - RNA, 38 nt, Artificial Sequence
  Description of Artificial Sequence:  Enzymatic Nucleic Acid
gauuuccccugaugaggccguuaggccgaaaauguucc

SEQ ID NO: 9192 - RNA, 38 nt, Artificial Sequence
  Description of Artificial Sequence:  Enzymatic Nucleic Acid
uugcaagacugaugaggccguuaggccgaaauuuccca

SEQ ID NO: 9193 - RNA, 38 nt, Artificial Sequence
  Description of Artificial Sequence:  Enzymatic Nucleic Acid
gcuugcaacugaugaggccguuaggccgaaagauuucc

SEQ ID NO: 9194 - RNA, 38 nt, Artificial Sequence
  Description of Artificial Sequence:  Enzymatic Nucleic Acid
uagcuugccugaugaggccguuaggccgaaagagauuu

SEQ ID NO: 9195 - RNA, 38 nt, Artificial Sequence
  Description of Artificial Sequence:  Enzymatic Nucleic Acid
cugagcaucugaugaggccguuaggccgaaagcuugca

SEQ ID NO: 9196 - RNA, 38 nt, Artificial Sequence
  Description of Artificial Sequence:  Enzymatic Nucleic Acid
auccugcucugaugaggccguuaggccgaaagcauuag

SEQ ID NO: 9197 - RNA, 38 nt, Artificial Sequence
  Description of Artificial Sequence:  Enzymatic Nucleic Acid
gaacaaugcugaugaggccguuaggccgaaagucuuug

SEQ ID NO: 9198 - RNA, 38 nt, Artificial Sequence
  Description of Artificial Sequence:  Enzymatic Nucleic Acid
ggaagaaccugaugaggccguuaggccgaaauguaguc

SEQ ID NO: 9199 - RNA, 38 nt, Artificial Sequence
  Description of Artificial Sequence:  Enzymatic Nucleic Acid
aucggaagcugaugaggccguuaggccgaaacaaugua

SEQ ID NO: 9200 - RNA, 38 nt, Artificial Sequence
  Description of Artificial Sequence:  Enzymatic Nucleic Acid
uaucggaacugaugaggccguuaggccgaaaacaaugu

SEQ ID NO: 9201 - RNA, 38 nt, Artificial Sequence
  Description of Artificial Sequence:  Enzymatic Nucleic Acid
gauaucggcugaugaggccguuaggccgaaagaacaau

SEQ ID NO: 9202 - RNA, 38 nt, Artificial Sequence
  Description of Artificial Sequence:  Enzymatic Nucleic Acid
ugauaucgcugaugaggccguuaggccgaaaagaacaa

SEQ ID NO: 9203 - RNA, 38 nt, Artificial Sequence
  Description of Artificial Sequence:  Enzymatic Nucleic Acid
gucucugacugaugaggccguuaggccgaaaucggaag

SEQ ID NO: 9204 - RNA, 38 nt, Artificial Sequence
  Description of Artificial Sequence:  Enzymatic Nucleic Acid
aagucucucugaugaggccguuaggccgaaauaucgga

SEQ ID NO: 9205 - RNA, 38 nt, Artificial Sequence
  Description of Artificial Sequence:  Enzymatic Nucleic Acid
caugcucacugaugaggccguuaggccgaaagucucug

SEQ ID NO: 9206 - RNA, 38 nt, Artificial Sequence
  Description of Artificial Sequence:  Enzymatic Nucleic Acid
ccaugcuccugaugaggccguuaggccgaaaagucucu

SEQ ID NO: 9207 - RNA, 38 nt, Artificial Sequence
  Description of Artificial Sequence:  Enzymatic Nucleic Acid
gaguccagcugaugaggccguuaggccgaaauccucuu

SEQ ID NO: 9208 - RNA, 38 nt, Artificial Sequence
  Description of Artificial Sequence:  Enzymatic Nucleic Acid
agaguccacugaugaggccguuaggccgaaaauccucu

SEQ ID NO: 9209 - RNA, 38 nt, Artificial Sequence
  Description of Artificial Sequence:  Enzymatic Nucleic Acid
ggcagagacugaugaggccguuaggccgaaaguccaga

SEQ ID NO: 9210 - RNA, 38 nt, Artificial Sequence
  Description of Artificial Sequence:  Enzymatic Nucleic Acid
uaggcagacugaugaggccguuaggccgaaagagucca

SEQ ID NO: 9211 - RNA, 38 nt, Artificial Sequence
  Description of Artificial Sequence:  Enzymatic Nucleic Acid
gguaggcacugaugaggccguuaggccgaaagagaguc

SEQ ID NO: 9212 - RNA, 38 nt, Artificial Sequence
  Description of Artificial Sequence:  Enzymatic Nucleic Acid
aggugaggcugaugaggccguuaggccgaaaggcagag

SEQ ID NO: 9213 - RNA, 38 nt, Artificial Sequence
  Description of Artificial Sequence:  Enzymatic Nucleic Acid
aaacaggucugaugaggccguuaggccgaaagguaggc

SEQ ID NO: 9214 - RNA, 38 nt, Artificial Sequence
  Description of Artificial Sequence:  Enzymatic Nucleic Acid
auacaggacugaugaggccguuaggccgaaacagguga

SEQ ID NO: 9215 - RNA, 38 nt, Artificial Sequence
  Description of Artificial Sequence:  Enzymatic Nucleic Acid
cauacaggcugaugaggccguuaggccgaaaacaggug

SEQ ID NO: 9216 - RNA, 38 nt, Artificial Sequence
  Description of Artificial Sequence:  Enzymatic Nucleic Acid
ccauacagcugaugaggccguuaggccgaaaaacaggu

SEQ ID NO: 9217 - RNA, 38 nt, Artificial Sequence
  Description of Artificial Sequence:  Enzymatic Nucleic Acid
cuccuccacugaugaggccguuaggccgaaacaggaaa

SEQ ID NO: 9218 - RNA, 38 nt, Artificial Sequence
  Description of Artificial Sequence:  Enzymatic Nucleic Acid
gggucacacugaugaggccguuaggccgaaacuuccuc

SEQ ID NO: 9219 - RNA, 38 nt, Artificial Sequence
  Description of Artificial Sequence:  Enzymatic Nucleic Acid
cauaauggcugaugaggccguuaggccgaaauuugggg

SEQ ID NO: 9220 - RNA, 38 nt, Artificial Sequence
  Description of Artificial Sequence:  Enzymatic Nucleic Acid
ucauaaugcugaugaggccguuaggccgaaaauuuggg

SEQ ID NO: 9221 - RNA, 38 nt, Artificial Sequence
  Description of Artificial Sequence:  Enzymatic Nucleic Acid
guugucaucugaugaggccguuaggccgaaauggaauu

SEQ ID NO: 9222 - RNA, 38 nt, Artificial Sequence
  Description of Artificial Sequence:  Enzymatic Nucleic Acid
uguugucacugaugaggccguuaggccgaaaauggaau

SEQ ID NO: 9223 - RNA, 38 nt, Artificial Sequence
  Description of Artificial Sequence:  Enzymatic Nucleic Acid
uacugacucugaugaggccguuaggccgaaauuccugc

SEQ ID NO: 9224 - RNA, 38 nt, Artificial Sequence
  Description of Artificial Sequence:  Enzymatic Nucleic Acid
cagauacucugaugaggccguuaggccgaaacugauuc

SEQ ID NO: 9225 - RNA, 38 nt, Artificial Sequence
  Description of Artificial Sequence:  Enzymatic Nucleic Acid
ucugcagacugaugaggccguuaggccgaaacugacug

SEQ ID NO: 9226 - RNA, 38 nt, Artificial Sequence
  Description of Artificial Sequence:  Enzymatic Nucleic Acid
guucugcacugaugaggccguuaggccgaaauacugac

SEQ ID NO: 9227 - RNA, 38 nt, Artificial Sequence
  Description of Artificial Sequence:  Enzymatic Nucleic Acid
cuuucgcucugaugaggccguuaggccgaaacuguucu

SEQ ID NO: 9228 - RNA, 38 nt, Artificial Sequence
  Description of Artificial Sequence:  Enzymatic Nucleic Acid
aauguuuucugaugaggccguuaggccgaaacacucac

SEQ ID NO: 9229 - RNA, 38 nt, Artificial Sequence
  Description of Artificial Sequence:  Enzymatic Nucleic Acid
uaucuucacugaugaggccguuaggccgaaauguuuuu

SEQ ID NO: 9230 - RNA, 38 nt, Artificial Sequence
  Description of Artificial Sequence:  Enzymatic Nucleic Acid
auaucuuccugaugaggccguuaggccgaaaauguuuu

SEQ ID NO: 9231 - RNA, 38 nt, Artificial Sequence
  Description of Artificial Sequence:  Enzymatic Nucleic Acid
uaacgggacugaugaggccguuaggccgaaaucuucaa

SEQ ID NO: 9232 - RNA, 38 nt, Artificial Sequence
  Description of Artificial Sequence:  Enzymatic Nucleic Acid
ucuaacggcugaugaggccguuaggccgaaauaucuuc

SEQ ID NO: 9233 - RNA, 38 nt, Artificial Sequence
  Description of Artificial Sequence:  Enzymatic Nucleic Acid
guucuucucugaugaggccguuaggccgaaacgggaua

SEQ ID NO: 9234 - RNA, 38 nt, Artificial Sequence
  Description of Artificial Sequence:  Enzymatic Nucleic Acid
gguucuuccugaugaggccguuaggccgaaaacgggau

SEQ ID NO: 9235 - RNA, 38 nt, Artificial Sequence
  Description of Artificial Sequence:  Enzymatic Nucleic Acid
auuacuuucugaugaggccguuaggccgaaacuucugg

SEQ ID NO: 9236 - RNA, 38 nt, Artificial Sequence
  Description of Artificial Sequence:  Enzymatic Nucleic Acid
ucugggaucugaugaggccguuaggccgaaacuuuuac

SEQ ID NO: 9237 - RNA, 38 nt, Artificial Sequence
  Description of Artificial Sequence:  Enzymatic Nucleic Acid
ucaucuggcugaugaggccguuaggccgaaauuacuuu

SEQ ID NO: 9238 - RNA, 38 nt, Artificial Sequence
  Description of Artificial Sequence:  Enzymatic Nucleic Acid
aagaaccacugaugaggccguuaggccgaaaccacugu

SEQ ID NO: 9239 - RNA, 38 nt, Artificial Sequence
  Description of Artificial Sequence:  Enzymatic Nucleic Acid
gaggcaagcugaugaggccguuaggccgaaaccauacc

SEQ ID NO: 9240 - RNA, 38 nt, Artificial Sequence
  Description of Artificial Sequence:  Enzymatic Nucleic Acid
ugaggcaacugaugaggccguuaggccgaaaaccauac

SEQ ID NO: 9241 - RNA, 38 nt, Artificial Sequence
  Description of Artificial Sequence:  Enzymatic Nucleic Acid
ucugaggccugaugaggccguuaggccgaaagaaccau

SEQ ID NO: 9242 - RNA, 38 nt, Artificial Sequence
  Description of Artificial Sequence:  Enzymatic Nucleic Acid
gcucuucucugaugaggccguuaggccgaaaggcaaga

SEQ ID NO: 9243 - RNA, 38 nt, Artificial Sequence
  Description of Artificial Sequence:  Enzymatic Nucleic Acid
gucuuccacugaugaggccguuaggccgaaaguuuuca

SEQ ID NO: 9244 - RNA, 38 nt, Artificial Sequence
  Description of Artificial Sequence:  Enzymatic Nucleic Acid
ugucuucccugaugaggccguuaggccgaaaaguuuuc

SEQ ID NO: 9245 - RNA, 38 nt, Artificial Sequence
  Description of Artificial Sequence:  Enzymatic Nucleic Acid
auggagaucugaugaggccguuaggccgaaauuugguu

SEQ ID NO: 9246 - RNA, 38 nt, Artificial Sequence
  Description of Artificial Sequence:  Enzymatic Nucleic Acid
gauggagacugaugaggccguuaggccgaaaauuuggu

SEQ ID NO: 9247 - RNA, 38 nt, Artificial Sequence
  Description of Artificial Sequence:  Enzymatic Nucleic Acid
aagauggacugaugaggccguuaggccgaaauaauuug

SEQ ID NO: 9248 - RNA, 38 nt, Artificial Sequence
  Description of Artificial Sequence:  Enzymatic Nucleic Acid
aaaagaugcugaugaggccguuaggccgaaagauaauu

SEQ ID NO: 9249 - RNA, 38 nt, Artificial Sequence
  Description of Artificial Sequence:  Enzymatic Nucleic Acid
caccaaaacugaugaggccguuaggccgaaauggagau

SEQ ID NO: 9250 - RNA, 38 nt, Artificial Sequence
  Description of Artificial Sequence:  Enzymatic Nucleic Acid
uccaccaacugaugaggccguuaggccgaaagauggag

SEQ ID NO: 9251 - RNA, 38 nt, Artificial Sequence
  Description of Artificial Sequence:  Enzymatic Nucleic Acid
uuccaccacugaugaggccguuaggccgaaaagaugga

SEQ ID NO: 9252 - RNA, 38 nt, Artificial Sequence
  Description of Artificial Sequence:  Enzymatic Nucleic Acid
auuccacccugaugaggccguuaggccgaaaaagaugg

SEQ ID NO: 9253 - RNA, 38 nt, Artificial Sequence
  Description of Artificial Sequence:  Enzymatic Nucleic Acid
augccacacugaugaggccguuaggccgaaacucccug

SEQ ID NO: 9254 - RNA, 38 nt, Artificial Sequence
  Description of Artificial Sequence:  Enzymatic Nucleic Acid
agccuucacugaugaggccguuaggccgaaaugccaca

SEQ ID NO: 9255 - RNA, 38 nt, Artificial Sequence
  Description of Artificial Sequence:  Enzymatic Nucleic Acid
ucugguuucugaugaggccguuaggccgaaagccuuca

SEQ ID NO: 9256 - RNA, 38 nt, Artificial Sequence
  Description of Artificial Sequence:  Enzymatic Nucleic Acid
cggacuggcugaugaggccguuaggccgaaagccgcuu

SEQ ID NO: 9257 - RNA, 38 nt, Artificial Sequence
  Description of Artificial Sequence:  Enzymatic Nucleic Acid
gauauccgcugaugaggccguuaggccgaaacugguag

SEQ ID NO: 9258 - RNA, 38 nt, Artificial Sequence
  Description of Artificial Sequence:  Enzymatic Nucleic Acid
cggagugacugaugaggccguuaggccgaaauccggac

SEQ ID NO: 9259 - RNA, 38 nt, Artificial Sequence
  Description of Artificial Sequence:  Enzymatic Nucleic Acid
aucggagucugaugaggccguuaggccgaaauauccgg

SEQ ID NO: 9260 - RNA, 38 nt, Artificial Sequence
  Description of Artificial Sequence:  Enzymatic Nucleic Acid
ugucaucgcugaugaggccguuaggccgaaagugauau

SEQ ID NO: 9261 - RNA, 38 nt, Artificial Sequence
  Description of Artificial Sequence:  Enzymatic Nucleic Acid
cacuggagcugaugaggccguuaggccgaaacacggug

SEQ ID NO: 9262 - RNA, 38 nt, Artificial Sequence
  Description of Artificial Sequence:  Enzymatic Nucleic Acid
ccucacugcugaugaggccguuaggccgaaaguacacg

SEQ ID NO: 9263 - RNA, 38 nt, Artificial Sequence
  Description of Artificial Sequence:  Enzymatic Nucleic Acid
agcuuuaacugaugaggccguuaggccgaaaguucugc

SEQ ID NO: 9264 - RNA, 38 nt, Artificial Sequence
  Description of Artificial Sequence:  Enzymatic Nucleic Acid
cagcuuuacugaugaggccguuaggccgaaaaguucug

SEQ ID NO: 9265 - RNA, 38 nt, Artificial Sequence
  Description of Artificial Sequence:  Enzymatic Nucleic Acid
ucagcuuucugaugaggccguuaggccgaaaaaguucu

SEQ ID NO: 9266 - RNA, 38 nt, Artificial Sequence
  Description of Artificial Sequence:  Enzymatic Nucleic Acid
aucagcuucugaugaggccguuaggccgaaaaaaguuc

SEQ ID NO: 9267 - RNA, 38 nt, Artificial Sequence
  Description of Artificial Sequence:  Enzymatic Nucleic Acid
ccaaucuccugaugaggccguuaggccgaaaucagcuu

SEQ ID NO: 9268 - RNA, 38 nt, Artificial Sequence
  Description of Artificial Sequence:  Enzymatic Nucleic Acid
ugcacucccugaugaggccguuaggccgaaaucucuau

SEQ ID NO: 9269 - RNA, 38 nt, Artificial Sequence
  Description of Artificial Sequence:  Enzymatic Nucleic Acid
ggcugugccugaugaggccguuaggccgaaaccgguuu

SEQ ID NO: 9270 - RNA, 38 nt, Artificial Sequence
  Description of Artificial Sequence:  Enzymatic Nucleic Acid
ggcuggagcugaugaggccguuaggccgaaaucugggc

SEQ ID NO: 9271 - RNA, 38 nt, Artificial Sequence
  Description of Artificial Sequence:  Enzymatic Nucleic Acid
aggcuggacugaugaggccguuaggccgaaaaucuggg

SEQ ID NO: 9272 - RNA, 38 nt, Artificial Sequence
  Description of Artificial Sequence:  Enzymatic Nucleic Acid
ucaggcugcugaugaggccguuaggccgaaagaaucug

SEQ ID NO: 9273 - RNA, 38 nt, Artificial Sequence
  Description of Artificial Sequence:  Enzymatic Nucleic Acid
caggaggacugaugaggccguuaggccgaaagcucagu

SEQ ID NO: 9274 - RNA, 38 nt, Artificial Sequence
  Description of Artificial Sequence:  Enzymatic Nucleic Acid
aacaggagcugaugaggccguuaggccgaaagagcuca

SEQ ID NO: 9275 - RNA, 38 nt, Artificial Sequence
  Description of Artificial Sequence:  Enzymatic Nucleic Acid
uuaaacagcugaugaggccguuaggccgaaaggagagc

SEQ ID NO: 9276 - RNA, 38 nt, Artificial Sequence
  Description of Artificial Sequence:  Enzymatic Nucleic Acid
uccuuuuacugaugaggccguuaggccgaaacaggagg

SEQ ID NO: 9277 - RNA, 38 nt, Artificial Sequence
  Description of Artificial Sequence:  Enzymatic Nucleic Acid
uuccuuuucugaugaggccguuaggccgaaaacaggag

SEQ ID NO: 9278 - RNA, 38 nt, Artificial Sequence
  Description of Artificial Sequence:  Enzymatic Nucleic Acid
cuuccuuucugaugaggccguuaggccgaaaaacagga

SEQ ID NO: 9279 - RNA, 38 nt, Artificial Sequence
  Description of Artificial Sequence:  Enzymatic Nucleic Acid
ggggugugcugaugaggccguuaggccgaaaugcuucc

SEQ ID NO: 9280 - RNA, 38 nt, Artificial Sequence
  Description of Artificial Sequence:  Enzymatic Nucleic Acid
auguccggcugaugaggccguuaggccgaaaguugggg

SEQ ID NO: 9281 - RNA, 38 nt, Artificial Sequence
  Description of Artificial Sequence:  Enzymatic Nucleic Acid
ucucaugucugaugaggccguuaggccgaaauguccgg

SEQ ID NO: 9282 - RNA, 38 nt, Artificial Sequence
  Description of Artificial Sequence:  Enzymatic Nucleic Acid
ucugagcacugaugaggccguuaggccgaaaccucuca

SEQ ID NO: 9283 - RNA, 38 nt, Artificial Sequence
  Description of Artificial Sequence:  Enzymatic Nucleic Acid
caaaaucucugaugaggccguuaggccgaaagcagacc

SEQ ID NO: 9284 - RNA, 38 nt, Artificial Sequence
  Description of Artificial Sequence:  Enzymatic Nucleic Acid
cacuucaacugaugaggccguuaggccgaaaucugagc

SEQ ID NO: 9285 - RNA, 38 nt, Artificial Sequence
  Description of Artificial Sequence:  Enzymatic Nucleic Acid
acacuucacugaugaggccguuaggccgaaaaucugag

SEQ ID NO: 9286 - RNA, 38 nt, Artificial Sequence
  Description of Artificial Sequence:  Enzymatic Nucleic Acid
aacacuuccugaugaggccguuaggccgaaaaaucuga

SEQ ID NO: 9287 - RNA, 38 nt, Artificial Sequence
  Description of Artificial Sequence:  Enzymatic Nucleic Acid
gaaagaaccugaugaggccguuaggccgaaacacuuca

SEQ ID NO: 9288 - RNA, 38 nt, Artificial Sequence
  Description of Artificial Sequence:  Enzymatic Nucleic Acid
guggaaagcugaugaggccguuaggccgaaacaacacu

SEQ ID NO: 9289 - RNA, 38 nt, Artificial Sequence
  Description of Artificial Sequence:  Enzymatic Nucleic Acid
gguggaaacugaugaggccguuaggccgaaaacaacac

SEQ ID NO: 9290 - RNA, 38 nt, Artificial Sequence
  Description of Artificial Sequence:  Enzymatic Nucleic Acid
cugguggacugaugaggccguuaggccgaaagaacaac

SEQ ID NO: 9291 - RNA, 38 nt, Artificial Sequence
  Description of Artificial Sequence:  Enzymatic Nucleic Acid
gcugguggcugaugaggccguuaggccgaaaagaacaa

SEQ ID NO: 9292 - RNA, 38 nt, Artificial Sequence
  Description of Artificial Sequence:  Enzymatic Nucleic Acid
ugcuggugcugaugaggccguuaggccgaaaaagaaca

SEQ ID NO: 9293 - RNA, 38 nt, Artificial Sequence
  Description of Artificial Sequence:  Enzymatic Nucleic Acid
aaugcggccugaugaggccguuaggccgaaacuuccug

SEQ ID NO: 9294 - RNA, 38 nt, Artificial Sequence
  Description of Artificial Sequence:  Enzymatic Nucleic Acid
gaaaaucacugaugaggccguuaggccgaaaugcggcu

SEQ ID NO: 9295 - RNA, 38 nt, Artificial Sequence
  Description of Artificial Sequence:  Enzymatic Nucleic Acid
ugaaaauccugaugaggccguuaggccgaaaaugcggc

SEQ ID NO: 9296 - RNA, 38 nt, Artificial Sequence
  Description of Artificial Sequence:  Enzymatic Nucleic Acid
gaaaugaacugaugaggccguuaggccgaaaucaaaug

SEQ ID NO: 9297 - RNA, 38 nt, Artificial Sequence
  Description of Artificial Sequence:  Enzymatic Nucleic Acid
cgaaaugacugaugaggccguuaggccgaaaaucaaau

SEQ ID NO: 9298 - RNA, 38 nt, Artificial Sequence
  Description of Artificial Sequence:  Enzymatic Nucleic Acid
ucgaaaugcugaugaggccguuaggccgaaaaaucaaa

SEQ ID NO: 9299 - RNA, 38 nt, Artificial Sequence
  Description of Artificial Sequence:  Enzymatic Nucleic Acid
gucgaaaucugaugaggccguuaggccgaaaaaaucaa

SEQ ID NO: 9300 - RNA, 38 nt, Artificial Sequence
  Description of Artificial Sequence:  Enzymatic Nucleic Acid
guugucgacugaugaggccguuaggccgaaaugaaaau

SEQ ID NO: 9301 - RNA, 38 nt, Artificial Sequence
  Description of Artificial Sequence:  Enzymatic Nucleic Acid
uguugucgcugaugaggccguuaggccgaaaaugaaaa

SEQ ID NO: 9302 - RNA, 38 nt, Artificial Sequence
  Description of Artificial Sequence:  Enzymatic Nucleic Acid
cuguuguccugaugaggccguuaggccgaaaaaugaaa

SEQ ID NO: 9303 - RNA, 38 nt, Artificial Sequence
  Description of Artificial Sequence:  Enzymatic Nucleic Acid
ugcagucccugaugaggccguuaggccgaaagguccuu

SEQ ID NO: 9304 - RNA, 38 nt, Artificial Sequence
  Description of Artificial Sequence:  Enzymatic Nucleic Acid
gccuagaacugaugaggccguuaggccgaaagcuggcu

SEQ ID NO: 9305 - RNA, 38 nt, Artificial Sequence
  Description of Artificial Sequence:  Enzymatic Nucleic Acid
aagccuagcugaugaggccguuaggccgaaagagcugg

SEQ ID NO: 9306 - RNA, 38 nt, Artificial Sequence
  Description of Artificial Sequence:  Enzymatic Nucleic Acid
caagccuacugaugaggccguuaggccgaaaagagcug

SEQ ID NO: 9307 - RNA, 38 nt, Artificial Sequence
  Description of Artificial Sequence:  Enzymatic Nucleic Acid
cacaagcccugaugaggccguuaggccgaaagaagagc

SEQ ID NO: 9308 - RNA, 54 nt, Artificial Sequence
  Description of Artificial Sequence:  Enzymatic Nucleic Acid
cgacggccagaagcaccuaccagagaaacacacguugugguacauuaccuggua

SEQ ID NO: 9309 - RNA, 54 nt, Artificial Sequence
  Description of Artificial Sequence:  Enzymatic Nucleic Acid
cacagggcagaagccagcaccagagaaacacacguugugguacauuaccuggua

SEQ ID NO: 9310 - RNA, 54 nt, Artificial Sequence
  Description of Artificial Sequence:  Enzymatic Nucleic Acid
cccacagaagaagcccggaccagagaaacacacguugugguacauuaccuggua

SEQ ID NO: 9311 - RNA, 54 nt, Artificial Sequence
  Description of Artificial Sequence:  Enzymatic Nucleic Acid
ugagccugagaagaucaaaccagagaaacacacguugugguacauuaccuggua

SEQ ID NO: 9312 - RNA, 54 nt, Artificial Sequence
  Description of Artificial Sequence:  Enzymatic Nucleic Acid
gaggccaaagaaguuuccaccagagaaacacacguugugguacauuaccuggua

SEQ ID NO: 9313 - RNA, 54 nt, Artificial Sequence
  Description of Artificial Sequence:  Enzymatic Nucleic Acid
aaauggagagaaguaaucaccagagaaacacacguugugguacauuaccuggua

SEQ ID NO: 9314 - RNA, 54 nt, Artificial Sequence
  Description of Artificial Sequence:  Enzymatic Nucleic Acid
cuguuaccagaaggaacaaccagagaaacacacguugugguacauuaccuggua

SEQ ID NO: 9315 - RNA, 54 nt, Artificial Sequence
  Description of Artificial Sequence:  Enzymatic Nucleic Acid
acauaauaagaagguaacaccagagaaacacacguugugguacauuaccuggua

SEQ ID NO: 9316 - RNA, 54 nt, Artificial Sequence
  Description of Artificial Sequence:  Enzymatic Nucleic Acid
uuccaugaagaagacucaaccagagaaacacacguugugguacauuaccuggua

SEQ ID NO: 9317 - RNA, 54 nt, Artificial Sequence
  Description of Artificial Sequence:  Enzymatic Nucleic Acid
uuuucuccagaagauaguaccagagaaacacacguugugguacauuaccuggua

SEQ ID NO: 9318 - RNA, 54 nt, Artificial Sequence
  Description of Artificial Sequence:  Enzymatic Nucleic Acid
cacucccaagaaggguuuaccagagaaacacacguugugguacauuaccuggua

SEQ ID NO: 9319 - RNA, 54 nt, Artificial Sequence
  Description of Artificial Sequence:  Enzymatic Nucleic Acid
ucuuggucagaagcccacaccagagaaacacacguugugguacauuaccuggua

SEQ ID NO: 9320 - RNA, 54 nt, Artificial Sequence
  Description of Artificial Sequence:  Enzymatic Nucleic Acid
ccauaaucagaaguacauaccagagaaacacacguugugguacauuaccuggua

SEQ ID NO: 9321 - RNA, 54 nt, Artificial Sequence
  Description of Artificial Sequence:  Enzymatic Nucleic Acid
ucucaccaagaaggggugaccagagaaacacacguugugguacauuaccuggua

SEQ ID NO: 9322 - RNA, 54 nt, Artificial Sequence
  Description of Artificial Sequence:  Enzymatic Nucleic Acid
auggcauaagaaguacauaccagagaaacacacguugugguacauuaccuggua

SEQ ID NO: 9323 - RNA, 54 nt, Artificial Sequence
  Description of Artificial Sequence:  Enzymatic Nucleic Acid
cuuccuccagaagccaauaccagagaaacacacguugugguacauuaccuggua

SEQ ID NO: 9324 - RNA, 54 nt, Artificial Sequence
  Description of Artificial Sequence:  Enzymatic Nucleic Acid
gucacugaagaagcuuggaccagagaaacacacguugugguacauuaccuggua

SEQ ID NO: 9325 - RNA, 54 nt, Artificial Sequence
  Description of Artificial Sequence:  Enzymatic Nucleic Acid
uuguacaaagaagacacaaccagagaaacacacguugugguacauuaccuggua

SEQ ID NO: 9326 - RNA, 54 nt, Artificial Sequence
  Description of Artificial Sequence:  Enzymatic Nucleic Acid
gcucagugagaagcauguaccagagaaacacacguugugguacauuaccuggua

SEQ ID NO: 9327 - RNA, 54 nt, Artificial Sequence
  Description of Artificial Sequence:  Enzymatic Nucleic Acid
aaacguagagaagucugcaccagagaaacacacguugugguacauuaccuggua

SEQ ID NO: 9328 - RNA, 54 nt, Artificial Sequence
  Description of Artificial Sequence:  Enzymatic Nucleic Acid
uuggcagaagaagugggcaccagagaaacacacguugugguacauuaccuggua

SEQ ID NO: 9329 - RNA, 54 nt, Artificial Sequence
  Description of Artificial Sequence:  Enzymatic Nucleic Acid
uucuugcaagaaggugugaccagagaaacacacguugugguacauuaccuggua

SEQ ID NO: 9330 - RNA, 54 nt, Artificial Sequence
  Description of Artificial Sequence:  Enzymatic Nucleic Acid
uugagcaaagaagacauaaccagagaaacacacguugugguacauuaccuggua

SEQ ID NO: 9331 - RNA, 54 nt, Artificial Sequence
  Description of Artificial Sequence:  Enzymatic Nucleic Acid
ggacugugagaagccugaaccagagaaacacacguugugguacauuaccuggua

SEQ ID NO: 9332 - RNA, 54 nt, Artificial Sequence
  Description of Artificial Sequence:  Enzymatic Nucleic Acid
cgcucuagagaagugagcaccagagaaacacacguugugguacauuaccuggua

SEQ ID NO: 9333 - RNA, 54 nt, Artificial Sequence
  Description of Artificial Sequence:  Enzymatic Nucleic Acid
uacuugucagaagauucuaccagagaaacacacguugugguacauuaccuggua

SEQ ID NO: 9334 - RNA, 54 nt, Artificial Sequence
  Description of Artificial Sequence:  Enzymatic Nucleic Acid
accacaugagaaguggagaccagagaaacacacguugugguacauuaccuggua

SEQ ID NO: 9335 - RNA, 54 nt, Artificial Sequence
  Description of Artificial Sequence:  Enzymatic Nucleic Acid
gggaguucagaaggauccaccagagaaacacacguugugguacauuaccuggua

SEQ ID NO: 9336 - RNA, 54 nt, Artificial Sequence
  Description of Artificial Sequence:  Enzymatic Nucleic Acid
caucauaaagaagucguuaccagagaaacacacguugugguacauuaccuggua

SEQ ID NO: 9337 - RNA, 54 nt, Artificial Sequence
  Description of Artificial Sequence:  Enzymatic Nucleic Acid
cuagguucagaaggucucaccagagaaacacacguugugguacauuaccuggua

SEQ ID NO: 9338 - RNA, 54 nt, Artificial Sequence
  Description of Artificial Sequence:  Enzymatic Nucleic Acid
ccaaaggcagaagcuucaaccagagaaacacacguugugguacauuaccuggua

SEQ ID NO: 9339 - RNA, 54 nt, Artificial Sequence
  Description of Artificial Sequence:  Enzymatic Nucleic Acid
gguaagugagaagguuucaccagagaaacacacguugugguacauuaccuggua

SEQ ID NO: 9340 - RNA, 54 nt, Artificial Sequence
  Description of Artificial Sequence:  Enzymatic Nucleic Acid
aaauccagagaaggcugaaccagagaaacacacguugugguacauuaccuggua

SEQ ID NO: 9341 - RNA, 54 nt, Artificial Sequence
  Description of Artificial Sequence:  Enzymatic Nucleic Acid
gcuccaagagaaggaaguaccagagaaacacacguugugguacauuaccuggua

SEQ ID NO: 9342 - RNA, 54 nt, Artificial Sequence
  Description of Artificial Sequence:  Enzymatic Nucleic Acid
cacuuggaagaaguaacaaccagagaaacacacguugugguacauuaccuggua

SEQ ID NO: 9343 - RNA, 54 nt, Artificial Sequence
  Description of Artificial Sequence:  Enzymatic Nucleic Acid
cugacauaagaaggaucuaccagagaaacacacguugugguacauuaccuggua

SEQ ID NO: 9344 - RNA, 54 nt, Artificial Sequence
  Description of Artificial Sequence:  Enzymatic Nucleic Acid
guaguauaagaaggggccaccagagaaacacacguugugguacauuaccuggua

SEQ ID NO: 9345 - RNA, 54 nt, Artificial Sequence
  Description of Artificial Sequence:  Enzymatic Nucleic Acid
ccagcaugagaagguacaaccagagaaacacacguugugguacauuaccuggua

SEQ ID NO: 9346 - RNA, 54 nt, Artificial Sequence
  Description of Artificial Sequence:  Enzymatic Nucleic Acid
cccgugccagaaguccagaccagagaaacacacguugugguacauuaccuggua

SEQ ID NO: 9347 - RNA, 54 nt, Artificial Sequence
  Description of Artificial Sequence:  Enzymatic Nucleic Acid
gugagguaagaagagagaaccagagaaacacacguugugguacauuaccuggua

SEQ ID NO: 9348 - RNA, 54 nt, Artificial Sequence
  Description of Artificial Sequence:  Enzymatic Nucleic Acid
auacaggaagaaggugagaccagagaaacacacguugugguacauuaccuggua

SEQ ID NO: 9349 - RNA, 54 nt, Artificial Sequence
  Description of Artificial Sequence:  Enzymatic Nucleic Acid
cacucacaagaaggcucuaccagagaaacacacguugugguacauuaccuggua

SEQ ID NO: 9350 - RNA, 54 nt, Artificial Sequence
  Description of Artificial Sequence:  Enzymatic Nucleic Acid
ugguugucagaagggauuaccagagaaacacacguugugguacauuaccuggua

SEQ ID NO: 9351 - RNA, 54 nt, Artificial Sequence
  Description of Artificial Sequence:  Enzymatic Nucleic Acid
cacuguccagaagguuguaccagagaaacacacguugugguacauuaccuggua

SEQ ID NO: 9352 - RNA, 54 nt, Artificial Sequence
  Description of Artificial Sequence:  Enzymatic Nucleic Acid
gauauccgagaagguagcaccagagaaacacacguugugguacauuaccuggua

SEQ ID NO: 9353 - RNA, 54 nt, Artificial Sequence
  Description of Artificial Sequence:  Enzymatic Nucleic Acid
ucugugucagaagagugaaccagagaaacacacguugugguacauuaccuggua

SEQ ID NO: 9354 - RNA, 54 nt, Artificial Sequence
  Description of Artificial Sequence:  Enzymatic Nucleic Acid
agaaucugagaagugcuaaccagagaaacacacguugugguacauuaccuggua

SEQ ID NO: 9355 - RNA, 54 nt, Artificial Sequence
  Description of Artificial Sequence:  Enzymatic Nucleic Acid
gcuggagaagaagggcugaccagagaaacacacguugugguacauuaccuggua

SEQ ID NO: 9356 - RNA, 54 nt, Artificial Sequence
  Description of Artificial Sequence:  Enzymatic Nucleic Acid
ccgugucaagaaggagaaaccagagaaacacacguugugguacauuaccuggua

SEQ ID NO: 9357 - RNA, 54 nt, Artificial Sequence
  Description of Artificial Sequence:  Enzymatic Nucleic Acid
uccuuuuaagaaggaggaaccagagaaacacacguugugguacauuaccuggua

SEQ ID NO: 9358 - RNA, 54 nt, Artificial Sequence
  Description of Artificial Sequence:  Enzymatic Nucleic Acid
aaaaucugagaagaccucaccagagaaacacacguugugguacauuaccuggua

SEQ ID NO: 9359 - RNA, 54 nt, Artificial Sequence
  Description of Artificial Sequence:  Enzymatic Nucleic Acid
acuucaaaagaagagcagaccagagaaacacacguugugguacauuaccuggua

SEQ ID NO: 9360 - RNA, 54 nt, Artificial Sequence
  Description of Artificial Sequence:  Enzymatic Nucleic Acid
ucccugcaagaagaggucaccagagaaacacacguugugguacauuaccuggua

SEQ ID NO: 9361 - RNA, 54 nt, Artificial Sequence
  Description of Artificial Sequence:  Enzymatic Nucleic Acid
ccuagaagagaaggcuccaccagagaaacacacguugugguacauuaccuggua

SEQ ID NO: 9362 - RNA, 38 nt, Artificial Sequence
  Description of Artificial Sequence:  Enzymatic Nucleic Acid
ccguaccccugaugaggccguuaggccgaaauucgccc

SEQ ID NO: 9363 - RNA, 38 nt, Artificial Sequence
  Description of Artificial Sequence:  Enzymatic Nucleic Acid
gggucccgcugaugaggccguuaggccgaaacccaauu

SEQ ID NO: 9364 - RNA, 38 nt, Artificial Sequence
  Description of Artificial Sequence:  Enzymatic Nucleic Acid
ucgaccuccugaugaggccguuaggccgaaaggggggu

SEQ ID NO: 9365 - RNA, 38 nt, Artificial Sequence
  Description of Artificial Sequence:  Enzymatic Nucleic Acid
auaccguccugaugaggccguuaggccgaaaccucgag

SEQ ID NO: 9366 - RNA, 38 nt, Artificial Sequence
  Description of Artificial Sequence:  Enzymatic Nucleic Acid
cuuaucgacugaugaggccguuaggccgaaaccgucga

SEQ ID NO: 9367 - RNA, 38 nt, Artificial Sequence
  Description of Artificial Sequence:  Enzymatic Nucleic Acid
agcuuauccugaugaggccguuaggccgaaauaccguc

SEQ ID NO: 9368 - RNA, 38 nt, Artificial Sequence
  Description of Artificial Sequence:  Enzymatic Nucleic Acid
aucaagcucugaugaggccguuaggccgaaaucgauac

SEQ ID NO: 9369 - RNA, 38 nt, Artificial Sequence
  Description of Artificial Sequence:  Enzymatic Nucleic Acid
ucgauauccugaugaggccguuaggccgaaagcuuauc

SEQ ID NO: 9370 - RNA, 38 nt, Artificial Sequence
  Description of Artificial Sequence:  Enzymatic Nucleic Acid
gaauucgacugaugaggccguuaggccgaaaucaagcu

SEQ ID NO: 9371 - RNA, 38 nt, Artificial Sequence
  Description of Artificial Sequence:  Enzymatic Nucleic Acid
ccgaauuccugaugaggccguuaggccgaaauaucaag

SEQ ID NO: 9372 - RNA, 38 nt, Artificial Sequence
  Description of Artificial Sequence:  Enzymatic Nucleic Acid
ugggcccgcugaugaggccguuaggccgaaauucgaua

SEQ ID NO: 9373 - RNA, 38 nt, Artificial Sequence
  Description of Artificial Sequence:  Enzymatic Nucleic Acid
cugggccccugaugaggccguuaggccgaaaauucgau

SEQ ID NO: 9374 - RNA, 38 nt, Artificial Sequence
  Description of Artificial Sequence:  Enzymatic Nucleic Acid
ggcugcggcugaugaggccguuaggccgaaacacaguc

SEQ ID NO: 9375 - RNA, 38 nt, Artificial Sequence
  Description of Artificial Sequence:  Enzymatic Nucleic Acid
agccaggucugaugaggccguuaggccgaaaucccggc

SEQ ID NO: 9376 - RNA, 38 nt, Artificial Sequence
  Description of Artificial Sequence:  Enzymatic Nucleic Acid
guccgcggcugaugaggccguuaggccgaaaucggguc

SEQ ID NO: 9377 - RNA, 38 nt, Artificial Sequence
  Description of Artificial Sequence:  Enzymatic Nucleic Acid
uguccgcgcugaugaggccguuaggccgaaaaucgggu

SEQ ID NO: 9378 - RNA, 38 nt, Artificial Sequence
  Description of Artificial Sequence:  Enzymatic Nucleic Acid
accggggacugaugaggccguuaggccgaaagcgcggg

SEQ ID NO: 9379 - RNA, 38 nt, Artificial Sequence
  Description of Artificial Sequence:  Enzymatic Nucleic Acid
agaccgggcugaugaggccguuaggccgaaagagcgcg

SEQ ID NO: 9380 - RNA, 38 nt, Artificial Sequence
  Description of Artificial Sequence:  Enzymatic Nucleic Acid
cagcgcaacugaugaggccguuaggccgaaaccgggga

SEQ ID NO: 9381 - RNA, 38 nt, Artificial Sequence
  Description of Artificial Sequence:  Enzymatic Nucleic Acid
cgcagcgccugaugaggccguuaggccgaaagaccggg

SEQ ID NO: 9382 - RNA, 38 nt, Artificial Sequence
  Description of Artificial Sequence:  Enzymatic Nucleic Acid
agaggcggcugaugaggccguuaggccgaaauggcccc

SEQ ID NO: 9383 - RNA, 38 nt, Artificial Sequence
  Description of Artificial Sequence:  Enzymatic Nucleic Acid
aagucacacugaugaggccguuaggccgaaaggcggua

SEQ ID NO: 9384 - RNA, 38 nt, Artificial Sequence
  Description of Artificial Sequence:  Enzymatic Nucleic Acid
ccgcaaagcugaugaggccguuaggccgaaagucacag

SEQ ID NO: 9385 - RNA, 38 nt, Artificial Sequence
  Description of Artificial Sequence:  Enzymatic Nucleic Acid
cccgcaaacugaugaggccguuaggccgaaaagucaca

SEQ ID NO: 9386 - RNA, 38 nt, Artificial Sequence
  Description of Artificial Sequence:  Enzymatic Nucleic Acid
ggcccgcacugaugaggccguuaggccgaaagaaguca

SEQ ID NO: 9387 - RNA, 38 nt, Artificial Sequence
  Description of Artificial Sequence:  Enzymatic Nucleic Acid
uggcccgccugaugaggccguuaggccgaaaagaaguc

SEQ ID NO: 9388 - RNA, 38 nt, Artificial Sequence
  Description of Artificial Sequence:  Enzymatic Nucleic Acid
caggcacacugaugaggccguuaggccgaaacuccuuc

SEQ ID NO: 9389 - RNA, 38 nt, Artificial Sequence
  Description of Artificial Sequence:  Enzymatic Nucleic Acid
ugggcacacugaugaggccguuaggccgaaagcccagu

SEQ ID NO: 9390 - RNA, 38 nt, Artificial Sequence
  Description of Artificial Sequence:  Enzymatic Nucleic Acid
gcgacagccugaugaggccguuaggccgaaagcagcgc

SEQ ID NO: 9391 - RNA, 38 nt, Artificial Sequence
  Description of Artificial Sequence:  Enzymatic Nucleic Acid
cacagagccugaugaggccguuaggccgaaacagcuag

SEQ ID NO: 9392 - RNA, 38 nt, Artificial Sequence
  Description of Artificial Sequence:  Enzymatic Nucleic Acid
gaaccacacugaugaggccguuaggccgaaagcgacag

SEQ ID NO: 9393 - RNA, 38 nt, Artificial Sequence
  Description of Artificial Sequence:  Enzymatic Nucleic Acid
ccacgcagcugaugaggccguuaggccgaaaccacaga

SEQ ID NO: 9394 - RNA, 38 nt, Artificial Sequence
  Description of Artificial Sequence:  Enzymatic Nucleic Acid
uccacgcacugaugaggccguuaggccgaaaaccacag

SEQ ID NO: 9395 - RNA, 38 nt, Artificial Sequence
  Description of Artificial Sequence:  Enzymatic Nucleic Acid
aacccacacugaugaggccguuaggccgaaaggcggcu

SEQ ID NO: 9396 - RNA, 38 nt, Artificial Sequence
  Description of Artificial Sequence:  Enzymatic Nucleic Acid
gccagucacugaugaggccguuaggccgaaacccacag

SEQ ID NO: 9397 - RNA, 38 nt, Artificial Sequence
  Description of Artificial Sequence:  Enzymatic Nucleic Acid
cgccaguccugaugaggccguuaggccgaaaacccaca

SEQ ID NO: 9398 - RNA, 38 nt, Artificial Sequence
  Description of Artificial Sequence:  Enzymatic Nucleic Acid
auggagaacugaugaggccguuaggccgaaaucgccag

SEQ ID NO: 9399 - RNA, 38 nt, Artificial Sequence
  Description of Artificial Sequence:  Enzymatic Nucleic Acid
gauggagacugaugaggccguuaggccgaaaaucgcca

SEQ ID NO: 9400 - RNA, 38 nt, Artificial Sequence
  Description of Artificial Sequence:  Enzymatic Nucleic Acid
ggauggagcugaugaggccguuaggccgaaaaaucgcc

SEQ ID NO: 9401 - RNA, 38 nt, Artificial Sequence
  Description of Artificial Sequence:  Enzymatic Nucleic Acid
gggauggacugaugaggccguuaggccgaaaaaaucgc

SEQ ID NO: 9402 - RNA, 38 nt, Artificial Sequence
  Description of Artificial Sequence:  Enzymatic Nucleic Acid
gggggaugcugaugaggccguuaggccgaaagaaaauc

SEQ ID NO: 9403 - RNA, 38 nt, Artificial Sequence
  Description of Artificial Sequence:  Enzymatic Nucleic Acid
cuugggggcugaugaggccguuaggccgaaauggagaa

SEQ ID NO: 9404 - RNA, 38 nt, Artificial Sequence
  Description of Artificial Sequence:  Enzymatic Nucleic Acid
ugugugcucugaugaggccguuaggccgaaagcuuggg

SEQ ID NO: 9405 - RNA, 38 nt, Artificial Sequence
  Description of Artificial Sequence:  Enzymatic Nucleic Acid
auugucagcugaugaggccguuaggccgaaaugucuuu

SEQ ID NO: 9406 - RNA, 38 nt, Artificial Sequence
  Description of Artificial Sequence:  Enzymatic Nucleic Acid
uuugccaacugaugaggccguuaggccgaaauugucag

SEQ ID NO: 9407 - RNA, 38 nt, Artificial Sequence
  Description of Artificial Sequence:  Enzymatic Nucleic Acid
auuugccacugaugaggccguuaggccgaaaauuguca

SEQ ID NO: 9408 - RNA, 38 nt, Artificial Sequence
  Description of Artificial Sequence:  Enzymatic Nucleic Acid
uauuugcccugaugaggccguuaggccgaaaaauuguc

SEQ ID NO: 9409 - RNA, 38 nt, Artificial Sequence
  Description of Artificial Sequence:  Enzymatic Nucleic Acid
aaggguugcugaugaggccguuaggccgaaauuugcca

SEQ ID NO: 9410 - RNA, 38 nt, Artificial Sequence
  Description of Artificial Sequence:  Enzymatic Nucleic Acid
guaaucugcugaugaggccguuaggccgaaaggguugu

SEQ ID NO: 9411 - RNA, 38 nt, Artificial Sequence
  Description of Artificial Sequence:  Enzymatic Nucleic Acid
aguaaucucugaugaggccguuaggccgaaaaggguug

SEQ ID NO: 9412 - RNA, 38 nt, Artificial Sequence
  Description of Artificial Sequence:  Enzymatic Nucleic Acid
cugcaagucugaugaggccguuaggccgaaaucugaag

SEQ ID NO: 9413 - RNA, 38 nt, Artificial Sequence
  Description of Artificial Sequence:  Enzymatic Nucleic Acid
ccugcaagcugaugaggccguuaggccgaaaaucugaa

SEQ ID NO: 9414 - RNA, 38 nt, Artificial Sequence
  Description of Artificial Sequence:  Enzymatic Nucleic Acid
uccccugccugaugaggccguuaggccgaaaguaaucu

SEQ ID NO: 9415 - RNA, 38 nt, Artificial Sequence
  Description of Artificial Sequence:  Enzymatic Nucleic Acid
aucacgcucugaugaggccguuaggccgaaagcauugg

SEQ ID NO: 9416 - RNA, 38 nt, Artificial Sequence
  Description of Artificial Sequence:  Enzymatic Nucleic Acid
uuccucagcugaugaggccguuaggccgaaaucacgcu

SEQ ID NO: 9417 - RNA, 38 nt, Artificial Sequence
  Description of Artificial Sequence:  Enzymatic Nucleic Acid
uuuccucacugaugaggccguuaggccgaaaaucacgc

SEQ ID NO: 9418 - RNA, 38 nt, Artificial Sequence
  Description of Artificial Sequence:  Enzymatic Nucleic Acid
gucaccaacugaugaggccguuaggccgaaacccuuuc

SEQ ID NO: 9419 - RNA, 38 nt, Artificial Sequence
  Description of Artificial Sequence:  Enzymatic Nucleic Acid
cagucacccugaugaggccguuaggccgaaauacccuu

SEQ ID NO: 9420 - RNA, 38 nt, Artificial Sequence
  Description of Artificial Sequence:  Enzymatic Nucleic Acid
gcagaagacugaugaggccguuaggccgaaacugucac

SEQ ID NO: 9421 - RNA, 38 nt, Artificial Sequence
  Description of Artificial Sequence:  Enzymatic Nucleic Acid
uugcagaacugaugaggccguuaggccgaaauacuguc

SEQ ID NO: 9422 - RNA, 38 nt, Artificial Sequence
  Description of Artificial Sequence:  Enzymatic Nucleic Acid
uuuugcagcugaugaggccguuaggccgaaagauacug

SEQ ID NO: 9423 - RNA, 38 nt, Artificial Sequence
  Description of Artificial Sequence:  Enzymatic Nucleic Acid
guuuugcacugaugaggccguuaggccgaaaagauacu

SEQ ID NO: 9424 - RNA, 38 nt, Artificial Sequence
  Description of Artificial Sequence:  Enzymatic Nucleic Acid
ggaauggucugaugaggccguuaggccgaaaguguuuu

SEQ ID NO: 9425 - RNA, 38 nt, Artificial Sequence
  Description of Artificial Sequence:  Enzymatic Nucleic Acid
acccugggcugaugaggccguuaggccgaaauggugag

SEQ ID NO: 9426 - RNA, 38 nt, Artificial Sequence
  Description of Artificial Sequence:  Enzymatic Nucleic Acid
cacccuggcugaugaggccguuaggccgaaaaugguga

SEQ ID NO: 9427 - RNA, 38 nt, Artificial Sequence
  Description of Artificial Sequence:  Enzymatic Nucleic Acid
ucauuucccugaugaggccguuaggccgaaaccacccu

SEQ ID NO: 9428 - RNA, 38 nt, Artificial Sequence
  Description of Artificial Sequence:  Enzymatic Nucleic Acid
ggcuccagcugaugaggccguuaggccgaaaucauuuc

SEQ ID NO: 9429 - RNA, 38 nt, Artificial Sequence
  Description of Artificial Sequence:  Enzymatic Nucleic Acid
cccgguaccugaugaggccguuaggccgaaagcacuug

SEQ ID NO: 9430 - RNA, 38 nt, Artificial Sequence
  Description of Artificial Sequence:  Enzymatic Nucleic Acid
cgucccggcugaugaggccguuaggccgaaacgagcac

SEQ ID NO: 9431 - RNA, 38 nt, Artificial Sequence
  Description of Artificial Sequence:  Enzymatic Nucleic Acid
gcuauguccugaugaggccguuaggccgaaacgucccg

SEQ ID NO: 9432 - RNA, 38 nt, Artificial Sequence
  Description of Artificial Sequence:  Enzymatic Nucleic Acid
guggaggccugaugaggccguuaggccgaaaugucgac

SEQ ID NO: 9433 - RNA, 38 nt, Artificial Sequence
  Description of Artificial Sequence:  Enzymatic Nucleic Acid
aaacagugcugaugaggccguuaggccgaaaggcuaug

SEQ ID NO: 9434 - RNA, 38 nt, Artificial Sequence
  Description of Artificial Sequence:  Enzymatic Nucleic Acid
uagacauacugaugaggccguuaggccgaaacagugga

SEQ ID NO: 9435 - RNA, 38 nt, Artificial Sequence
  Description of Artificial Sequence:  Enzymatic Nucleic Acid
auagacaucugaugaggccguuaggccgaaaacagugg

SEQ ID NO: 9436 - RNA, 38 nt, Artificial Sequence
  Description of Artificial Sequence:  Enzymatic Nucleic Acid
cauagacacugaugaggccguuaggccgaaaaacagug

SEQ ID NO: 9437 - RNA, 38 nt, Artificial Sequence
  Description of Artificial Sequence:  Enzymatic Nucleic Acid
cgaacauacugaugaggccguuaggccgaaacauaaac

SEQ ID NO: 9438 - RNA, 38 nt, Artificial Sequence
  Description of Artificial Sequence:  Enzymatic Nucleic Acid
cucgaacacugaugaggccguuaggccgaaagacauaa

SEQ ID NO: 9439 - RNA, 38 nt, Artificial Sequence
  Description of Artificial Sequence:  Enzymatic Nucleic Acid
uaaucucgcugaugaggccguuaggccgaaacauagac

SEQ ID NO: 9440 - RNA, 38 nt, Artificial Sequence
  Description of Artificial Sequence:  Enzymatic Nucleic Acid
guaaucuccugaugaggccguuaggccgaaaacauaga

SEQ ID NO: 9441 - RNA, 38 nt, Artificial Sequence
  Description of Artificial Sequence:  Enzymatic Nucleic Acid
ugaucugucugaugaggccguuaggccgaaaucucgaa

SEQ ID NO: 9442 - RNA, 38 nt, Artificial Sequence
  Description of Artificial Sequence:  Enzymatic Nucleic Acid
gugaucugcugaugaggccguuaggccgaaaaucucga

SEQ ID NO: 9443 - RNA, 38 nt, Artificial Sequence
  Description of Artificial Sequence:  Enzymatic Nucleic Acid
ugaauggucugaugaggccguuaggccgaaaucuguaa

SEQ ID NO: 9444 - RNA, 38 nt, Artificial Sequence
  Description of Artificial Sequence:  Enzymatic Nucleic Acid
aggcgaugcugaugaggccguuaggccgaaauggugau

SEQ ID NO: 9445 - RNA, 38 nt, Artificial Sequence
  Description of Artificial Sequence:  Enzymatic Nucleic Acid
gaggcgaucugaugaggccguuaggccgaaaaugguga

SEQ ID NO: 9446 - RNA, 38 nt, Artificial Sequence
  Description of Artificial Sequence:  Enzymatic Nucleic Acid
acagaggccugaugaggccguuaggccgaaaugaaugg

SEQ ID NO: 9447 - RNA, 38 nt, Artificial Sequence
  Description of Artificial Sequence:  Enzymatic Nucleic Acid
cacugacacugaugaggccguuaggccgaaaggcgaug

SEQ ID NO: 9448 - RNA, 38 nt, Artificial Sequence
  Description of Artificial Sequence:  Enzymatic Nucleic Acid
uggucacucugaugaggccguuaggccgaaacagaggc

SEQ ID NO: 9449 - RNA, 38 nt, Artificial Sequence
  Description of Artificial Sequence:  Enzymatic Nucleic Acid
auguacaccugaugaggccguuaggccgaaaugccaug

SEQ ID NO: 9450 - RNA, 38 nt, Artificial Sequence
  Description of Artificial Sequence:  Enzymatic Nucleic Acid
cggugaugcugaugaggccguuaggccgaaacacgaug

SEQ ID NO: 9451 - RNA, 38 nt, Artificial Sequence
  Description of Artificial Sequence:  Enzymatic Nucleic Acid
uucucggucugaugaggccguuaggccgaaauguacac

SEQ ID NO: 9452 - RNA, 38 nt, Artificial Sequence
  Description of Artificial Sequence:  Enzymatic Nucleic Acid
cggcagggcugaugaggccguuaggccgaaaucaccac

SEQ ID NO: 9453 - RNA, 38 nt, Artificial Sequence
  Description of Artificial Sequence:  Enzymatic Nucleic Acid
uugaaauccugaugaggccguuaggccgaaacccucgg

SEQ ID NO: 9454 - RNA, 38 nt, Artificial Sequence
  Description of Artificial Sequence:  Enzymatic Nucleic Acid
agguuugacugaugaggccguuaggccgaaaucgaccc

SEQ ID NO: 9455 - RNA, 38 nt, Artificial Sequence
  Description of Artificial Sequence:  Enzymatic Nucleic Acid
gagguuugcugaugaggccguuaggccgaaaaucgacc

SEQ ID NO: 9456 - RNA, 38 nt, Artificial Sequence
  Description of Artificial Sequence:  Enzymatic Nucleic Acid
ugagguuucugaugaggccguuaggccgaaaaaucgac

SEQ ID NO: 9457 - RNA, 38 nt, Artificial Sequence
  Description of Artificial Sequence:  Enzymatic Nucleic Acid
gacacauucugaugaggccguuaggccgaaagguuuga

SEQ ID NO: 9458 - RNA, 38 nt, Artificial Sequence
  Description of Artificial Sequence:  Enzymatic Nucleic Acid
cgcaaagacugaugaggccguuaggccgaaacacauug

SEQ ID NO: 9459 - RNA, 38 nt, Artificial Sequence
  Description of Artificial Sequence:  Enzymatic Nucleic Acid
agcgcaaacugaugaggccguuaggccgaaagacacau

SEQ ID NO: 9460 - RNA, 38 nt, Artificial Sequence
  Description of Artificial Sequence:  Enzymatic Nucleic Acid
cuagcgcacugaugaggccguuaggccgaaagagacac

SEQ ID NO: 9461 - RNA, 38 nt, Artificial Sequence
  Description of Artificial Sequence:  Enzymatic Nucleic Acid
ccuagcgccugaugaggccguuaggccgaaaagagaca

SEQ ID NO: 9462 - RNA, 38 nt, Artificial Sequence
  Description of Artificial Sequence:  Enzymatic Nucleic Acid
uggauacccugaugaggccguuaggccgaaagcgcaaa

SEQ ID NO: 9463 - RNA, 38 nt, Artificial Sequence
  Description of Artificial Sequence:  Enzymatic Nucleic Acid
uuucuggacugaugaggccguuaggccgaaaccuagcg

SEQ ID NO: 9464 - RNA, 38 nt, Artificial Sequence
  Description of Artificial Sequence:  Enzymatic Nucleic Acid
cuuuucugcugaugaggccguuaggccgaaauaccuag

SEQ ID NO: 9465 - RNA, 38 nt, Artificial Sequence
  Description of Artificial Sequence:  Enzymatic Nucleic Acid
ccggaacacugaugaggccguuaggccgaaaucucuuu

SEQ ID NO: 9466 - RNA, 38 nt, Artificial Sequence
  Description of Artificial Sequence:  Enzymatic Nucleic Acid
uccggaaccugaugaggccguuaggccgaaaaucucuu

SEQ ID NO: 9467 - RNA, 38 nt, Artificial Sequence
  Description of Artificial Sequence:  Enzymatic Nucleic Acid
ccauccggcugaugaggccguuaggccgaaacaaaucu

SEQ ID NO: 9468 - RNA, 38 nt, Artificial Sequence
  Description of Artificial Sequence:  Enzymatic Nucleic Acid
uccauccgcugaugaggccguuaggccgaaaacaaauc

SEQ ID NO: 9469 - RNA, 38 nt, Artificial Sequence
  Description of Artificial Sequence:  Enzymatic Nucleic Acid
guaaagcccugaugaggccguuaggccgaaaucucgcu

SEQ ID NO: 9470 - RNA, 38 nt, Artificial Sequence
  Description of Artificial Sequence:  Enzymatic Nucleic Acid
ggagaguacugaugaggccguuaggccgaaagccuauc

SEQ ID NO: 9471 - RNA, 38 nt, Artificial Sequence
  Description of Artificial Sequence:  Enzymatic Nucleic Acid
gggagagucugaugaggccguuaggccgaaaagccuau

SEQ ID NO: 9472 - RNA, 38 nt, Artificial Sequence
  Description of Artificial Sequence:  Enzymatic Nucleic Acid
ggggagagcugaugaggccguuaggccgaaaaagccua

SEQ ID NO: 9473 - RNA, 38 nt, Artificial Sequence
  Description of Artificial Sequence:  Enzymatic Nucleic Acid
acuggggacugaugaggccguuaggccgaaaguaaagc

SEQ ID NO: 9474 - RNA, 38 nt, Artificial Sequence
  Description of Artificial Sequence:  Enzymatic Nucleic Acid
uaacugggcugaugaggccguuaggccgaaagaguaaa

SEQ ID NO: 9475 - RNA, 38 nt, Artificial Sequence
  Description of Artificial Sequence:  Enzymatic Nucleic Acid
gaucaugucugaugaggccguuaggccgaaacugggga

SEQ ID NO: 9476 - RNA, 38 nt, Artificial Sequence
  Description of Artificial Sequence:  Enzymatic Nucleic Acid
ugaucaugcugaugaggccguuaggccgaaaacugggg

SEQ ID NO: 9477 - RNA, 38 nt, Artificial Sequence
  Description of Artificial Sequence:  Enzymatic Nucleic Acid
ugccggcacugaugaggccguuaggccgaaagcugauc

SEQ ID NO: 9478 - RNA, 38 nt, Artificial Sequence
  Description of Artificial Sequence:  Enzymatic Nucleic Acid
ccucacagcugaugaggccguuaggccgaaagaccaug

SEQ ID NO: 9479 - RNA, 38 nt, Artificial Sequence
  Description of Artificial Sequence:  Enzymatic Nucleic Acid
gccucacacugaugaggccguuaggccgaaaagaccau

SEQ ID NO: 9480 - RNA, 38 nt, Artificial Sequence
  Description of Artificial Sequence:  Enzymatic Nucleic Acid
ucaucauucugaugaggccguuaggccgaaaucuuugc

SEQ ID NO: 9481 - RNA, 38 nt, Artificial Sequence
  Description of Artificial Sequence:  Enzymatic Nucleic Acid
uagacugacugaugaggccguuaggccgaaagguuuca

SEQ ID NO: 9482 - RNA, 38 nt, Artificial Sequence
  Description of Artificial Sequence:  Enzymatic Nucleic Acid
gauagacucugaugaggccguuaggccgaaauagguuu

SEQ ID NO: 9483 - RNA, 38 nt, Artificial Sequence
  Description of Artificial Sequence:  Enzymatic Nucleic Acid
acaugauacugaugaggccguuaggccgaaacugauag

SEQ ID NO: 9484 - RNA, 38 nt, Artificial Sequence
  Description of Artificial Sequence:  Enzymatic Nucleic Acid
guacaugacugaugaggccguuaggccgaaagacugau

SEQ ID NO: 9485 - RNA, 38 nt, Artificial Sequence
  Description of Artificial Sequence:  Enzymatic Nucleic Acid
caacuaugcugaugaggccguuaggccgaaacaugaua

SEQ ID NO: 9486 - RNA, 38 nt, Artificial Sequence
  Description of Artificial Sequence:  Enzymatic Nucleic Acid
accacaaccugaugaggccguuaggccgaaauguacau

SEQ ID NO: 9487 - RNA, 38 nt, Artificial Sequence
  Description of Artificial Sequence:  Enzymatic Nucleic Acid
acaaccaccugaugaggccguuaggccgaaacuaugua

SEQ ID NO: 9488 - RNA, 38 nt, Artificial Sequence
  Description of Artificial Sequence:  Enzymatic Nucleic Acid
uauccuaccugaugaggccguuaggccgaaaccacaac

SEQ ID NO: 9489 - RNA, 38 nt, Artificial Sequence
  Description of Artificial Sequence:  Enzymatic Nucleic Acid
cuauaucccugaugaggccguuaggccgaaacaaccac

SEQ ID NO: 9490 - RNA, 38 nt, Artificial Sequence
  Description of Artificial Sequence:  Enzymatic Nucleic Acid
aaauccuacugaugaggccguuaggccgaaauccuaca

SEQ ID NO: 9491 - RNA, 38 nt, Artificial Sequence
  Description of Artificial Sequence:  Enzymatic Nucleic Acid
auaaaucccugaugaggccguuaggccgaaauauccua

SEQ ID NO: 9492 - RNA, 38 nt, Artificial Sequence
  Description of Artificial Sequence:  Enzymatic Nucleic Acid
ucacaucacugaugaggccguuaggccgaaaaauccua

SEQ ID NO: 9493 - RNA, 38 nt, Artificial Sequence
  Description of Artificial Sequence:  Enzymatic Nucleic Acid
gggcucagcugaugaggccguuaggccgaaaucacauc

SEQ ID NO: 9494 - RNA, 38 nt, Artificial Sequence
  Description of Artificial Sequence:  Enzymatic Nucleic Acid
ggggcucacugaugaggccguuaggccgaaaaucacau

SEQ ID NO: 9495 - RNA, 38 nt, Artificial Sequence
  Description of Artificial Sequence:  Enzymatic Nucleic Acid
gauagcuccugaugaggccguuaggccgaaauuucaug

SEQ ID NO: 9496 - RNA, 38 nt, Artificial Sequence
  Description of Artificial Sequence:  Enzymatic Nucleic Acid
ccggcagacugaugaggccguuaggccgaaagcucaau

SEQ ID NO: 9497 - RNA, 38 nt, Artificial Sequence
  Description of Artificial Sequence:  Enzymatic Nucleic Acid
cuccggcacugaugaggccguuaggccgaaauagcuca

SEQ ID NO: 9498 - RNA, 38 nt, Artificial Sequence
  Description of Artificial Sequence:  Enzymatic Nucleic Acid
uuuaagaccugaugaggccguuaggccgaaaguuuuuc

SEQ ID NO: 9499 - RNA, 38 nt, Artificial Sequence
  Description of Artificial Sequence:  Enzymatic Nucleic Acid
caauuuaacugaugaggccguuaggccgaaacaaguuu

SEQ ID NO: 9500 - RNA, 38 nt, Artificial Sequence
  Description of Artificial Sequence:  Enzymatic Nucleic Acid
uacaauuucugaugaggccguuaggccgaaagacaagu

SEQ ID NO: 9501 - RNA, 38 nt, Artificial Sequence
  Description of Artificial Sequence:  Enzymatic Nucleic Acid
cgcuguaccugaugaggccguuaggccgaaauuuaaga

SEQ ID NO: 9502 - RNA, 38 nt, Artificial Sequence
  Description of Artificial Sequence:  Enzymatic Nucleic Acid
ucucgcugcugaugaggccguuaggccgaaacaauuua

SEQ ID NO: 9503 - RNA, 38 nt, Artificial Sequence
  Description of Artificial Sequence:  Enzymatic Nucleic Acid
cccacauucugaugaggccguuaggccgaaagcucugu

SEQ ID NO: 9504 - RNA, 38 nt, Artificial Sequence
  Description of Artificial Sequence:  Enzymatic Nucleic Acid
gugaaauccugaugaggccguuaggccgaaagccccac

SEQ ID NO: 9505 - RNA, 38 nt, Artificial Sequence
  Description of Artificial Sequence:  Enzymatic Nucleic Acid
ccaggugacugaugaggccguuaggccgaaaucaagcc

SEQ ID NO: 9506 - RNA, 38 nt, Artificial Sequence
  Description of Artificial Sequence:  Enzymatic Nucleic Acid
gccaggugcugaugaggccguuaggccgaaaaucaagc

SEQ ID NO: 9507 - RNA, 38 nt, Artificial Sequence
  Description of Artificial Sequence:  Enzymatic Nucleic Acid
ugccaggucugaugaggccguuaggccgaaaaaucaag

SEQ ID NO: 9508 - RNA, 38 nt, Artificial Sequence
  Description of Artificial Sequence:  Enzymatic Nucleic Acid
aagguggacugaugaggccguuaggccgaaagugccag

SEQ ID NO: 9509 - RNA, 38 nt, Artificial Sequence
  Description of Artificial Sequence:  Enzymatic Nucleic Acid
ugaaggugcugaugaggccguuaggccgaaagagugcc

SEQ ID NO: 9510 - RNA, 38 nt, Artificial Sequence
  Description of Artificial Sequence:  Enzymatic Nucleic Acid
agacuuugcugaugaggccguuaggccgaaagguggag

SEQ ID NO: 9511 - RNA, 38 nt, Artificial Sequence
  Description of Artificial Sequence:  Enzymatic Nucleic Acid
gagacuuucugaugaggccguuaggccgaaaaggugga

SEQ ID NO: 9512 - RNA, 38 nt, Artificial Sequence
  Description of Artificial Sequence:  Enzymatic Nucleic Acid
uaugaugacugaugaggccguuaggccgaaacuuugaa

SEQ ID NO: 9513 - RNA, 38 nt, Artificial Sequence
  Description of Artificial Sequence:  Enzymatic Nucleic Acid
cuuaugaucugaugaggccguuaggccgaaagacuuug

SEQ ID NO: 9514 - RNA, 38 nt, Artificial Sequence
  Description of Artificial Sequence:  Enzymatic Nucleic Acid
cuucuuaucugaugaggccguuaggccgaaaugagacu

SEQ ID NO: 9515 - RNA, 38 nt, Artificial Sequence
  Description of Artificial Sequence:  Enzymatic Nucleic Acid
aaucuucucugaugaggccguuaggccgaaaugaugag

SEQ ID NO: 9516 - RNA, 38 nt, Artificial Sequence
  Description of Artificial Sequence:  Enzymatic Nucleic Acid
cgguuuaccugaugaggccguuaggccgaaaucuucuu

SEQ ID NO: 9517 - RNA, 38 nt, Artificial Sequence
  Description of Artificial Sequence:  Enzymatic Nucleic Acid
ucccgguucugaugaggccguuaggccgaaacaaucuu

SEQ ID NO: 9518 - RNA, 38 nt, Artificial Sequence
  Description of Artificial Sequence:  Enzymatic Nucleic Acid
ucccaggacugaugaggccguuaggccgaaaggguuuc

SEQ ID NO: 9519 - RNA, 38 nt, Artificial Sequence
  Description of Artificial Sequence:  Enzymatic Nucleic Acid
gucccaggcugaugaggccguuaggccgaaaaggguuu

SEQ ID NO: 9520 - RNA, 38 nt, Artificial Sequence
  Description of Artificial Sequence:  Enzymatic Nucleic Acid
agucccagcugaugaggccguuaggccgaaaaaggguu

SEQ ID NO: 9521 - RNA, 38 nt, Artificial Sequence
  Description of Artificial Sequence:  Enzymatic Nucleic Acid
ugcucaaacugaugaggccguuaggccgaaacaucuuc

SEQ ID NO: 9522 - RNA, 38 nt, Artificial Sequence
  Description of Artificial Sequence:  Enzymatic Nucleic Acid
gugcucaacugaugaggccguuaggccgaaaacaucuu

SEQ ID NO: 9523 - RNA, 38 nt, Artificial Sequence
  Description of Artificial Sequence:  Enzymatic Nucleic Acid
ggugcucacugaugaggccguuaggccgaaaaacaucu

SEQ ID NO: 9524 - RNA, 38 nt, Artificial Sequence
  Description of Artificial Sequence:  Enzymatic Nucleic Acid
aggugcuccugaugaggccguuaggccgaaaaaacauc

SEQ ID NO: 9525 - RNA, 38 nt, Artificial Sequence
  Description of Artificial Sequence:  Enzymatic Nucleic Acid
cuauuguccugaugaggccguuaggccgaaaggugcuc

SEQ ID NO: 9526 - RNA, 38 nt, Artificial Sequence
  Description of Artificial Sequence:  Enzymatic Nucleic Acid
acacuuuccugaugaggccguuaggccgaaauugucaa

SEQ ID NO: 9527 - RNA, 38 nt, Artificial Sequence
  Description of Artificial Sequence:  Enzymatic Nucleic Acid
cacaggugcugaugaggccguuaggccgaaauuccccu

SEQ ID NO: 9528 - RNA, 38 nt, Artificial Sequence
  Description of Artificial Sequence:  Enzymatic Nucleic Acid
cuggacgccugaugaggccguuaggccgaaacacaggu

SEQ ID NO: 9529 - RNA, 38 nt, Artificial Sequence
  Description of Artificial Sequence:  Enzymatic Nucleic Acid
guccacugcugaugaggccguuaggccgaaacgcuaca

SEQ ID NO: 9530 - RNA, 38 nt, Artificial Sequence
  Description of Artificial Sequence:  Enzymatic Nucleic Acid
uuucucuucugaugaggccguuaggccgaaaucauccg

SEQ ID NO: 9531 - RNA, 38 nt, Artificial Sequence
  Description of Artificial Sequence:  Enzymatic Nucleic Acid
aaauguuccugaugaggccguuaggccgaaauuucucu

SEQ ID NO: 9532 - RNA, 38 nt, Artificial Sequence
  Description of Artificial Sequence:  Enzymatic Nucleic Acid
cucggacacugaugaggccguuaggccgaaauguucua

SEQ ID NO: 9533 - RNA, 38 nt, Artificial Sequence
  Description of Artificial Sequence:  Enzymatic Nucleic Acid
acucggaccugaugaggccguuaggccgaaaauguucu

SEQ ID NO: 9534 - RNA, 38 nt, Artificial Sequence
  Description of Artificial Sequence:  Enzymatic Nucleic Acid
ugaacucgcugaugaggccguuaggccgaaacaaaugu

SEQ ID NO: 9535 - RNA, 38 nt, Artificial Sequence
  Description of Artificial Sequence:  Enzymatic Nucleic Acid
uuugugugcugaugaggccguuaggccgaaacucggac

SEQ ID NO: 9536 - RNA, 38 nt, Artificial Sequence
  Description of Artificial Sequence:  Enzymatic Nucleic Acid
cuuugugucugaugaggccguuaggccgaaaacucgga

SEQ ID NO: 9537 - RNA, 38 nt, Artificial Sequence
  Description of Artificial Sequence:  Enzymatic Nucleic Acid
agcaauaacugaugaggccguuaggccgaaaggcuuug

SEQ ID NO: 9538 - RNA, 38 nt, Artificial Sequence
  Description of Artificial Sequence:  Enzymatic Nucleic Acid
aagcaauacugaugaggccguuaggccgaaaaggcuuu

SEQ ID NO: 9539 - RNA, 38 nt, Artificial Sequence
  Description of Artificial Sequence:  Enzymatic Nucleic Acid
aaagcaaucugaugaggccguuaggccgaaaaaggcuu

SEQ ID NO: 9540 - RNA, 38 nt, Artificial Sequence
  Description of Artificial Sequence:  Enzymatic Nucleic Acid
gaaagcaacugaugaggccguuaggccgaaaaaaggcu

SEQ ID NO: 9541 - RNA, 38 nt, Artificial Sequence
  Description of Artificial Sequence:  Enzymatic Nucleic Acid
ccgaaagccugaugaggccguuaggccgaaauaaaagg

SEQ ID NO: 9542 - RNA, 38 nt, Artificial Sequence
  Description of Artificial Sequence:  Enzymatic Nucleic Acid
acuaccgacugaugaggccguuaggccgaaagcaauaa

SEQ ID NO: 9543 - RNA, 38 nt, Artificial Sequence
  Description of Artificial Sequence:  Enzymatic Nucleic Acid
cacuaccgcugaugaggccguuaggccgaaaagcaaua

SEQ ID NO: 9544 - RNA, 38 nt, Artificial Sequence
  Description of Artificial Sequence:  Enzymatic Nucleic Acid
ccacuacccugaugaggccguuaggccgaaaaagcaau

SEQ ID NO: 9545 - RNA, 38 nt, Artificial Sequence
  Description of Artificial Sequence:  Enzymatic Nucleic Acid
caucccaccugaugaggccguuaggccgaaaccgaaag

SEQ ID NO: 9546 - RNA, 38 nt, Artificial Sequence
  Description of Artificial Sequence:  Enzymatic Nucleic Acid
ccaccaaacugaugaggccguuaggccgaaauuucauc

SEQ ID NO: 9547 - RNA, 38 nt, Artificial Sequence
  Description of Artificial Sequence:  Enzymatic Nucleic Acid
uuccaccacugaugaggccguuaggccgaaagauuuca

SEQ ID NO: 9548 - RNA, 38 nt, Artificial Sequence
  Description of Artificial Sequence:  Enzymatic Nucleic Acid
cuuccacccugaugaggccguuaggccgaaaagauuuc

SEQ ID NO: 9549 - RNA, 38 nt, Artificial Sequence
  Description of Artificial Sequence:  Enzymatic Nucleic Acid
ucggacuucugaugaggccguuaggccgaaacugccca

SEQ ID NO: 9550 - RNA, 38 nt, Artificial Sequence
  Description of Artificial Sequence:  Enzymatic Nucleic Acid
gggauucgcugaugaggccguuaggccgaaacuugacu

SEQ ID NO: 9551 - RNA, 38 nt, Artificial Sequence
  Description of Artificial Sequence:  Enzymatic Nucleic Acid
uucacaggcugaugaggccguuaggccgaaauucggac

SEQ ID NO: 9552 - RNA, 38 nt, Artificial Sequence
  Description of Artificial Sequence:  Enzymatic Nucleic Acid
aacugagacugaugaggccguuaggccgaaacuucaca

SEQ ID NO: 9553 - RNA, 38 nt, Artificial Sequence
  Description of Artificial Sequence:  Enzymatic Nucleic Acid
guaacugacugaugaggccguuaggccgaaauacuuca

SEQ ID NO: 9554 - RNA, 38 nt, Artificial Sequence
  Description of Artificial Sequence:  Enzymatic Nucleic Acid
ggguaacucugaugaggccguuaggccgaaagauacuu

SEQ ID NO: 9555 - RNA, 38 nt, Artificial Sequence
  Description of Artificial Sequence:  Enzymatic Nucleic Acid
agcugggucugaugaggccguuaggccgaaacugagau

SEQ ID NO: 9556 - RNA, 38 nt, Artificial Sequence
  Description of Artificial Sequence:  Enzymatic Nucleic Acid
gagcugggcugaugaggccguuaggccgaaaacugaga

SEQ ID NO: 9557 - RNA, 38 nt, Artificial Sequence
  Description of Artificial Sequence:  Enzymatic Nucleic Acid
gauaucagcugaugaggccguuaggccgaaagcugggu

SEQ ID NO: 9558 - RNA, 38 nt, Artificial Sequence
  Description of Artificial Sequence:  Enzymatic Nucleic Acid
ccauuugacugaugaggccguuaggccgaaaucaggag

SEQ ID NO: 9559 - RNA, 38 nt, Artificial Sequence
  Description of Artificial Sequence:  Enzymatic Nucleic Acid
uaccauuucugaugaggccguuaggccgaaauaucagg

SEQ ID NO: 9560 - RNA, 38 nt, Artificial Sequence
  Description of Artificial Sequence:  Enzymatic Nucleic Acid
cauuucugcugaugaggccguuaggccgaaaccauuug

SEQ ID NO: 9561 - RNA, 38 nt, Artificial Sequence
  Description of Artificial Sequence:  Enzymatic Nucleic Acid
uuggacuccugaugaggccguuaggccgaaaugggccu

SEQ ID NO: 9562 - RNA, 38 nt, Artificial Sequence
  Description of Artificial Sequence:  Enzymatic Nucleic Acid
uguaguugcugaugaggccguuaggccgaaacucaaug

SEQ ID NO: 9563 - RNA, 38 nt, Artificial Sequence
  Description of Artificial Sequence:  Enzymatic Nucleic Acid
ucauugugcugaugaggccguuaggccgaaaguuggac

SEQ ID NO: 9564 - RNA, 38 nt, Artificial Sequence
  Description of Artificial Sequence:  Enzymatic Nucleic Acid
ucgccaaccugaugaggccguuaggccgaaaucauugu

SEQ ID NO: 9565 - RNA, 38 nt, Artificial Sequence
  Description of Artificial Sequence:  Enzymatic Nucleic Acid
ucaucgcccugaugaggccguuaggccgaaacaaucau

SEQ ID NO: 9566 - RNA, 38 nt, Artificial Sequence
  Description of Artificial Sequence:  Enzymatic Nucleic Acid
augauggucugaugaggccguuaggccgaaaguucauc

SEQ ID NO: 9567 - RNA, 38 nt, Artificial Sequence
  Description of Artificial Sequence:  Enzymatic Nucleic Acid
acuuccaucugaugaggccguuaggccgaaauggugag

SEQ ID NO: 9568 - RNA, 38 nt, Artificial Sequence
  Description of Artificial Sequence:  Enzymatic Nucleic Acid
ugaccgugcugaugaggccguuaggccgaaaguuuccu

SEQ ID NO: 9569 - RNA, 38 nt, Artificial Sequence
  Description of Artificial Sequence:  Enzymatic Nucleic Acid
gugaggaucugaugaggccguuaggccgaaaccgugua

SEQ ID NO: 9570 - RNA, 38 nt, Artificial Sequence
  Description of Artificial Sequence:  Enzymatic Nucleic Acid
uuggugagcugaugaggccguuaggccgaaaugaccgu

SEQ ID NO: 9571 - RNA, 38 nt, Artificial Sequence
  Description of Artificial Sequence:  Enzymatic Nucleic Acid
ggguuggucugaugaggccguuaggccgaaaggaugac

SEQ ID NO: 9572 - RNA, 38 nt, Artificial Sequence
  Description of Artificial Sequence:  Enzymatic Nucleic Acid
uccauugacugaugaggccguuaggccgaaaugggguu

SEQ ID NO: 9573 - RNA, 38 nt, Artificial Sequence
  Description of Artificial Sequence:  Enzymatic Nucleic Acid
cuccauugcugaugaggccguuaggccgaaaauggggu

SEQ ID NO: 9574 - RNA, 38 nt, Artificial Sequence
  Description of Artificial Sequence:  Enzymatic Nucleic Acid
ucuccauucugaugaggccguuaggccgaaaaaugggg

SEQ ID NO: 9575 - RNA, 38 nt, Artificial Sequence
  Description of Artificial Sequence:  Enzymatic Nucleic Acid
accagagacugaugaggccguuaggccgaaaccaugug

SEQ ID NO: 9576 - RNA, 38 nt, Artificial Sequence
  Description of Artificial Sequence:  Enzymatic Nucleic Acid
caaccagacugaugaggccguuaggccgaaagaccaug

SEQ ID NO: 9577 - RNA, 38 nt, Artificial Sequence
  Description of Artificial Sequence:  Enzymatic Nucleic Acid
acauucaccugaugaggccguuaggccgaaaccagaga

SEQ ID NO: 9578 - RNA, 38 nt, Artificial Sequence
  Description of Artificial Sequence:  Enzymatic Nucleic Acid
ugggguggcugaugaggccguuaggccgaaacauucac

SEQ ID NO: 9579 - RNA, 38 nt, Artificial Sequence
  Description of Artificial Sequence:  Enzymatic Nucleic Acid
gcgagauccugaugaggccguuaggccgaaaggcuuuc

SEQ ID NO: 9580 - RNA, 38 nt, Artificial Sequence
  Description of Artificial Sequence:  Enzymatic Nucleic Acid
auaggcgacugaugaggccguuaggccgaaaucaaggc

SEQ ID NO: 9581 - RNA, 38 nt, Artificial Sequence
  Description of Artificial Sequence:  Enzymatic Nucleic Acid
ccauaggccugaugaggccguuaggccgaaagaucaag

SEQ ID NO: 9582 - RNA, 38 nt, Artificial Sequence
  Description of Artificial Sequence:  Enzymatic Nucleic Acid
ggaauccacugaugaggccguuaggccgaaaggcgaga

SEQ ID NO: 9583 - RNA, 38 nt, Artificial Sequence
  Description of Artificial Sequence:  Enzymatic Nucleic Acid
cugguaggcugaugaggccguuaggccgaaauccauag

SEQ ID NO: 9584 - RNA, 38 nt, Artificial Sequence
  Description of Artificial Sequence:  Enzymatic Nucleic Acid
acugguagcugaugaggccguuaggccgaaaauccaua

SEQ ID NO: 9585 - RNA, 38 nt, Artificial Sequence
  Description of Artificial Sequence:  Enzymatic Nucleic Acid
cauacuggcugaugaggccguuaggccgaaaggaaucc

SEQ ID NO: 9586 - RNA, 38 nt, Artificial Sequence
  Description of Artificial Sequence:  Enzymatic Nucleic Acid
uggucccacugaugaggccguuaggccgaaacugguag

SEQ ID NO: 9587 - RNA, 38 nt, Artificial Sequence
  Description of Artificial Sequence:  Enzymatic Nucleic Acid
ugcauguccugaugaggccguuaggccgaaaugucugc

SEQ ID NO: 9588 - RNA, 38 nt, Artificial Sequence
  Description of Artificial Sequence:  Enzymatic Nucleic Acid
uuggcguacugaugaggccguuaggccgaaacugugca

SEQ ID NO: 9589 - RNA, 38 nt, Artificial Sequence
  Description of Artificial Sequence:  Enzymatic Nucleic Acid
gguuggcgcugaugaggccguuaggccgaaagacugug

SEQ ID NO: 9590 - RNA, 38 nt, Artificial Sequence
  Description of Artificial Sequence:  Enzymatic Nucleic Acid
gugcagggcugaugaggccguuaggccgaaaggguugg

SEQ ID NO: 9591 - RNA, 38 nt, Artificial Sequence
  Description of Artificial Sequence:  Enzymatic Nucleic Acid
uaccacugcugaugaggccguuaggccgaaauguggug

SEQ ID NO: 9592 - RNA, 38 nt, Artificial Sequence
  Description of Artificial Sequence:  Enzymatic Nucleic Acid
gcugccagcugaugaggccguuaggccgaaaccacugg

SEQ ID NO: 9593 - RNA, 38 nt, Artificial Sequence
  Description of Artificial Sequence:  Enzymatic Nucleic Acid
gcuucuuccugaugaggccguuaggccgaaagcugcca

SEQ ID NO: 9594 - RNA, 38 nt, Artificial Sequence
  Description of Artificial Sequence:  Enzymatic Nucleic Acid
gucuguagcugaugaggccguuaggccgaaagcaggcu

SEQ ID NO: 9595 - RNA, 38 nt, Artificial Sequence
  Description of Artificial Sequence:  Enzymatic Nucleic Acid
cgggucugcugaugaggccguuaggccgaaaggagcag

SEQ ID NO: 9596 - RNA, 38 nt, Artificial Sequence
  Description of Artificial Sequence:  Enzymatic Nucleic Acid
uacaagcacugaugaggccguuaggccgaaacgggcuu

SEQ ID NO: 9597 - RNA, 38 nt, Artificial Sequence
  Description of Artificial Sequence:  Enzymatic Nucleic Acid
uucuuuaccugaugaggccguuaggccgaaagcauacg

SEQ ID NO: 9598 - RNA, 38 nt, Artificial Sequence
  Description of Artificial Sequence:  Enzymatic Nucleic Acid
ccauucuucugaugaggccguuaggccgaaacaagcau

SEQ ID NO: 9599 - RNA, 38 nt, Artificial Sequence
  Description of Artificial Sequence:  Enzymatic Nucleic Acid
ccccuggacugaugaggccguuaggccgaaauccucca

SEQ ID NO: 9600 - RNA, 38 nt, Artificial Sequence
  Description of Artificial Sequence:  Enzymatic Nucleic Acid
cccccuggcugaugaggccguuaggccgaaaauccucc

SEQ ID NO: 9601 - RNA, 38 nt, Artificial Sequence
  Description of Artificial Sequence:  Enzymatic Nucleic Acid
ccccccugcugaugaggccguuaggccgaaaaauccuc

SEQ ID NO: 9602 - RNA, 38 nt, Artificial Sequence
  Description of Artificial Sequence:  Enzymatic Nucleic Acid
gugacuuccugaugaggccguuaggccgaaaucuuguu

SEQ ID NO: 9603 - RNA, 38 nt, Artificial Sequence
  Description of Artificial Sequence:  Enzymatic Nucleic Acid
uuuuuggucugaugaggccguuaggccgaaacuucgau

SEQ ID NO: 9604 - RNA, 38 nt, Artificial Sequence
  Description of Artificial Sequence:  Enzymatic Nucleic Acid
ucagggcacugaugaggccguuaggccgaaauugguuu

SEQ ID NO: 9605 - RNA, 38 nt, Artificial Sequence
  Description of Artificial Sequence:  Enzymatic Nucleic Acid
uuuccuuccugaugaggccguuaggccgaaaucagggc

SEQ ID NO: 9606 - RNA, 38 nt, Artificial Sequence
  Description of Artificial Sequence:  Enzymatic Nucleic Acid
agcguacucugaugaggccguuaggccgaaacaguuuu

SEQ ID NO: 9607 - RNA, 38 nt, Artificial Sequence
  Description of Artificial Sequence:  Enzymatic Nucleic Acid
gaccagcgcugaugaggccguuaggccgaaacuuacag

SEQ ID NO: 9608 - RNA, 38 nt, Artificial Sequence
  Description of Artificial Sequence:  Enzymatic Nucleic Acid
gcuuggaucugaugaggccguuaggccgaaaccagcgu

SEQ ID NO: 9609 - RNA, 38 nt, Artificial Sequence
  Description of Artificial Sequence:  Enzymatic Nucleic Acid
gcagcuugcugaugaggccguuaggccgaaaugaccag

SEQ ID NO: 9610 - RNA, 38 nt, Artificial Sequence
  Description of Artificial Sequence:  Enzymatic Nucleic Acid
acaacgcucugaugaggccguuaggccgaaacacguug

SEQ ID NO: 9611 - RNA, 38 nt, Artificial Sequence
  Description of Artificial Sequence:  Enzymatic Nucleic Acid
auuuguaccugaugaggccguuaggccgaaacgcugac

SEQ ID NO: 9612 - RNA, 38 nt, Artificial Sequence
  Description of Artificial Sequence:  Enzymatic Nucleic Acid
cacauuugcugaugaggccguuaggccgaaacaacgcu

SEQ ID NO: 9613 - RNA, 38 nt, Artificial Sequence
  Description of Artificial Sequence:  Enzymatic Nucleic Acid
gcuuuguucugaugaggccguuaggccgaaauggcuuc

SEQ ID NO: 9614 - RNA, 38 nt, Artificial Sequence
  Description of Artificial Sequence:  Enzymatic Nucleic Acid
aaggagaucugaugaggccguuaggccgaaacccucuc

SEQ ID NO: 9615 - RNA, 38 nt, Artificial Sequence
  Description of Artificial Sequence:  Enzymatic Nucleic Acid
uggaaggacugaugaggccguuaggccgaaaugacccu

SEQ ID NO: 9616 - RNA, 38 nt, Artificial Sequence
  Description of Artificial Sequence:  Enzymatic Nucleic Acid
cauggaagcugaugaggccguuaggccgaaagaugacc

SEQ ID NO: 9617 - RNA, 38 nt, Artificial Sequence
  Description of Artificial Sequence:  Enzymatic Nucleic Acid
ucacauggcugaugaggccguuaggccgaaaggagaug

SEQ ID NO: 9618 - RNA, 38 nt, Artificial Sequence
  Description of Artificial Sequence:  Enzymatic Nucleic Acid
aucacaugcugaugaggccguuaggccgaaaaggagau

SEQ ID NO: 9619 - RNA, 38 nt, Artificial Sequence
  Description of Artificial Sequence:  Enzymatic Nucleic Acid
ggaccccucugaugaggccguuaggccgaaaucacaug

SEQ ID NO: 9620 - RNA, 38 nt, Artificial Sequence
  Description of Artificial Sequence:  Enzymatic Nucleic Acid
aauuucagcugaugaggccguuaggccgaaaccccuga

SEQ ID NO: 9621 - RNA, 38 nt, Artificial Sequence
  Description of Artificial Sequence:  Enzymatic Nucleic Acid
ugcacagucugaugaggccguuaggccgaaauuucagg

SEQ ID NO: 9622 - RNA, 38 nt, Artificial Sequence
  Description of Artificial Sequence:  Enzymatic Nucleic Acid
uugcacagcugaugaggccguuaggccgaaaauuucag

SEQ ID NO: 9623 - RNA, 38 nt, Artificial Sequence
  Description of Artificial Sequence:  Enzymatic Nucleic Acid
acaacaggcugaugaggccguuaggccgaaacacacuc

SEQ ID NO: 9624 - RNA, 38 nt, Artificial Sequence
  Description of Artificial Sequence:  Enzymatic Nucleic Acid
cagugcaccugaugaggccguuaggccgaaacagggac

SEQ ID NO: 9625 - RNA, 38 nt, Artificial Sequence
  Description of Artificial Sequence:  Enzymatic Nucleic Acid
cucaaacgcugaugaggccguuaggccgaaauuucugu

SEQ ID NO: 9626 - RNA, 38 nt, Artificial Sequence
  Description of Artificial Sequence:  Enzymatic Nucleic Acid
gguucucacugaugaggccguuaggccgaaacguauuu

SEQ ID NO: 9627 - RNA, 38 nt, Artificial Sequence
  Description of Artificial Sequence:  Enzymatic Nucleic Acid
agguucuccugaugaggccguuaggccgaaaacguauu

SEQ ID NO: 9628 - RNA, 38 nt, Artificial Sequence
  Description of Artificial Sequence:  Enzymatic Nucleic Acid
uaccacgucugaugaggccguuaggccgaaagguucuc

SEQ ID NO: 9629 - RNA, 38 nt, Artificial Sequence
  Description of Artificial Sequence:  Enzymatic Nucleic Acid
caagcuugcugaugaggccguuaggccgaaaccacgug

SEQ ID NO: 9630 - RNA, 38 nt, Artificial Sequence
  Description of Artificial Sequence:  Enzymatic Nucleic Acid
ugugagcccugaugaggccguuaggccgaaagcuugua

SEQ ID NO: 9631 - RNA, 38 nt, Artificial Sequence
  Description of Artificial Sequence:  Enzymatic Nucleic Acid
uugccugucugaugaggccguuaggccgaaagccaagc

SEQ ID NO: 9632 - RNA, 38 nt, Artificial Sequence
  Description of Artificial Sequence:  Enzymatic Nucleic Acid
uguggacccugaugaggccguuaggccgaaauguugcc

SEQ ID NO: 9633 - RNA, 38 nt, Artificial Sequence
  Description of Artificial Sequence:  Enzymatic Nucleic Acid
cccaugugcugaugaggccguuaggccgaaaccgaugu

SEQ ID NO: 9634 - RNA, 38 nt, Artificial Sequence
  Description of Artificial Sequence:  Enzymatic Nucleic Acid
gugugagucugaugaggccguuaggccgaaauucgccc

SEQ ID NO: 9635 - RNA, 38 nt, Artificial Sequence
  Description of Artificial Sequence:  Enzymatic Nucleic Acid
acuggugucugaugaggccguuaggccgaaagugauuc

SEQ ID NO: 9636 - RNA, 38 nt, Artificial Sequence
  Description of Artificial Sequence:  Enzymatic Nucleic Acid
uucuugcacugaugaggccguuaggccgaaacuggugu

SEQ ID NO: 9637 - RNA, 38 nt, Artificial Sequence
  Description of Artificial Sequence:  Enzymatic Nucleic Acid
guucuugccugaugaggccguuaggccgaaaacuggug

SEQ ID NO: 9638 - RNA, 38 nt, Artificial Sequence
  Description of Artificial Sequence:  Enzymatic Nucleic Acid
gagcaucccugaugaggccguuaggccgaaaguucuug

SEQ ID NO: 9639 - RNA, 38 nt, Artificial Sequence
  Description of Artificial Sequence:  Enzymatic Nucleic Acid
uuuccaaacugaugaggccguuaggccgaaagcaucca

SEQ ID NO: 9640 - RNA, 38 nt, Artificial Sequence
  Description of Artificial Sequence:  Enzymatic Nucleic Acid
aguuuccacugaugaggccguuaggccgaaagagcauc

SEQ ID NO: 9641 - RNA, 38 nt, Artificial Sequence
  Description of Artificial Sequence:  Enzymatic Nucleic Acid
caguuucccugaugaggccguuaggccgaaaagagcau

SEQ ID NO: 9642 - RNA, 38 nt, Artificial Sequence
  Description of Artificial Sequence:  Enzymatic Nucleic Acid
uguuagaacugaugaggccguuaggccgaaacauggug

SEQ ID NO: 9643 - RNA, 38 nt, Artificial Sequence
  Description of Artificial Sequence:  Enzymatic Nucleic Acid
cuguuagacugaugaggccguuaggccgaaaacauggu

SEQ ID NO: 9644 - RNA, 38 nt, Artificial Sequence
  Description of Artificial Sequence:  Enzymatic Nucleic Acid
gcuguuagcugaugaggccguuaggccgaaaaacaugg

SEQ ID NO: 9645 - RNA, 38 nt, Artificial Sequence
  Description of Artificial Sequence:  Enzymatic Nucleic Acid
ugcuguuacugaugaggccguuaggccgaaaaaacaug

SEQ ID NO: 9646 - RNA, 38 nt, Artificial Sequence
  Description of Artificial Sequence:  Enzymatic Nucleic Acid
ugugcugucugaugaggccguuaggccgaaagaaaaca

SEQ ID NO: 9647 - RNA, 38 nt, Artificial Sequence
  Description of Artificial Sequence:  Enzymatic Nucleic Acid
acaaucaacugaugaggccguuaggccgaaaugucauu

SEQ ID NO: 9648 - RNA, 38 nt, Artificial Sequence
  Description of Artificial Sequence:  Enzymatic Nucleic Acid
ccacaauccugaugaggccguuaggccgaaagauguca

SEQ ID NO: 9649 - RNA, 38 nt, Artificial Sequence
  Description of Artificial Sequence:  Enzymatic Nucleic Acid
aaugccaccugaugaggccguuaggccgaaaucaagau

SEQ ID NO: 9650 - RNA, 38 nt, Artificial Sequence
  Description of Artificial Sequence:  Enzymatic Nucleic Acid
cauucugacugaugaggccguuaggccgaaaugccaca

SEQ ID NO: 9651 - RNA, 38 nt, Artificial Sequence
  Description of Artificial Sequence:  Enzymatic Nucleic Acid
gcauucugcugaugaggccguuaggccgaaaaugccac

SEQ ID NO: 9652 - RNA, 38 nt, Artificial Sequence
  Description of Artificial Sequence:  Enzymatic Nucleic Acid
ggcauucucugaugaggccguuaggccgaaaaaugcca

SEQ ID NO: 9653 - RNA, 38 nt, Artificial Sequence
  Description of Artificial Sequence:  Enzymatic Nucleic Acid
ccugcagacugaugaggccguuaggccgaaaggcauuc

SEQ ID NO: 9654 - RNA, 38 nt, Artificial Sequence
  Description of Artificial Sequence:  Enzymatic Nucleic Acid
guccugcacugaugaggccguuaggccgaaagaggcau

SEQ ID NO: 9655 - RNA, 38 nt, Artificial Sequence
  Description of Artificial Sequence:  Enzymatic Nucleic Acid
agcaaacacugaugaggccguuaggccgaaagucgccu

SEQ ID NO: 9656 - RNA, 38 nt, Artificial Sequence
  Description of Artificial Sequence:  Enzymatic Nucleic Acid
gcagagcacugaugaggccguuaggccgaaacauaguc

SEQ ID NO: 9657 - RNA, 38 nt, Artificial Sequence
  Description of Artificial Sequence:  Enzymatic Nucleic Acid
agcagagccugaugaggccguuaggccgaaaacauagu

SEQ ID NO: 9658 - RNA, 38 nt, Artificial Sequence
  Description of Artificial Sequence:  Enzymatic Nucleic Acid
cuugagcacugaugaggccguuaggccgaaagcaaaca

SEQ ID NO: 9659 - RNA, 38 nt, Artificial Sequence
  Description of Artificial Sequence:  Enzymatic Nucleic Acid
cuuaucuucugaugaggccguuaggccgaaagcagagc

SEQ ID NO: 9660 - RNA, 38 nt, Artificial Sequence
  Description of Artificial Sequence:  Enzymatic Nucleic Acid
ggucuucucugaugaggccguuaggccgaaaucuugag

SEQ ID NO: 9661 - RNA, 38 nt, Artificial Sequence
  Description of Artificial Sequence:  Enzymatic Nucleic Acid
gaccaggccugaugaggccguuaggccgaaaugucuuu

SEQ ID NO: 9662 - RNA, 38 nt, Artificial Sequence
  Description of Artificial Sequence:  Enzymatic Nucleic Acid
agcuguuucugaugaggccguuaggccgaaaccaggca

SEQ ID NO: 9663 - RNA, 38 nt, Artificial Sequence
  Description of Artificial Sequence:  Enzymatic Nucleic Acid
aggaugaucugaugaggccguuaggccgaaagcuguuu

SEQ ID NO: 9664 - RNA, 38 nt, Artificial Sequence
  Description of Artificial Sequence:  Enzymatic Nucleic Acid
ucuaggaucugaugaggccguuaggccgaaaugagcug

SEQ ID NO: 9665 - RNA, 38 nt, Artificial Sequence
  Description of Artificial Sequence:  Enzymatic Nucleic Acid
cgcucuagcugaugaggccguuaggccgaaaugaugag

SEQ ID NO: 9666 - RNA, 38 nt, Artificial Sequence
  Description of Artificial Sequence:  Enzymatic Nucleic Acid
augcgcuccugaugaggccguuaggccgaaaggaugau

SEQ ID NO: 9667 - RNA, 38 nt, Artificial Sequence
  Description of Artificial Sequence:  Enzymatic Nucleic Acid
uuuccggucugaugaggccguuaggccgaaaucauggg

SEQ ID NO: 9668 - RNA, 38 nt, Artificial Sequence
  Description of Artificial Sequence:  Enzymatic Nucleic Acid
auucuccacugaugaggccguuaggccgaaauuuccgg

SEQ ID NO: 9669 - RNA, 38 nt, Artificial Sequence
  Description of Artificial Sequence:  Enzymatic Nucleic Acid
uguugucucugaugaggccguuaggccgaaauucucca

SEQ ID NO: 9670 - RNA, 38 nt, Artificial Sequence
  Description of Artificial Sequence:  Enzymatic Nucleic Acid
gucucgcccugaugaggccguuaggccgaaaugguugu

SEQ ID NO: 9671 - RNA, 38 nt, Artificial Sequence
  Description of Artificial Sequence:  Enzymatic Nucleic Acid
gucacuuccugaugaggccguuaggccgaaauggucuc

SEQ ID NO: 9672 - RNA, 38 nt, Artificial Sequence
  Description of Artificial Sequence:  Enzymatic Nucleic Acid
ugcugggccugaugaggccguuaggccgaaagucacuu

SEQ ID NO: 9673 - RNA, 38 nt, Artificial Sequence
  Description of Artificial Sequence:  Enzymatic Nucleic Acid
gauuuccacugaugaggccguuaggccgaaaugcuggg

SEQ ID NO: 9674 - RNA, 38 nt, Artificial Sequence
  Description of Artificial Sequence:  Enzymatic Nucleic Acid
ugggguagcugaugaggccguuaggccgaaauuuccag

SEQ ID NO: 9675 - RNA, 38 nt, Artificial Sequence
  Description of Artificial Sequence:  Enzymatic Nucleic Acid
guguggggcugaugaggccguuaggccgaaaggauuuc

SEQ ID NO: 9676 - RNA, 38 nt, Artificial Sequence
  Description of Artificial Sequence:  Enzymatic Nucleic Acid
aaccaugucugaugaggccguuaggccgaaaugugugg

SEQ ID NO: 9677 - RNA, 38 nt, Artificial Sequence
  Description of Artificial Sequence:  Enzymatic Nucleic Acid
gaaccaugcugaugaggccguuaggccgaaaaugugug

SEQ ID NO: 9678 - RNA, 38 nt, Artificial Sequence
  Description of Artificial Sequence:  Enzymatic Nucleic Acid
ugucuuugcugaugaggccguuaggccgaaaccaugua

SEQ ID NO: 9679 - RNA, 38 nt, Artificial Sequence
  Description of Artificial Sequence:  Enzymatic Nucleic Acid
uugucuuucugaugaggccguuaggccgaaaaccaugu

SEQ ID NO: 9680 - RNA, 38 nt, Artificial Sequence
  Description of Artificial Sequence:  Enzymatic Nucleic Acid
gaaucuuccugaugaggccguuaggccgaaaccagggu

SEQ ID NO: 9681 - RNA, 38 nt, Artificial Sequence
  Description of Artificial Sequence:  Enzymatic Nucleic Acid
aaugccugcugaugaggccguuaggccgaaaucuucua

SEQ ID NO: 9682 - RNA, 38 nt, Artificial Sequence
  Description of Artificial Sequence:  Enzymatic Nucleic Acid
caaugccucugaugaggccguuaggccgaaaaucuucu

SEQ ID NO: 9683 - RNA, 38 nt, Artificial Sequence
  Description of Artificial Sequence:  Enzymatic Nucleic Acid
cucaguaccugaugaggccguuaggccgaaaugccuga

SEQ ID NO: 9684 - RNA, 38 nt, Artificial Sequence
  Description of Artificial Sequence:  Enzymatic Nucleic Acid
ucucucagcugaugaggccguuaggccgaaacaaugcc

SEQ ID NO: 9685 - RNA, 38 nt, Artificial Sequence
  Description of Artificial Sequence:  Enzymatic Nucleic Acid
ccugcggacugaugaggccguuaggccgaaagucaggu

SEQ ID NO: 9686 - RNA, 38 nt, Artificial Sequence
  Description of Artificial Sequence:  Enzymatic Nucleic Acid
acccugcgcugaugaggccguuaggccgaaauagucag

SEQ ID NO: 9687 - RNA, 38 nt, Artificial Sequence
  Description of Artificial Sequence:  Enzymatic Nucleic Acid
cagguguacugaugaggccguuaggccgaaaggccucc

SEQ ID NO: 9688 - RNA, 38 nt, Artificial Sequence
  Description of Artificial Sequence:  Enzymatic Nucleic Acid
cagccaagcugaugaggccguuaggccgaaacauugca

SEQ ID NO: 9689 - RNA, 38 nt, Artificial Sequence
  Description of Artificial Sequence:  Enzymatic Nucleic Acid
gcacagcccugaugaggccguuaggccgaaaggacauu

SEQ ID NO: 9690 - RNA, 38 nt, Artificial Sequence
  Description of Artificial Sequence:  Enzymatic Nucleic Acid
auuaugaacugaugaggccguuaggccgaaagcgucuc

SEQ ID NO: 9691 - RNA, 38 nt, Artificial Sequence
  Description of Artificial Sequence:  Enzymatic Nucleic Acid
cuauuaugcugaugaggccguuaggccgaaagagcguc

SEQ ID NO: 9692 - RNA, 38 nt, Artificial Sequence
  Description of Artificial Sequence:  Enzymatic Nucleic Acid
ucuauuaucugaugaggccguuaggccgaaaagagcgu

SEQ ID NO: 9693 - RNA, 38 nt, Artificial Sequence
  Description of Artificial Sequence:  Enzymatic Nucleic Acid
ccuucuaucugaugaggccguuaggccgaaaugaagag

SEQ ID NO: 9694 - RNA, 38 nt, Artificial Sequence
  Description of Artificial Sequence:  Enzymatic Nucleic Acid
ugacuucccugaugaggccguuaggccgaaaguugguc

SEQ ID NO: 9695 - RNA, 38 nt, Artificial Sequence
  Description of Artificial Sequence:  Enzymatic Nucleic Acid
aggauaaucugaugaggccguuaggccgaaacuuccaa

SEQ ID NO: 9696 - RNA, 38 nt, Artificial Sequence
  Description of Artificial Sequence:  Enzymatic Nucleic Acid
acgaggaucugaugaggccguuaggccgaaaugacuuc

SEQ ID NO: 9697 - RNA, 38 nt, Artificial Sequence
  Description of Artificial Sequence:  Enzymatic Nucleic Acid
gacgaggacugaugaggccguuaggccgaaaaugacuu

SEQ ID NO: 9698 - RNA, 38 nt, Artificial Sequence
  Description of Artificial Sequence:  Enzymatic Nucleic Acid
ccgacgagcugaugaggccguuaggccgaaauaaugac

SEQ ID NO: 9699 - RNA, 38 nt, Artificial Sequence
  Description of Artificial Sequence:  Enzymatic Nucleic Acid
gugccgaccugaugaggccguuaggccgaaaggauaau

SEQ ID NO: 9700 - RNA, 38 nt, Artificial Sequence
  Description of Artificial Sequence:  Enzymatic Nucleic Acid
gcagugcccugaugaggccguuaggccgaaacgaggau

SEQ ID NO: 9701 - RNA, 38 nt, Artificial Sequence
  Description of Artificial Sequence:  Enzymatic Nucleic Acid
aacauggccugaugaggccguuaggccgaaaucacugc

SEQ ID NO: 9702 - RNA, 38 nt, Artificial Sequence
  Description of Artificial Sequence:  Enzymatic Nucleic Acid
ggagccagcugaugaggccguuaggccgaaagaacaug

SEQ ID NO: 9703 - RNA, 38 nt, Artificial Sequence
  Description of Artificial Sequence:  Enzymatic Nucleic Acid
aggagccacugaugaggccguuaggccgaaaagaacau

SEQ ID NO: 9704 - RNA, 38 nt, Artificial Sequence
  Description of Artificial Sequence:  Enzymatic Nucleic Acid
augacaagcugaugaggccguuaggccgaaaggagcca

SEQ ID NO: 9705 - RNA, 38 nt, Artificial Sequence
  Description of Artificial Sequence:  Enzymatic Nucleic Acid
aaugacaacugaugaggccguuaggccgaaaaggagcc

SEQ ID NO: 9706 - RNA, 38 nt, Artificial Sequence
  Description of Artificial Sequence:  Enzymatic Nucleic Acid
acaaugaccugaugaggccguuaggccgaaagaaggag

SEQ ID NO: 9707 - RNA, 38 nt, Artificial Sequence
  Description of Artificial Sequence:  Enzymatic Nucleic Acid
aggacaaucugaugaggccguuaggccgaaacaagaag

SEQ ID NO: 9708 - RNA, 38 nt, Artificial Sequence
  Description of Artificial Sequence:  Enzymatic Nucleic Acid
cguaggaccugaugaggccguuaggccgaaaugacaag

SEQ ID NO: 9709 - RNA, 38 nt, Artificial Sequence
  Description of Artificial Sequence:  Enzymatic Nucleic Acid
guccguagcugaugaggccguuaggccgaaacaaugac

SEQ ID NO: 9710 - RNA, 38 nt, Artificial Sequence
  Description of Artificial Sequence:  Enzymatic Nucleic Acid
acgguccgcugaugaggccguuaggccgaaaggacaau

SEQ ID NO: 9711 - RNA, 38 nt, Artificial Sequence
  Description of Artificial Sequence:  Enzymatic Nucleic Acid
gcccgcuucugaugaggccguuaggccgaaacgguccg

SEQ ID NO: 9712 - RNA, 38 nt, Artificial Sequence
  Description of Artificial Sequence:  Enzymatic Nucleic Acid
uagacaagcugaugaggccguuaggccgaaagccuguc

SEQ ID NO: 9713 - RNA, 38 nt, Artificial Sequence
  Description of Artificial Sequence:  Enzymatic Nucleic Acid
caauagaccugaugaggccguuaggccgaaaguagccu

SEQ ID NO: 9714 - RNA, 38 nt, Artificial Sequence
  Description of Artificial Sequence:  Enzymatic Nucleic Acid
ugacaauacugaugaggccguuaggccgaaacaaguag

SEQ ID NO: 9715 - RNA, 38 nt, Artificial Sequence
  Description of Artificial Sequence:  Enzymatic Nucleic Acid
caugacaacugaugaggccguuaggccgaaagacaagu

SEQ ID NO: 9716 - RNA, 38 nt, Artificial Sequence
  Description of Artificial Sequence:  Enzymatic Nucleic Acid
uccaugaccugaugaggccguuaggccgaaauagacaa

SEQ ID NO: 9717 - RNA, 38 nt, Artificial Sequence
  Description of Artificial Sequence:  Enzymatic Nucleic Acid
ggauccaucugaugaggccguuaggccgaaacaauaga

SEQ ID NO: 9718 - RNA, 38 nt, Artificial Sequence
  Description of Artificial Sequence:  Enzymatic Nucleic Acid
ccaagggccugaugaggccguuaggccgaaauucaucu

SEQ ID NO: 9719 - RNA, 38 nt, Artificial Sequence
  Description of Artificial Sequence:  Enzymatic Nucleic Acid
gcucaucccugaugaggccguuaggccgaaagggcaau

SEQ ID NO: 9720 - RNA, 38 nt, Artificial Sequence
  Description of Artificial Sequence:  Enzymatic Nucleic Acid
cauaaggccugaugaggccguuaggccgaaagcguuca

SEQ ID NO: 9721 - RNA, 38 nt, Artificial Sequence
  Description of Artificial Sequence:  Enzymatic Nucleic Acid
ggcaucaucugaugaggccguuaggccgaaaggcaagc

SEQ ID NO: 9722 - RNA, 38 nt, Artificial Sequence
  Description of Artificial Sequence:  Enzymatic Nucleic Acid
uggcaucacugaugaggccguuaggccgaaaaggcaag

SEQ ID NO: 9723 - RNA, 38 nt, Artificial Sequence
  Description of Artificial Sequence:  Enzymatic Nucleic Acid
cccuggggcugaugaggccguuaggccgaaauucccac

SEQ ID NO: 9724 - RNA, 38 nt, Artificial Sequence
  Description of Artificial Sequence:  Enzymatic Nucleic Acid
ucccugggcugaugaggccguuaggccgaaaauuccca

SEQ ID NO: 9725 - RNA, 38 nt, Artificial Sequence
  Description of Artificial Sequence:  Enzymatic Nucleic Acid
gguuuucccugaugaggccguuaggccgaaaguuucag

SEQ ID NO: 9726 - RNA, 38 nt, Artificial Sequence
  Description of Artificial Sequence:  Enzymatic Nucleic Acid
gcggccaacugaugaggccguuaggccgaaagguuuuc

SEQ ID NO: 9727 - RNA, 38 nt, Artificial Sequence
  Description of Artificial Sequence:  Enzymatic Nucleic Acid
ccgcggcccugaugaggccguuaggccgaaagagguuu

SEQ ID NO: 9728 - RNA, 38 nt, Artificial Sequence
  Description of Artificial Sequence:  Enzymatic Nucleic Acid
cuuggccgcugaugaggccguuaggccgaaaggcaccg

SEQ ID NO: 9729 - RNA, 38 nt, Artificial Sequence
  Description of Artificial Sequence:  Enzymatic Nucleic Acid
acuuggcccugaugaggccguuaggccgaaaaggcacc

SEQ ID NO: 9730 - RNA, 38 nt, Artificial Sequence
  Description of Artificial Sequence:  Enzymatic Nucleic Acid
ucugccuccugaugaggccguuaggccgaaaucacuug

SEQ ID NO: 9731 - RNA, 38 nt, Artificial Sequence
  Description of Artificial Sequence:  Enzymatic Nucleic Acid
aauuccaacugaugaggccguuaggccgaaagcgucug

SEQ ID NO: 9732 - RNA, 38 nt, Artificial Sequence
  Description of Artificial Sequence:  Enzymatic Nucleic Acid
caauuccacugaugaggccguuaggccgaaaagcgucu

SEQ ID NO: 9733 - RNA, 38 nt, Artificial Sequence
  Description of Artificial Sequence:  Enzymatic Nucleic Acid
ucaauucccugaugaggccguuaggccgaaaaagcguc

SEQ ID NO: 9734 - RNA, 38 nt, Artificial Sequence
  Description of Artificial Sequence:  Enzymatic Nucleic Acid
uguuuugccugaugaggccguuaggccgaaagucgcug

SEQ ID NO: 9735 - RNA, 38 nt, Artificial Sequence
  Description of Artificial Sequence:  Enzymatic Nucleic Acid
uugacggccugaugaggccguuaggccgaaacuguuuu

SEQ ID NO: 9736 - RNA, 38 nt, Artificial Sequence
  Description of Artificial Sequence:  Enzymatic Nucleic Acid
aacaucuucugaugaggccguuaggccgaaacggcuac

SEQ ID NO: 9737 - RNA, 38 nt, Artificial Sequence
  Description of Artificial Sequence:  Enzymatic Nucleic Acid
cuucuuuccugaugaggccguuaggccgaaacaucuug

SEQ ID NO: 9738 - RNA, 38 nt, Artificial Sequence
  Description of Artificial Sequence:  Enzymatic Nucleic Acid
gagggcuccugaugaggccguuaggccgaaaugcucgc

SEQ ID NO: 9739 - RNA, 38 nt, Artificial Sequence
  Description of Artificial Sequence:  Enzymatic Nucleic Acid
ucagacaucugaugaggccguuaggccgaaagggcucg

SEQ ID NO: 9740 - RNA, 38 nt, Artificial Sequence
  Description of Artificial Sequence:  Enzymatic Nucleic Acid
ugaguucacugaugaggccguuaggccgaaacaugagg

SEQ ID NO: 9741 - RNA, 38 nt, Artificial Sequence
  Description of Artificial Sequence:  Enzymatic Nucleic Acid
uggaugagcugaugaggccguuaggccgaaaucuugag

SEQ ID NO: 9742 - RNA, 38 nt, Artificial Sequence
  Description of Artificial Sequence:  Enzymatic Nucleic Acid
auguggaucugaugaggccguuaggccgaaaggaucuu

SEQ ID NO: 9743 - RNA, 38 nt, Artificial Sequence
  Description of Artificial Sequence:  Enzymatic Nucleic Acid
ccaaugugcugaugaggccguuaggccgaaaugaggau

SEQ ID NO: 9744 - RNA, 38 nt, Artificial Sequence
  Description of Artificial Sequence:  Enzymatic Nucleic Acid
uggugacccugaugaggccguuaggccgaaauguggau

SEQ ID NO: 9745 - RNA, 38 nt, Artificial Sequence
  Description of Artificial Sequence:  Enzymatic Nucleic Acid
gagauggucugaugaggccguuaggccgaaaccaaugu

SEQ ID NO: 9746 - RNA, 38 nt, Artificial Sequence
  Description of Artificial Sequence:  Enzymatic Nucleic Acid
gcgccuagcugaugaggccguuaggccgaaagguucac

SEQ ID NO: 9747 - RNA, 38 nt, Artificial Sequence
  Description of Artificial Sequence:  Enzymatic Nucleic Acid
caggcgcccugaugaggccguuaggccgaaaggagguu

SEQ ID NO: 9748 - RNA, 38 nt, Artificial Sequence
  Description of Artificial Sequence:  Enzymatic Nucleic Acid
caccaugacugaugaggccguuaggccgaaaggcccuc

SEQ ID NO: 9749 - RNA, 38 nt, Artificial Sequence
  Description of Artificial Sequence:  Enzymatic Nucleic Acid
aucaccaucugaugaggccguuaggccgaaagaggccc

SEQ ID NO: 9750 - RNA, 38 nt, Artificial Sequence
  Description of Artificial Sequence:  Enzymatic Nucleic Acid
acuugcagcugaugaggccguuaggccgaaauuccaca

SEQ ID NO: 9751 - RNA, 38 nt, Artificial Sequence
  Description of Artificial Sequence:  Enzymatic Nucleic Acid
aacuugcacugaugaggccguuaggccgaaaauuccac

SEQ ID NO: 9752 - RNA, 38 nt, Artificial Sequence
  Description of Artificial Sequence:  Enzymatic Nucleic Acid
gguuuccacugaugaggccguuaggccgaaacuugcag

SEQ ID NO: 9753 - RNA, 38 nt, Artificial Sequence
  Description of Artificial Sequence:  Enzymatic Nucleic Acid
agguuucccugaugaggccguuaggccgaaaacuugca

SEQ ID NO: 9754 - RNA, 38 nt, Artificial Sequence
  Description of Artificial Sequence:  Enzymatic Nucleic Acid
uaaguugacugaugaggccguuaggccgaaagguuucc

SEQ ID NO: 9755 - RNA, 38 nt, Artificial Sequence
  Description of Artificial Sequence:  Enzymatic Nucleic Acid
aguaaguucugaugaggccguuaggccgaaauagguuu

SEQ ID NO: 9756 - RNA, 38 nt, Artificial Sequence
  Description of Artificial Sequence:  Enzymatic Nucleic Acid
ccguaagucugaugaggccguuaggccgaaaguugaua

SEQ ID NO: 9757 - RNA, 38 nt, Artificial Sequence
  Description of Artificial Sequence:  Enzymatic Nucleic Acid
cccguaagcugaugaggccguuaggccgaaaaguugau

SEQ ID NO: 9758 - RNA, 38 nt, Artificial Sequence
  Description of Artificial Sequence:  Enzymatic Nucleic Acid
ugccccgucugaugaggccguuaggccgaaaguaaguu

SEQ ID NO: 9759 - RNA, 38 nt, Artificial Sequence
  Description of Artificial Sequence:  Enzymatic Nucleic Acid
uugccccgcugaugaggccguuaggccgaaaaguaagu

SEQ ID NO: 9760 - RNA, 38 nt, Artificial Sequence
  Description of Artificial Sequence:  Enzymatic Nucleic Acid
agggaacacugaugaggccguuaggccgaaauucauuu

SEQ ID NO: 9761 - RNA, 38 nt, Artificial Sequence
  Description of Artificial Sequence:  Enzymatic Nucleic Acid
uagggaaccugaugaggccguuaggccgaaaauucauu

SEQ ID NO: 9762 - RNA, 38 nt, Artificial Sequence
  Description of Artificial Sequence:  Enzymatic Nucleic Acid
uuauagggcugaugaggccguuaggccgaaacaaauuc

SEQ ID NO: 9763 - RNA, 38 nt, Artificial Sequence
  Description of Artificial Sequence:  Enzymatic Nucleic Acid
cuuauaggcugaugaggccguuaggccgaaaacaaauu

SEQ ID NO: 9764 - RNA, 38 nt, Artificial Sequence
  Description of Artificial Sequence:  Enzymatic Nucleic Acid
ugcucuuacugaugaggccguuaggccgaaagggaaca

SEQ ID NO: 9765 - RNA, 38 nt, Artificial Sequence
  Description of Artificial Sequence:  Enzymatic Nucleic Acid
uuugcucucugaugaggccguuaggccgaaauagggaa

SEQ ID NO: 9766 - RNA, 38 nt, Artificial Sequence
  Description of Artificial Sequence:  Enzymatic Nucleic Acid
ccuggcggcugaugaggccguuaggccgaaagcgugcc

SEQ ID NO: 9767 - RNA, 38 nt, Artificial Sequence
  Description of Artificial Sequence:  Enzymatic Nucleic Acid
cccuggcgcugaugaggccguuaggccgaaaagcgugc

SEQ ID NO: 9768 - RNA, 38 nt, Artificial Sequence
  Description of Artificial Sequence:  Enzymatic Nucleic Acid
ccccaacgcugaugaggccguuaggccgaaaguccuug

SEQ ID NO: 9769 - RNA, 38 nt, Artificial Sequence
  Description of Artificial Sequence:  Enzymatic Nucleic Acid
agcucccccugaugaggccguuaggccgaaacguaguc

SEQ ID NO: 9770 - RNA, 38 nt, Artificial Sequence
  Description of Artificial Sequence:  Enzymatic Nucleic Acid
uccacggacugaugaggccguuaggccgaaagcucccc

SEQ ID NO: 9771 - RNA, 38 nt, Artificial Sequence
  Description of Artificial Sequence:  Enzymatic Nucleic Acid
gauccacgcugaugaggccguuaggccgaaagagcucc

SEQ ID NO: 9772 - RNA, 38 nt, Artificial Sequence
  Description of Artificial Sequence:  Enzymatic Nucleic Acid
ucuuuucacugaugaggccguuaggccgaaauccacgg

SEQ ID NO: 9773 - RNA, 38 nt, Artificial Sequence
  Description of Artificial Sequence:  Enzymatic Nucleic Acid
ugcugucccugaugaggccguuaggccgaaagcgucuu

SEQ ID NO: 9774 - RNA, 38 nt, Artificial Sequence
  Description of Artificial Sequence:  Enzymatic Nucleic Acid
cugcuggucugaugaggccguuaggccgaaaugcuguc

SEQ ID NO: 9775 - RNA, 38 nt, Artificial Sequence
  Description of Artificial Sequence:  Enzymatic Nucleic Acid
agcuggcacugaugaggccguuaggccgaaagcucugg

SEQ ID NO: 9776 - RNA, 38 nt, Artificial Sequence
  Description of Artificial Sequence:  Enzymatic Nucleic Acid
caaagccucugaugaggccguuaggccgaaagcuggca

SEQ ID NO: 9777 - RNA, 38 nt, Artificial Sequence
  Description of Artificial Sequence:  Enzymatic Nucleic Acid
ccucaacacugaugaggccguuaggccgaaagccugag

SEQ ID NO: 9778 - RNA, 38 nt, Artificial Sequence
  Description of Artificial Sequence:  Enzymatic Nucleic Acid
uccucaaccugaugaggccguuaggccgaaaagccuga

SEQ ID NO: 9779 - RNA, 38 nt, Artificial Sequence
  Description of Artificial Sequence:  Enzymatic Nucleic Acid
uucuccuccugaugaggccguuaggccgaaacaaagcc

SEQ ID NO: 9780 - RNA, 38 nt, Artificial Sequence
  Description of Artificial Sequence:  Enzymatic Nucleic Acid
cacugagccugaugaggccguuaggccgaaauuucucc

SEQ ID NO: 9781 - RNA, 38 nt, Artificial Sequence
  Description of Artificial Sequence:  Enzymatic Nucleic Acid
acaucacucugaugaggccguuaggccgaaagcgauuu

SEQ ID NO: 9782 - RNA, 38 nt, Artificial Sequence
  Description of Artificial Sequence:  Enzymatic Nucleic Acid
uucuucagcugaugaggccguuaggccgaaagcuucuu

SEQ ID NO: 9783 - RNA, 38 nt, Artificial Sequence
  Description of Artificial Sequence:  Enzymatic Nucleic Acid
guucuucacugaugaggccguuaggccgaaaagcuucu

SEQ ID NO: 9784 - RNA, 38 nt, Artificial Sequence
  Description of Artificial Sequence:  Enzymatic Nucleic Acid
aguccuugcugaugaggccguuaggccgaaacaguucu

SEQ ID NO: 9785 - RNA, 38 nt, Artificial Sequence
  Description of Artificial Sequence:  Enzymatic Nucleic Acid
aggucaggcugaugaggccguuaggccgaaaguccuug

SEQ ID NO: 9786 - RNA, 38 nt, Artificial Sequence
  Description of Artificial Sequence:  Enzymatic Nucleic Acid
uugaugcccugaugaggccguuaggccgaaagaacucc

SEQ ID NO: 9787 - RNA, 38 nt, Artificial Sequence
  Description of Artificial Sequence:  Enzymatic Nucleic Acid
acuuccuucugaugaggccguuaggccgaaaugccaag

SEQ ID NO: 9788 - RNA, 38 nt, Artificial Sequence
  Description of Artificial Sequence:  Enzymatic Nucleic Acid
ccuguggacugaugaggccguuaggccgaaacacuucc

SEQ ID NO: 9789 - RNA, 38 nt, Artificial Sequence
  Description of Artificial Sequence:  Enzymatic Nucleic Acid
gauaggagcugaugaggccguuaggccgaaauguuucg

SEQ ID NO: 9790 - RNA, 38 nt, Artificial Sequence
  Description of Artificial Sequence:  Enzymatic Nucleic Acid
cgauaggacugaugaggccguuaggccgaaaauguuuc

SEQ ID NO: 9791 - RNA, 38 nt, Artificial Sequence
  Description of Artificial Sequence:  Enzymatic Nucleic Acid
uccgauagcugaugaggccguuaggccgaaagaauguu

SEQ ID NO: 9792 - RNA, 38 nt, Artificial Sequence
  Description of Artificial Sequence:  Enzymatic Nucleic Acid
uucuccgacugaugaggccguuaggccgaaaggagaau

SEQ ID NO: 9793 - RNA, 38 nt, Artificial Sequence
  Description of Artificial Sequence:  Enzymatic Nucleic Acid
ucuucucccugaugaggccguuaggccgaaauaggaga

SEQ ID NO: 9794 - RNA, 38 nt, Artificial Sequence
  Description of Artificial Sequence:  Enzymatic Nucleic Acid
cagaucuucugaugaggccguuaggccgaaaccacauu

SEQ ID NO: 9795 - RNA, 38 nt, Artificial Sequence
  Description of Artificial Sequence:  Enzymatic Nucleic Acid
acagaucucugaugaggccguuaggccgaaaaccacau

SEQ ID NO: 9796 - RNA, 38 nt, Artificial Sequence
  Description of Artificial Sequence:  Enzymatic Nucleic Acid
aagucacacugaugaggccguuaggccgaaaucuuaac

SEQ ID NO: 9797 - RNA, 38 nt, Artificial Sequence
  Description of Artificial Sequence:  Enzymatic Nucleic Acid
ccaagccgcugaugaggccguuaggccgaaagucacag

SEQ ID NO: 9798 - RNA, 38 nt, Artificial Sequence
  Description of Artificial Sequence:  Enzymatic Nucleic Acid
cccgggcccugaugaggccguuaggccgaaagccgaag

SEQ ID NO: 9799 - RNA, 38 nt, Artificial Sequence
  Description of Artificial Sequence:  Enzymatic Nucleic Acid
ucuuuauacugaugaggccguuaggccgaaaugucccg

SEQ ID NO: 9800 - RNA, 38 nt, Artificial Sequence
  Description of Artificial Sequence:  Enzymatic Nucleic Acid
gucuuuaucugaugaggccguuaggccgaaaauguccc

SEQ ID NO: 9801 - RNA, 38 nt, Artificial Sequence
  Description of Artificial Sequence:  Enzymatic Nucleic Acid
ggucuuuacugaugaggccguuaggccgaaaaaugucc

SEQ ID NO: 9802 - RNA, 38 nt, Artificial Sequence
  Description of Artificial Sequence:  Enzymatic Nucleic Acid
cgggucuucugaugaggccguuaggccgaaauaaaugu

SEQ ID NO: 9803 - RNA, 38 nt, Artificial Sequence
  Description of Artificial Sequence:  Enzymatic Nucleic Acid
ucugacaucugaugaggccguuaggccgaaauccgggu

SEQ ID NO: 9804 - RNA, 38 nt, Artificial Sequence
  Description of Artificial Sequence:  Enzymatic Nucleic Acid
uucugacacugaugaggccguuaggccgaaaauccggg

SEQ ID NO: 9805 - RNA, 38 nt, Artificial Sequence
  Description of Artificial Sequence:  Enzymatic Nucleic Acid
uucaaaggcugaugaggccguuaggccgaaagucgggc

SEQ ID NO: 9806 - RNA, 38 nt, Artificial Sequence
  Description of Artificial Sequence:  Enzymatic Nucleic Acid
ccacuucacugaugaggccguuaggccgaaagggaguc

SEQ ID NO: 9807 - RNA, 38 nt, Artificial Sequence
  Description of Artificial Sequence:  Enzymatic Nucleic Acid
uccacuuccugaugaggccguuaggccgaaaagggagu

SEQ ID NO: 9808 - RNA, 38 nt, Artificial Sequence
  Description of Artificial Sequence:  Enzymatic Nucleic Acid
cugucaaacugaugaggccguuaggccgaaaugguuuc

SEQ ID NO: 9809 - RNA, 38 nt, Artificial Sequence
  Description of Artificial Sequence:  Enzymatic Nucleic Acid
ucugucaacugaugaggccguuaggccgaaaaugguuu

SEQ ID NO: 9810 - RNA, 38 nt, Artificial Sequence
  Description of Artificial Sequence:  Enzymatic Nucleic Acid
cucugucacugaugaggccguuaggccgaaaaaugguu

SEQ ID NO: 9811 - RNA, 38 nt, Artificial Sequence
  Description of Artificial Sequence:  Enzymatic Nucleic Acid
acucuguccugaugaggccguuaggccgaaaaaauggu

SEQ ID NO: 9812 - RNA, 38 nt, Artificial Sequence
  Description of Artificial Sequence:  Enzymatic Nucleic Acid
auuguguacugaugaggccguuaggccgaaacucuguc

SEQ ID NO: 9813 - RNA, 38 nt, Artificial Sequence
  Description of Artificial Sequence:  Enzymatic Nucleic Acid
gaauugugcugaugaggccguuaggccgaaauacucug

SEQ ID NO: 9814 - RNA, 38 nt, Artificial Sequence
  Description of Artificial Sequence:  Enzymatic Nucleic Acid
ucgcucugcugaugaggccguuaggccgaaauugugua

SEQ ID NO: 9815 - RNA, 38 nt, Artificial Sequence
  Description of Artificial Sequence:  Enzymatic Nucleic Acid
aucgcucucugaugaggccguuaggccgaaaauugugu

SEQ ID NO: 9816 - RNA, 38 nt, Artificial Sequence
  Description of Artificial Sequence:  Enzymatic Nucleic Acid
caccgaaacugaugaggccguuaggccgaaaccacaca

SEQ ID NO: 9817 - RNA, 38 nt, Artificial Sequence
  Description of Artificial Sequence:  Enzymatic Nucleic Acid
cacaccgacugaugaggccguuaggccgaaagaccaca

SEQ ID NO: 9818 - RNA, 38 nt, Artificial Sequence
  Description of Artificial Sequence:  Enzymatic Nucleic Acid
acacaccgcugaugaggccguuaggccgaaaagaccac

SEQ ID NO: 9819 - RNA, 38 nt, Artificial Sequence
  Description of Artificial Sequence:  Enzymatic Nucleic Acid
aacacacccugaugaggccguuaggccgaaaaagacca

SEQ ID NO: 9820 - RNA, 38 nt, Artificial Sequence
  Description of Artificial Sequence:  Enzymatic Nucleic Acid
cccagagccugaugaggccguuaggccgaaacacaccg

SEQ ID NO: 9821 - RNA, 38 nt, Artificial Sequence
  Description of Artificial Sequence:  Enzymatic Nucleic Acid
auuucccacugaugaggccguuaggccgaaagcaacac

SEQ ID NO: 9822 - RNA, 38 nt, Artificial Sequence
  Description of Artificial Sequence:  Enzymatic Nucleic Acid
aggcaccucugaugaggccguuaggccgaaaggaaaau

SEQ ID NO: 9823 - RNA, 38 nt, Artificial Sequence
  Description of Artificial Sequence:  Enzymatic Nucleic Acid
gaggcacccugaugaggccguuaggccgaaaaggaaaa

SEQ ID NO: 9824 - RNA, 38 nt, Artificial Sequence
  Description of Artificial Sequence:  Enzymatic Nucleic Acid
gguaugggcugaugaggccguuaggccgaaaggcaccu

SEQ ID NO: 9825 - RNA, 38 nt, Artificial Sequence
  Description of Artificial Sequence:  Enzymatic Nucleic Acid
ccccagggcugaugaggccguuaggccgaaauggggag

SEQ ID NO: 9826 - RNA, 38 nt, Artificial Sequence
  Description of Artificial Sequence:  Enzymatic Nucleic Acid
ucuucauccugaugaggccguuaggccgaaaucuugac

SEQ ID NO: 9827 - RNA, 38 nt, Artificial Sequence
  Description of Artificial Sequence:  Enzymatic Nucleic Acid
uccuacaacugaugaggccguuaggccgaaauucuuca

SEQ ID NO: 9828 - RNA, 38 nt, Artificial Sequence
  Description of Artificial Sequence:  Enzymatic Nucleic Acid
cuccuacacugaugaggccguuaggccgaaaauucuuc

SEQ ID NO: 9829 - RNA, 38 nt, Artificial Sequence
  Description of Artificial Sequence:  Enzymatic Nucleic Acid
ucuccuaccugaugaggccguuaggccgaaaaauucuu

SEQ ID NO: 9830 - RNA, 38 nt, Artificial Sequence
  Description of Artificial Sequence:  Enzymatic Nucleic Acid
caaucucccugaugaggccguuaggccgaaacaaaauu

SEQ ID NO: 9831 - RNA, 38 nt, Artificial Sequence
  Description of Artificial Sequence:  Enzymatic Nucleic Acid
cuucuuuccugaugaggccguuaggccgaaaucuccua

SEQ ID NO: 9832 - RNA, 38 nt, Artificial Sequence
  Description of Artificial Sequence:  Enzymatic Nucleic Acid
ccgcauuccugaugaggccguuaggccgaaaguuccuu

SEQ ID NO: 9833 - RNA, 38 nt, Artificial Sequence
  Description of Artificial Sequence:  Enzymatic Nucleic Acid
guagucagcugaugaggccguuaggccgaaagcccgca

SEQ ID NO: 9834 - RNA, 38 nt, Artificial Sequence
  Description of Artificial Sequence:  Enzymatic Nucleic Acid
ggguagugcugaugaggccguuaggccgaaagucagga

SEQ ID NO: 9835 - RNA, 38 nt, Artificial Sequence
  Description of Artificial Sequence:  Enzymatic Nucleic Acid
uucuggggcugaugaggccguuaggccgaaaguguagu

SEQ ID NO: 9836 - RNA, 38 nt, Artificial Sequence
  Description of Artificial Sequence:  Enzymatic Nucleic Acid
cugaaaaccugaugaggccguuaggccgaaagggucuc

SEQ ID NO: 9837 - RNA, 38 nt, Artificial Sequence
  Description of Artificial Sequence:  Enzymatic Nucleic Acid
acucugaacugaugaggccguuaggccgaaacgagggu

SEQ ID NO: 9838 - RNA, 38 nt, Artificial Sequence
  Description of Artificial Sequence:  Enzymatic Nucleic Acid
aacucugacugaugaggccguuaggccgaaaacgaggg

SEQ ID NO: 9839 - RNA, 38 nt, Artificial Sequence
  Description of Artificial Sequence:  Enzymatic Nucleic Acid
caacucugcugaugaggccguuaggccgaaaaacgagg

SEQ ID NO: 9840 - RNA, 38 nt, Artificial Sequence
  Description of Artificial Sequence:  Enzymatic Nucleic Acid
ccaacucucugaugaggccguuaggccgaaaaaacgag

SEQ ID NO: 9841 - RNA, 38 nt, Artificial Sequence
  Description of Artificial Sequence:  Enzymatic Nucleic Acid
gcuccacccugaugaggccguuaggccgaaacucugaa

SEQ ID NO: 9842 - RNA, 38 nt, Artificial Sequence
  Description of Artificial Sequence:  Enzymatic Nucleic Acid
guuucccacugaugaggccguuaggccgaaaugcucca

SEQ ID NO: 9843 - RNA, 38 nt, Artificial Sequence
  Description of Artificial Sequence:  Enzymatic Nucleic Acid
gguuuccccugaugaggccguuaggccgaaaaugcucc

SEQ ID NO: 9844 - RNA, 38 nt, Artificial Sequence
  Description of Artificial Sequence:  Enzymatic Nucleic Acid
gcuugcagcugaugaggccguuaggccgaaagguuucc

SEQ ID NO: 9845 - RNA, 38 nt, Artificial Sequence
  Description of Artificial Sequence:  Enzymatic Nucleic Acid
gaacaauacugaugaggccguuaggccgaaagucuuug

SEQ ID NO: 9846 - RNA, 38 nt, Artificial Sequence
  Description of Artificial Sequence:  Enzymatic Nucleic Acid
aagaacaacugaugaggccguuaggccgaaauagucuu

SEQ ID NO: 9847 - RNA, 38 nt, Artificial Sequence
  Description of Artificial Sequence:  Enzymatic Nucleic Acid
ggaagaaccugaugaggccguuaggccgaaauauaguc

SEQ ID NO: 9848 - RNA, 38 nt, Artificial Sequence
  Description of Artificial Sequence:  Enzymatic Nucleic Acid
auuggaagcugaugaggccguuaggccgaaacaauaua

SEQ ID NO: 9849 - RNA, 38 nt, Artificial Sequence
  Description of Artificial Sequence:  Enzymatic Nucleic Acid
cauuggaacugaugaggccguuaggccgaaaacaauau

SEQ ID NO: 9850 - RNA, 38 nt, Artificial Sequence
  Description of Artificial Sequence:  Enzymatic Nucleic Acid
gacauuggcugaugaggccguuaggccgaaagaacaau

SEQ ID NO: 9851 - RNA, 38 nt, Artificial Sequence
  Description of Artificial Sequence:  Enzymatic Nucleic Acid
ugacauugcugaugaggccguuaggccgaaaagaacaa

SEQ ID NO: 9852 - RNA, 38 nt, Artificial Sequence
  Description of Artificial Sequence:  Enzymatic Nucleic Acid
gugucucucugaugaggccguuaggccgaaacauugga

SEQ ID NO: 9853 - RNA, 38 nt, Artificial Sequence
  Description of Artificial Sequence:  Enzymatic Nucleic Acid
ggcagggacugaugaggccguuaggccgaaaguccaga

SEQ ID NO: 9854 - RNA, 38 nt, Artificial Sequence
  Description of Artificial Sequence:  Enzymatic Nucleic Acid
uaggcaggcugaugaggccguuaggccgaaagagucca

SEQ ID NO: 9855 - RNA, 38 nt, Artificial Sequence
  Description of Artificial Sequence:  Enzymatic Nucleic Acid
aggugaggcugaugaggccguuaggccgaaaggcaggg

SEQ ID NO: 9856 - RNA, 38 nt, Artificial Sequence
  Description of Artificial Sequence:  Enzymatic Nucleic Acid
uuccuccacugaugaggccguuaggccgaaacaggaaa

SEQ ID NO: 9857 - RNA, 38 nt, Artificial Sequence
  Description of Artificial Sequence:  Enzymatic Nucleic Acid
uaaugacucugaugaggccguuaggccgaaauuccugc

SEQ ID NO: 9858 - RNA, 38 nt, Artificial Sequence
  Description of Artificial Sequence:  Enzymatic Nucleic Acid
gagauaaucugaugaggccguuaggccgaaacugauuc

SEQ ID NO: 9859 - RNA, 38 nt, Artificial Sequence
  Description of Artificial Sequence:  Enzymatic Nucleic Acid
cuggagaucugaugaggccguuaggccgaaaugacuga

SEQ ID NO: 9860 - RNA, 38 nt, Artificial Sequence
  Description of Artificial Sequence:  Enzymatic Nucleic Acid
ucuggagacugaugaggccguuaggccgaaaaugacug

SEQ ID NO: 9861 - RNA, 38 nt, Artificial Sequence
  Description of Artificial Sequence:  Enzymatic Nucleic Acid
guucuggacugaugaggccguuaggccgaaauaaugac

SEQ ID NO: 9862 - RNA, 38 nt, Artificial Sequence
  Description of Artificial Sequence:  Enzymatic Nucleic Acid
cuguucugcugaugaggccguuaggccgaaagauaaug

SEQ ID NO: 9863 - RNA, 38 nt, Artificial Sequence
  Description of Artificial Sequence:  Enzymatic Nucleic Acid
caaugggacugaugaggccguuaggccgaaaucuucaa

SEQ ID NO: 9864 - RNA, 38 nt, Artificial Sequence
  Description of Artificial Sequence:  Enzymatic Nucleic Acid
uccaauggcugaugaggccguuaggccgaaauaucuuc

SEQ ID NO: 9865 - RNA, 38 nt, Artificial Sequence
  Description of Artificial Sequence:  Enzymatic Nucleic Acid
guuccucccugaugaggccguuaggccgaaaugggaua

SEQ ID NO: 9866 - RNA, 38 nt, Artificial Sequence
  Description of Artificial Sequence:  Enzymatic Nucleic Acid
aucacuuucugaugaggccguuaggccgaaacuucugg

SEQ ID NO: 9867 - RNA, 38 nt, Artificial Sequence
  Description of Artificial Sequence:  Enzymatic Nucleic Acid
ucaucuggcugaugaggccguuaggccgaaaucacuuu

SEQ ID NO: 9868 - RNA, 38 nt, Artificial Sequence
  Description of Artificial Sequence:  Enzymatic Nucleic Acid
gaugcaagcugaugaggccguuaggccgaaaccauccc

SEQ ID NO: 9869 - RNA, 38 nt, Artificial Sequence
  Description of Artificial Sequence:  Enzymatic Nucleic Acid
ucugaugccugaugaggccguuaggccgaaaggaccau

SEQ ID NO: 9870 - RNA, 38 nt, Artificial Sequence
  Description of Artificial Sequence:  Enzymatic Nucleic Acid
gcucuucucugaugaggccguuaggccgaaaugcaagg

SEQ ID NO: 9871 - RNA, 38 nt, Artificial Sequence
  Description of Artificial Sequence:  Enzymatic Nucleic Acid
auggagaucugaugaggccguuaggccgaaauuuguuc

SEQ ID NO: 9872 - RNA, 38 nt, Artificial Sequence
  Description of Artificial Sequence:  Enzymatic Nucleic Acid
gauggagacugaugaggccguuaggccgaaaauuuguu

SEQ ID NO: 9873 - RNA, 38 nt, Artificial Sequence
  Description of Artificial Sequence:  Enzymatic Nucleic Acid
ccugcuuucugaugaggccguuaggccgaaacugggca

SEQ ID NO: 9874 - RNA, 38 nt, Artificial Sequence
  Description of Artificial Sequence:  Enzymatic Nucleic Acid
aggccacacugaugaggccguuaggccgaaacucccug

SEQ ID NO: 9875 - RNA, 38 nt, Artificial Sequence
  Description of Artificial Sequence:  Enzymatic Nucleic Acid
agccuucccugaugaggccguuaggccgaaaggccaca

SEQ ID NO: 9876 - RNA, 38 nt, Artificial Sequence
  Description of Artificial Sequence:  Enzymatic Nucleic Acid
ucugguugcugaugaggccguuaggccgaaagccuucc

SEQ ID NO: 9877 - RNA, 38 nt, Artificial Sequence
  Description of Artificial Sequence:  Enzymatic Nucleic Acid
cagacuggcugaugaggccguuaggccgaaagccacug

SEQ ID NO: 9878 - RNA, 38 nt, Artificial Sequence
  Description of Artificial Sequence:  Enzymatic Nucleic Acid
gauacccacugaugaggccguuaggccgaaacugguag

SEQ ID NO: 9879 - RNA, 38 nt, Artificial Sequence
  Description of Artificial Sequence:  Enzymatic Nucleic Acid
cugagugacugaugaggccguuaggccgaaacccagac

SEQ ID NO: 9880 - RNA, 38 nt, Artificial Sequence
  Description of Artificial Sequence:  Enzymatic Nucleic Acid
aucugagucugaugaggccguuaggccgaaauacccag

SEQ ID NO: 9881 - RNA, 38 nt, Artificial Sequence
  Description of Artificial Sequence:  Enzymatic Nucleic Acid
ugucaucucugaugaggccguuaggccgaaagugauac

SEQ ID NO: 9882 - RNA, 38 nt, Artificial Sequence
  Description of Artificial Sequence:  Enzymatic Nucleic Acid
cgcuggagcugaugaggccguuaggccgaaacacggug

SEQ ID NO: 9883 - RNA, 38 nt, Artificial Sequence
  Description of Artificial Sequence:  Enzymatic Nucleic Acid
cgucgcugcugaugaggccguuaggccgaaaguacacg

SEQ ID NO: 9884 - RNA, 38 nt, Artificial Sequence
  Description of Artificial Sequence:  Enzymatic Nucleic Acid
aucuuuaacugaugaggccguuaggccgaaaguccugc

SEQ ID NO: 9885 - RNA, 38 nt, Artificial Sequence
  Description of Artificial Sequence:  Enzymatic Nucleic Acid
caucuuuacugaugaggccguuaggccgaaaaguccug

SEQ ID NO: 9886 - RNA, 38 nt, Artificial Sequence
  Description of Artificial Sequence:  Enzymatic Nucleic Acid
ccaucuuucugaugaggccguuaggccgaaaaaguccu

SEQ ID NO: 9887 - RNA, 38 nt, Artificial Sequence
  Description of Artificial Sequence:  Enzymatic Nucleic Acid
accaucuucugaugaggccguuaggccgaaaaaagucc

SEQ ID NO: 9888 - RNA, 38 nt, Artificial Sequence
  Description of Artificial Sequence:  Enzymatic Nucleic Acid
ucagcgugcugaugaggccguuaggccgaaacugcagc

SEQ ID NO: 9889 - RNA, 38 nt, Artificial Sequence
  Description of Artificial Sequence:  Enzymatic Nucleic Acid
gucagcgucugaugaggccguuaggccgaaaacugcag

SEQ ID NO: 9890 - RNA, 38 nt, Artificial Sequence
  Description of Artificial Sequence:  Enzymatic Nucleic Acid
uggucccucugaugaggccguuaggccgaaagucagcg

SEQ ID NO: 9891 - RNA, 38 nt, Artificial Sequence
  Description of Artificial Sequence:  Enzymatic Nucleic Acid
caggaggucugaugaggccguuaggccgaaagcugcag

SEQ ID NO: 9892 - RNA, 38 nt, Artificial Sequence
  Description of Artificial Sequence:  Enzymatic Nucleic Acid
uuaaacagcugaugaggccguuaggccgaaaggugagc

SEQ ID NO: 9893 - RNA, 38 nt, Artificial Sequence
  Description of Artificial Sequence:  Enzymatic Nucleic Acid
uccauuuacugaugaggccguuaggccgaaacaggagg

SEQ ID NO: 9894 - RNA, 38 nt, Artificial Sequence
  Description of Artificial Sequence:  Enzymatic Nucleic Acid
uuccauuucugaugaggccguuaggccgaaaacaggag

SEQ ID NO: 9895 - RNA, 38 nt, Artificial Sequence
  Description of Artificial Sequence:  Enzymatic Nucleic Acid
cuuccauucugaugaggccguuaggccgaaaaacagga

SEQ ID NO: 9896 - RNA, 38 nt, Artificial Sequence
  Description of Artificial Sequence:  Enzymatic Nucleic Acid
cgggacagcugaugaggccguuaggccgaaaccacuuc

SEQ ID NO: 9897 - RNA, 38 nt, Artificial Sequence
  Description of Artificial Sequence:  Enzymatic Nucleic Acid
ggagccggcugaugaggccguuaggccgaaacaggacc

SEQ ID NO: 9898 - RNA, 38 nt, Artificial Sequence
  Description of Artificial Sequence:  Enzymatic Nucleic Acid
ugggggcgcugaugaggccguuaggccgaaagccggga

SEQ ID NO: 9899 - RNA, 38 nt, Artificial Sequence
  Description of Artificial Sequence:  Enzymatic Nucleic Acid
auuuccagcugaugaggccguuaggccgaaaguugggg

SEQ ID NO: 9900 - RNA, 38 nt, Artificial Sequence
  Description of Artificial Sequence:  Enzymatic Nucleic Acid
ucucucgucugaugaggccguuaggccgaaauuuccag

SEQ ID NO: 9901 - RNA, 38 nt, Artificial Sequence
  Description of Artificial Sequence:  Enzymatic Nucleic Acid
gaaaaucucugaugaggccguuaggccgaaagcagcac

SEQ ID NO: 9902 - RNA, 38 nt, Artificial Sequence
  Description of Artificial Sequence:  Enzymatic Nucleic Acid
ugaaaauccugaugaggccguuaggccgaaaagcagca

SEQ ID NO: 9903 - RNA, 38 nt, Artificial Sequence
  Description of Artificial Sequence:  Enzymatic Nucleic Acid
cacuugaacugaugaggccguuaggccgaaaucuaagc

SEQ ID NO: 9904 - RNA, 38 nt, Artificial Sequence
  Description of Artificial Sequence:  Enzymatic Nucleic Acid
acacuugacugaugaggccguuaggccgaaaaucuaag

SEQ ID NO: 9905 - RNA, 38 nt, Artificial Sequence
  Description of Artificial Sequence:  Enzymatic Nucleic Acid
aacacuugcugaugaggccguuaggccgaaaaaucuaa

SEQ ID NO: 9906 - RNA, 38 nt, Artificial Sequence
  Description of Artificial Sequence:  Enzymatic Nucleic Acid
caacacuucugaugaggccguuaggccgaaaaaaucua

SEQ ID NO: 9907 - RNA, 38 nt, Artificial Sequence
  Description of Artificial Sequence:  Enzymatic Nucleic Acid
gaaagaaccugaugaggccguuaggccgaaacacuuga

SEQ ID NO: 9908 - RNA, 38 nt, Artificial Sequence
  Description of Artificial Sequence:  Enzymatic Nucleic Acid
gugguggacugaugaggccguuaggccgaaagaacaac

SEQ ID NO: 9909 - RNA, 38 nt, Artificial Sequence
  Description of Artificial Sequence:  Enzymatic Nucleic Acid
ggugguggcugaugaggccguuaggccgaaaagaacaa

SEQ ID NO: 9910 - RNA, 38 nt, Artificial Sequence
  Description of Artificial Sequence:  Enzymatic Nucleic Acid
ggguggugcugaugaggccguuaggccgaaaaagaaca

SEQ ID NO: 9911 - RNA, 38 nt, Artificial Sequence
  Description of Artificial Sequence:  Enzymatic Nucleic Acid
aauguggccugaugaggccguuaggccgaaacuuccgg

SEQ ID NO: 9912 - RNA, 38 nt, Artificial Sequence
  Description of Artificial Sequence:  Enzymatic Nucleic Acid
gaaaaucacugaugaggccguuaggccgaaauguggcu

SEQ ID NO: 9913 - RNA, 38 nt, Artificial Sequence
  Description of Artificial Sequence:  Enzymatic Nucleic Acid
ugaaaauccugaugaggccguuaggccgaaaauguggc

SEQ ID NO: 9914 - RNA, 38 nt, Artificial Sequence
  Description of Artificial Sequence:  Enzymatic Nucleic Acid
aaaaugaacugaugaggccguuaggccgaaaucaaaug

SEQ ID NO: 9915 - RNA, 38 nt, Artificial Sequence
  Description of Artificial Sequence:  Enzymatic Nucleic Acid
aaaaaugacugaugaggccguuaggccgaaaaucaaau

SEQ ID NO: 9916 - RNA, 38 nt, Artificial Sequence
  Description of Artificial Sequence:  Enzymatic Nucleic Acid
caaaaaugcugaugaggccguuaggccgaaaaaucaaa

SEQ ID NO: 9917 - RNA, 38 nt, Artificial Sequence
  Description of Artificial Sequence:  Enzymatic Nucleic Acid
ccaaaaaucugaugaggccguuaggccgaaaaaaucaa

SEQ ID NO: 9918 - RNA, 38 nt, Artificial Sequence
  Description of Artificial Sequence:  Enzymatic Nucleic Acid
ccuccaaacugaugaggccguuaggccgaaaugaaaau

SEQ ID NO: 9919 - RNA, 38 nt, Artificial Sequence
  Description of Artificial Sequence:  Enzymatic Nucleic Acid
uccuccaacugaugaggccguuaggccgaaaaugaaaa

SEQ ID NO: 9920 - RNA, 38 nt, Artificial Sequence
  Description of Artificial Sequence:  Enzymatic Nucleic Acid
cuccuccacugaugaggccguuaggccgaaaaaugaaa

SEQ ID NO: 9921 - RNA, 38 nt, Artificial Sequence
  Description of Artificial Sequence:  Enzymatic Nucleic Acid
ccuccucccugaugaggccguuaggccgaaaaaaugaa

SEQ ID NO: 9922 - RNA, 38 nt, Artificial Sequence
  Description of Artificial Sequence:  Enzymatic Nucleic Acid
ugcagucucugaugaggccguuaggccgaaaggucccu

SEQ ID NO: 9923 - RNA, 38 nt, Artificial Sequence
  Description of Artificial Sequence:  Enzymatic Nucleic Acid
cugaggaccugaugaggccguuaggccgaaagcuccuu

SEQ ID NO: 9924 - RNA, 38 nt, Artificial Sequence
  Description of Artificial Sequence:  Enzymatic Nucleic Acid
gcccugagcugaugaggccguuaggccgaaacaagcuc

SEQ ID NO: 9925 - RNA, 38 nt, Artificial Sequence
  Description of Artificial Sequence:  Enzymatic Nucleic Acid
aaugcccucugaugaggccguuaggccgaaaggacaag

SEQ ID NO: 9926 - RNA, 38 nt, Artificial Sequence
  Description of Artificial Sequence:  Enzymatic Nucleic Acid
ucucuggacugaugaggccguuaggccgaaaugcccug

SEQ ID NO: 9927 - RNA, 38 nt, Artificial Sequence
  Description of Artificial Sequence:  Enzymatic Nucleic Acid
uucucuggcugaugaggccguuaggccgaaaaugcccu

SEQ ID NO: 9928 - RNA, 38 nt, Artificial Sequence
  Description of Artificial Sequence:  Enzymatic Nucleic Acid
cuucucugcugaugaggccguuaggccgaaaaaugccc

SEQ ID NO: 9929 - RNA, 38 nt, Artificial Sequence
  Description of Artificial Sequence:  Enzymatic Nucleic Acid
guagaguccugaugaggccguuaggccgaaacacauuc

SEQ ID NO: 9930 - RNA, 38 nt, Artificial Sequence
  Description of Artificial Sequence:  Enzymatic Nucleic Acid
agagaguacugaugaggccguuaggccgaaagucaaca

SEQ ID NO: 9931 - RNA, 38 nt, Artificial Sequence
  Description of Artificial Sequence:  Enzymatic Nucleic Acid
aaagagagcugaugaggccguuaggccgaaagagucaa

SEQ ID NO: 9932 - RNA, 38 nt, Artificial Sequence
  Description of Artificial Sequence:  Enzymatic Nucleic Acid
ggaaaagacugaugaggccguuaggccgaaaguagagu

SEQ ID NO: 9933 - RNA, 38 nt, Artificial Sequence
  Description of Artificial Sequence:  Enzymatic Nucleic Acid
auggaaaacugaugaggccguuaggccgaaagaguaga

SEQ ID NO: 9934 - RNA, 38 nt, Artificial Sequence
  Description of Artificial Sequence:  Enzymatic Nucleic Acid
gaauggaacugaugaggccguuaggccgaaagagagua

SEQ ID NO: 9935 - RNA, 38 nt, Artificial Sequence
  Description of Artificial Sequence:  Enzymatic Nucleic Acid
ugaauggacugaugaggccguuaggccgaaaagagagu

SEQ ID NO: 9936 - RNA, 38 nt, Artificial Sequence
  Description of Artificial Sequence:  Enzymatic Nucleic Acid
augaauggcugaugaggccguuaggccgaaaaagagag

SEQ ID NO: 9937 - RNA, 38 nt, Artificial Sequence
  Description of Artificial Sequence:  Enzymatic Nucleic Acid
aaugaaugcugaugaggccguuaggccgaaaaaagaga

SEQ ID NO: 9938 - RNA, 38 nt, Artificial Sequence
  Description of Artificial Sequence:  Enzymatic Nucleic Acid
uuuaaaugcugaugaggccguuaggccgaaauggaaaa

SEQ ID NO: 9939 - RNA, 38 nt, Artificial Sequence
  Description of Artificial Sequence:  Enzymatic Nucleic Acid
uuuuaaaucugaugaggccguuaggccgaaaauggaaa

SEQ ID NO: 9940 - RNA, 38 nt, Artificial Sequence
  Description of Artificial Sequence:  Enzymatic Nucleic Acid
gacuuuuacugaugaggccguuaggccgaaaugaaugg

SEQ ID NO: 9941 - RNA, 38 nt, Artificial Sequence
  Description of Artificial Sequence:  Enzymatic Nucleic Acid
ggacuuuucugaugaggccguuaggccgaaaaugaaug

SEQ ID NO: 9942 - RNA, 38 nt, Artificial Sequence
  Description of Artificial Sequence:  Enzymatic Nucleic Acid
aggacuuucugaugaggccguuaggccgaaaaaugaau

SEQ ID NO: 9943 - RNA, 38 nt, Artificial Sequence
  Description of Artificial Sequence:  Enzymatic Nucleic Acid
uuauauagcugaugaggccguuaggccgaaacuuuuaa

SEQ ID NO: 9944 - RNA, 38 nt, Artificial Sequence
  Description of Artificial Sequence:  Enzymatic Nucleic Acid
acauuauacugaugaggccguuaggccgaaaggacuuu

SEQ ID NO: 9945 - RNA, 38 nt, Artificial Sequence
  Description of Artificial Sequence:  Enzymatic Nucleic Acid
gcacauuacugaugaggccguuaggccgaaauaggacu

SEQ ID NO: 9946 - RNA, 38 nt, Artificial Sequence
  Description of Artificial Sequence:  Enzymatic Nucleic Acid
gggcacaucugaugaggccguuaggccgaaauauagga

SEQ ID NO: 9947 - RNA, 38 nt, Artificial Sequence
  Description of Artificial Sequence:  Enzymatic Nucleic Acid
gguagugacugaugaggccguuaggccgaaaccacagc

SEQ ID NO: 9948 - RNA, 38 nt, Artificial Sequence
  Description of Artificial Sequence:  Enzymatic Nucleic Acid
cugguagucugaugaggccguuaggccgaaagaccaca

SEQ ID NO: 9949 - RNA, 38 nt, Artificial Sequence
  Description of Artificial Sequence:  Enzymatic Nucleic Acid
uuaacuggcugaugaggccguuaggccgaaagugagac

SEQ ID NO: 9950 - RNA, 38 nt, Artificial Sequence
  Description of Artificial Sequence:  Enzymatic Nucleic Acid
uuugcuuucugaugaggccguuaggccgaaacugguag

SEQ ID NO: 9951 - RNA, 38 nt, Artificial Sequence
  Description of Artificial Sequence:  Enzymatic Nucleic Acid
uuuugcuucugaugaggccguuaggccgaaaacuggua

SEQ ID NO: 9952 - RNA, 38 nt, Artificial Sequence
  Description of Artificial Sequence:  Enzymatic Nucleic Acid
guguuugacugaugaggccguuaggccgaaagucuuuu

SEQ ID NO: 9953 - RNA, 38 nt, Artificial Sequence
  Description of Artificial Sequence:  Enzymatic Nucleic Acid
cguguuugcugaugaggccguuaggccgaaaagucuuu

SEQ ID NO: 9954 - RNA, 38 nt, Artificial Sequence
  Description of Artificial Sequence:  Enzymatic Nucleic Acid
acguguuucugaugaggccguuaggccgaaaaagucuu

SEQ ID NO: 9955 - RNA, 38 nt, Artificial Sequence
  Description of Artificial Sequence:  Enzymatic Nucleic Acid
ggaggacacugaugaggccguuaggccgaaaguccacg

SEQ ID NO: 9956 - RNA, 38 nt, Artificial Sequence
  Description of Artificial Sequence:  Enzymatic Nucleic Acid
ucuuggagcugaugaggccguuaggccgaaacagaguc

SEQ ID NO: 9957 - RNA, 38 nt, Artificial Sequence
  Description of Artificial Sequence:  Enzymatic Nucleic Acid
acuucuugcugaugaggccguuaggccgaaaggacaga

SEQ ID NO: 9958 - RNA, 38 nt, Artificial Sequence
  Description of Artificial Sequence:  Enzymatic Nucleic Acid
guuucacacugaugaggccguuaggccgaaaggugccg

SEQ ID NO: 9959 - RNA, 38 nt, Artificial Sequence
  Description of Artificial Sequence:  Enzymatic Nucleic Acid
gcccauuccugaugaggccguuaggccgaaauccaguu

SEQ ID NO: 9960 - RNA, 38 nt, Artificial Sequence
  Description of Artificial Sequence:  Enzymatic Nucleic Acid
aacacacacugaugaggccguuaggccgaaagcauugc

SEQ ID NO: 9961 - RNA, 38 nt, Artificial Sequence
  Description of Artificial Sequence:  Enzymatic Nucleic Acid
caacacaccugaugaggccguuaggccgaaaagcauug

SEQ ID NO: 9962 - RNA, 38 nt, Artificial Sequence
  Description of Artificial Sequence:  Enzymatic Nucleic Acid
ccauccuccugaugaggccguuaggccgaaacacacaa

SEQ ID NO: 9963 - RNA, 38 nt, Artificial Sequence
  Description of Artificial Sequence:  Enzymatic Nucleic Acid
ggcccuggcugaugaggccguuaggccgaaacaucuca

SEQ ID NO: 9964 - RNA, 38 nt, Artificial Sequence
  Description of Artificial Sequence:  Enzymatic Nucleic Acid
gguagacacugaugaggccguuaggccgaaacucggcc

SEQ ID NO: 9965 - RNA, 38 nt, Artificial Sequence
  Description of Artificial Sequence:  Enzymatic Nucleic Acid
ccaagguacugaugaggccguuaggccgaaacagacuc

SEQ ID NO: 9966 - RNA, 38 nt, Artificial Sequence
  Description of Artificial Sequence:  Enzymatic Nucleic Acid
cuccaaggcugaugaggccguuaggccgaaagacagac

SEQ ID NO: 9967 - RNA, 38 nt, Artificial Sequence
  Description of Artificial Sequence:  Enzymatic Nucleic Acid
aagccucccugaugaggccguuaggccgaaagguagac

SEQ ID NO: 9968 - RNA, 38 nt, Artificial Sequence
  Description of Artificial Sequence:  Enzymatic Nucleic Acid
ccuccacacugaugaggccguuaggccgaaagccucca

SEQ ID NO: 9969 - RNA, 38 nt, Artificial Sequence
  Description of Artificial Sequence:  Enzymatic Nucleic Acid
uccuccaccugaugaggccguuaggccgaaaagccucc

SEQ ID NO: 9970 - RNA, 38 nt, Artificial Sequence
  Description of Artificial Sequence:  Enzymatic Nucleic Acid
uuggcucacugaugaggccguuaggccgaaagcccgca

SEQ ID NO: 9971 - RNA, 38 nt, Artificial Sequence
  Description of Artificial Sequence:  Enzymatic Nucleic Acid
ccacacuucugaugaggccguuaggccgaaacacuugg

SEQ ID NO: 9972 - RNA, 38 nt, Artificial Sequence
  Description of Artificial Sequence:  Enzymatic Nucleic Acid
cccacacucugaugaggccguuaggccgaaaacacuug

SEQ ID NO: 9973 - RNA, 38 nt, Artificial Sequence
  Description of Artificial Sequence:  Enzymatic Nucleic Acid
cuccgagccugaugaggccguuaggccgaaacuugcgc

SEQ ID NO: 9974 - RNA, 38 nt, Artificial Sequence
  Description of Artificial Sequence:  Enzymatic Nucleic Acid
cgcucucccugaugaggccguuaggccgaaagcgacuu

SEQ ID NO: 9975 - RNA, 38 nt, Artificial Sequence
  Description of Artificial Sequence:  Enzymatic Nucleic Acid
caggcucccugaugaggccguuaggccgaaaccgcucu

SEQ ID NO: 9976 - RNA, 38 nt, Artificial Sequence
  Description of Artificial Sequence:  Enzymatic Nucleic Acid
gccagcaccugaugaggccguuaggccgaaaugcaucu

SEQ ID NO: 9977 - RNA, 38 nt, Artificial Sequence
  Description of Artificial Sequence:  Enzymatic Nucleic Acid
cuccaccacugaugaggccguuaggccgaaagccagca

SEQ ID NO: 9978 - RNA, 38 nt, Artificial Sequence
  Description of Artificial Sequence:  Enzymatic Nucleic Acid
caggccaccugaugaggccguuaggccgaaagcccacc

SEQ ID NO: 9979 - RNA, 38 nt, Artificial Sequence
  Description of Artificial Sequence:  Enzymatic Nucleic Acid
cguuuccucugaugaggccguuaggccgaaacaggcca

SEQ ID NO: 9980 - RNA, 38 nt, Artificial Sequence
  Description of Artificial Sequence:  Enzymatic Nucleic Acid
caaaaccacugaugaggccguuaggccgaaacccugcc

SEQ ID NO: 9981 - RNA, 38 nt, Artificial Sequence
  Description of Artificial Sequence:  Enzymatic Nucleic Acid
ccaaaacccugaugaggccguuaggccgaaaacccugc

SEQ ID NO: 9982 - RNA, 38 nt, Artificial Sequence
  Description of Artificial Sequence:  Enzymatic Nucleic Acid
ccuuccaacugaugaggccguuaggccgaaaccaaacc

SEQ ID NO: 9983 - RNA, 38 nt, Artificial Sequence
  Description of Artificial Sequence:  Enzymatic Nucleic Acid
accuuccacugaugaggccguuaggccgaaaaccaaac

SEQ ID NO: 9984 - RNA, 38 nt, Artificial Sequence
  Description of Artificial Sequence:  Enzymatic Nucleic Acid
aaccuucccugaugaggccguuaggccgaaaaaccaaa

SEQ ID NO: 9985 - RNA, 38 nt, Artificial Sequence
  Description of Artificial Sequence:  Enzymatic Nucleic Acid
agcacgcacugaugaggccguuaggccgaaaccuucca

SEQ ID NO: 9986 - RNA, 38 nt, Artificial Sequence
  Description of Artificial Sequence:  Enzymatic Nucleic Acid
gagcacgccugaugaggccguuaggccgaaaaccuucc

SEQ ID NO: 9987 - RNA, 38 nt, Artificial Sequence
  Description of Artificial Sequence:  Enzymatic Nucleic Acid
acugugaacugaugaggccguuaggccgaaagcacgca

SEQ ID NO: 9988 - RNA, 38 nt, Artificial Sequence
  Description of Artificial Sequence:  Enzymatic Nucleic Acid
cgacugugcugaugaggccguuaggccgaaagagcacg

SEQ ID NO: 9989 - RNA, 38 nt, Artificial Sequence
  Description of Artificial Sequence:  Enzymatic Nucleic Acid
ccgacugucugaugaggccguuaggccgaaaagagcac

SEQ ID NO: 9990 - RNA, 38 nt, Artificial Sequence
  Description of Artificial Sequence:  Enzymatic Nucleic Acid
uguaaccccugaugaggccguuaggccgaaacugugaa

SEQ ID NO: 9991 - RNA, 38 nt, Artificial Sequence
  Description of Artificial Sequence:  Enzymatic Nucleic Acid
ucgccugucugaugaggccguuaggccgaaacccgacu

SEQ ID NO: 9992 - RNA, 38 nt, Artificial Sequence
  Description of Artificial Sequence:  Enzymatic Nucleic Acid
cucgccugcugaugaggccguuaggccgaaaacccgac

SEQ ID NO: 9993 - RNA, 38 nt, Artificial Sequence
  Description of Artificial Sequence:  Enzymatic Nucleic Acid
ccacagggcugaugaggccguuaggccgaaacucgccu

SEQ ID NO: 9994 - RNA, 38 nt, Artificial Sequence
  Description of Artificial Sequence:  Enzymatic Nucleic Acid
gccacaggcugaugaggccguuaggccgaaaacucgcc

SEQ ID NO: 9995 - RNA, 38 nt, Artificial Sequence
  Description of Artificial Sequence:  Enzymatic Nucleic Acid
gaguaggacugaugaggccguuaggccgaaacgccaca

SEQ ID NO: 9996 - RNA, 38 nt, Artificial Sequence
  Description of Artificial Sequence:  Enzymatic Nucleic Acid
ggaguaggcugaugaggccguuaggccgaaaacgccac

SEQ ID NO: 9997 - RNA, 38 nt, Artificial Sequence
  Description of Artificial Sequence:  Enzymatic Nucleic Acid
aggaguagcugaugaggccguuaggccgaaaaacgcca

SEQ ID NO: 9998 - RNA, 38 nt, Artificial Sequence
  Description of Artificial Sequence:  Enzymatic Nucleic Acid
auuaggagcugaugaggccguuaggccgaaaggaaacg

SEQ ID NO: 9999 - RNA, 38 nt, Artificial Sequence
  Description of Artificial Sequence:  Enzymatic Nucleic Acid
cucauuagcugaugaggccguuaggccgaaaguaggaa

SEQ ID NO: 10000 - RNA, 38 nt, Artificial Sequence
  Description of Artificial Sequence:  Enzymatic Nucleic Acid
acucucaucugaugaggccguuaggccgaaaggaguag

SEQ ID NO: 10001 - RNA, 38 nt, Artificial Sequence
  Description of Artificial Sequence:  Enzymatic Nucleic Acid
ccggaaggcugaugaggccguuaggccgaaacucucau

SEQ ID NO: 10002 - RNA, 38 nt, Artificial Sequence
  Description of Artificial Sequence:  Enzymatic Nucleic Acid
uccggaagcugaugaggccguuaggccgaaaacucuca

SEQ ID NO: 10003 - RNA, 38 nt, Artificial Sequence
  Description of Artificial Sequence:  Enzymatic Nucleic Acid
gaguccggcugaugaggccguuaggccgaaaggaacuc

SEQ ID NO: 10004 - RNA, 38 nt, Artificial Sequence
  Description of Artificial Sequence:  Enzymatic Nucleic Acid
agaguccgcugaugaggccguuaggccgaaaaggaacu

SEQ ID NO: 10005 - RNA, 38 nt, Artificial Sequence
  Description of Artificial Sequence:  Enzymatic Nucleic Acid
acacguaacugaugaggccguuaggccgaaaguccgga

SEQ ID NO: 10006 - RNA, 38 nt, Artificial Sequence
  Description of Artificial Sequence:  Enzymatic Nucleic Acid
agacacgucugaugaggccguuaggccgaaagaguccg

SEQ ID NO: 10007 - RNA, 38 nt, Artificial Sequence
  Description of Artificial Sequence:  Enzymatic Nucleic Acid
gagacacgcugaugaggccguuaggccgaaaagagucc

SEQ ID NO: 10008 - RNA, 38 nt, Artificial Sequence
  Description of Artificial Sequence:  Enzymatic Nucleic Acid
ggccaggacugaugaggccguuaggccgaaacacguaa

SEQ ID NO: 10009 - RNA, 38 nt, Artificial Sequence
  Description of Artificial Sequence:  Enzymatic Nucleic Acid
caggccagcugaugaggccguuaggccgaaagacacgu

SEQ ID NO: 10010 - RNA, 38 nt, Artificial Sequence
  Description of Artificial Sequence:  Enzymatic Nucleic Acid
gaaggagccugaugaggccguuaggccgaaagcugcau

SEQ ID NO: 10011 - RNA, 38 nt, Artificial Sequence
  Description of Artificial Sequence:  Enzymatic Nucleic Acid
ugaggaagcugaugaggccguuaggccgaaagcaagcu

SEQ ID NO: 10012 - RNA, 38 nt, Artificial Sequence
  Description of Artificial Sequence:  Enzymatic Nucleic Acid
agaugaggcugaugaggccguuaggccgaaaggagcaa

SEQ ID NO: 10013 - RNA, 38 nt, Artificial Sequence
  Description of Artificial Sequence:  Enzymatic Nucleic Acid
gagaugagcugaugaggccguuaggccgaaaaggagca

SEQ ID NO: 10014 - RNA, 38 nt, Artificial Sequence
  Description of Artificial Sequence:  Enzymatic Nucleic Acid
ugagagaucugaugaggccguuaggccgaaaggaagga

SEQ ID NO: 10015 - RNA, 38 nt, Artificial Sequence
  Description of Artificial Sequence:  Enzymatic Nucleic Acid
gccugagacugaugaggccguuaggccgaaaugaggaa

SEQ ID NO: 10016 - RNA, 38 nt, Artificial Sequence
  Description of Artificial Sequence:  Enzymatic Nucleic Acid
cagccugacugaugaggccguuaggccgaaagaugagg

SEQ ID NO: 10017 - RNA, 38 nt, Artificial Sequence
  Description of Artificial Sequence:  Enzymatic Nucleic Acid
cacagccucugaugaggccguuaggccgaaagagauga

SEQ ID NO: 10018 - RNA, 38 nt, Artificial Sequence
  Description of Artificial Sequence:  Enzymatic Nucleic Acid
ucugaauucugaugaggccguuaggccgaaaggcacag

SEQ ID NO: 10019 - RNA, 38 nt, Artificial Sequence
  Description of Artificial Sequence:  Enzymatic Nucleic Acid
uucugaaucugaugaggccguuaggccgaaaaggcaca

SEQ ID NO: 10020 - RNA, 38 nt, Artificial Sequence
  Description of Artificial Sequence:  Enzymatic Nucleic Acid
guguucugcugaugaggccguuaggccgaaauuaaggc

SEQ ID NO: 10021 - RNA, 38 nt, Artificial Sequence
  Description of Artificial Sequence:  Enzymatic Nucleic Acid
gguguucucugaugaggccguuaggccgaaaauuaagg

SEQ ID NO: 10022 - RNA, 38 nt, Artificial Sequence
  Description of Artificial Sequence:  Enzymatic Nucleic Acid
ccucugcccugaugaggccguuaggccgaaacguuccu

SEQ ID NO: 10023 - RNA, 38 nt, Artificial Sequence
  Description of Artificial Sequence:  Enzymatic Nucleic Acid
cccgucagcugaugaggccguuaggccgaaagccucug

SEQ ID NO: 10024 - RNA, 38 nt, Artificial Sequence
  Description of Artificial Sequence:  Enzymatic Nucleic Acid
guucucaccugaugaggccguuaggccgaaauucuucg

SEQ ID NO: 10025 - RNA, 38 nt, Artificial Sequence
  Description of Artificial Sequence:  Enzymatic Nucleic Acid
gaaacccucugaugaggccguuaggccgaaaguuucug

SEQ ID NO: 10026 - RNA, 38 nt, Artificial Sequence
  Description of Artificial Sequence:  Enzymatic Nucleic Acid
ccagcagacugaugaggccguuaggccgaaacccugag

SEQ ID NO: 10027 - RNA, 38 nt, Artificial Sequence
  Description of Artificial Sequence:  Enzymatic Nucleic Acid
cccagcagcugaugaggccguuaggccgaaaacccuga

SEQ ID NO: 10028 - RNA, 38 nt, Artificial Sequence
  Description of Artificial Sequence:  Enzymatic Nucleic Acid
acccagcacugaugaggccguuaggccgaaaaacccug

SEQ ID NO: 10029 - RNA, 38 nt, Artificial Sequence
  Description of Artificial Sequence:  Enzymatic Nucleic Acid
aacccucacugaugaggccguuaggccgaaaccugcca

SEQ ID NO: 10030 - RNA, 38 nt, Artificial Sequence
  Description of Artificial Sequence:  Enzymatic Nucleic Acid
ugacagagcugaugaggccguuaggccgaaacccucag

SEQ ID NO: 10031 - RNA, 38 nt, Artificial Sequence
  Description of Artificial Sequence:  Enzymatic Nucleic Acid
uugacagacugaugaggccguuaggccgaaaacccuca

SEQ ID NO: 10032 - RNA, 38 nt, Artificial Sequence
  Description of Artificial Sequence:  Enzymatic Nucleic Acid
acuugacacugaugaggccguuaggccgaaagaacccu

SEQ ID NO: 10033 - RNA, 38 nt, Artificial Sequence
  Description of Artificial Sequence:  Enzymatic Nucleic Acid
cgccacuucugaugaggccguuaggccgaaacagagaa

SEQ ID NO: 10034 - RNA, 38 nt, Artificial Sequence
  Description of Artificial Sequence:  Enzymatic Nucleic Acid
ugagccuucugaugaggccguuaggccgaaaccgccac

SEQ ID NO: 10035 - RNA, 38 nt, Artificial Sequence
  Description of Artificial Sequence:  Enzymatic Nucleic Acid
accagccucugaugaggccguuaggccgaaagccuuua

SEQ ID NO: 10036 - RNA, 38 nt, Artificial Sequence
  Description of Artificial Sequence:  Enzymatic Nucleic Acid
agaggaagcugaugaggccguuaggccgaaacaccagc

SEQ ID NO: 10037 - RNA, 38 nt, Artificial Sequence
  Description of Artificial Sequence:  Enzymatic Nucleic Acid
uagaggaacugaugaggccguuaggccgaaaacaccag

SEQ ID NO: 10038 - RNA, 38 nt, Artificial Sequence
  Description of Artificial Sequence:  Enzymatic Nucleic Acid
gauagaggcugaugaggccguuaggccgaaagaacacc

SEQ ID NO: 10039 - RNA, 38 nt, Artificial Sequence
  Description of Artificial Sequence:  Enzymatic Nucleic Acid
agauagagcugaugaggccguuaggccgaaaagaacac

SEQ ID NO: 10040 - RNA, 38 nt, Artificial Sequence
  Description of Artificial Sequence:  Enzymatic Nucleic Acid
uggagauacugaugaggccguuaggccgaaaggaagaa

SEQ ID NO: 10041 - RNA, 38 nt, Artificial Sequence
  Description of Artificial Sequence:  Enzymatic Nucleic Acid
aguggagacugaugaggccguuaggccgaaagaggaag

SEQ ID NO: 10042 - RNA, 38 nt, Artificial Sequence
  Description of Artificial Sequence:  Enzymatic Nucleic Acid
ggaguggacugaugaggccguuaggccgaaauagagga

SEQ ID NO: 10043 - RNA, 38 nt, Artificial Sequence
  Description of Artificial Sequence:  Enzymatic Nucleic Acid
caggagugcugaugaggccguuaggccgaaagauagag

SEQ ID NO: 10044 - RNA, 38 nt, Artificial Sequence
  Description of Artificial Sequence:  Enzymatic Nucleic Acid
ccugacagcugaugaggccguuaggccgaaaguggaga

SEQ ID NO: 10045 - RNA, 38 nt, Artificial Sequence
  Description of Artificial Sequence:  Enzymatic Nucleic Acid
gggggccucugaugaggccguuaggccgaaacaggagu

SEQ ID NO: 10046 - RNA, 38 nt, Artificial Sequence
  Description of Artificial Sequence:  Enzymatic Nucleic Acid
auacugagcugaugaggccguuaggccgaaacuugggg

SEQ ID NO: 10047 - RNA, 38 nt, Artificial Sequence
  Description of Artificial Sequence:  Enzymatic Nucleic Acid
aaaauacucugaugaggccguuaggccgaaaggacuug

SEQ ID NO: 10048 - RNA, 38 nt, Artificial Sequence
  Description of Artificial Sequence:  Enzymatic Nucleic Acid
agcuaaaacugaugaggccguuaggccgaaacugagga

SEQ ID NO: 10049 - RNA, 38 nt, Artificial Sequence
  Description of Artificial Sequence:  Enzymatic Nucleic Acid
aaagcuaacugaugaggccguuaggccgaaauacugag

SEQ ID NO: 10050 - RNA, 38 nt, Artificial Sequence
  Description of Artificial Sequence:  Enzymatic Nucleic Acid
caaagcuacugaugaggccguuaggccgaaaauacuga

SEQ ID NO: 10051 - RNA, 38 nt, Artificial Sequence
  Description of Artificial Sequence:  Enzymatic Nucleic Acid
acaaagcucugaugaggccguuaggccgaaaaauacug

SEQ ID NO: 10052 - RNA, 38 nt, Artificial Sequence
  Description of Artificial Sequence:  Enzymatic Nucleic Acid
cacaaagccugaugaggccguuaggccgaaaaaauacu

SEQ ID NO: 10053 - RNA, 38 nt, Artificial Sequence
  Description of Artificial Sequence:  Enzymatic Nucleic Acid
aagccacacugaugaggccguuaggccgaaagcuaaaa

SEQ ID NO: 10054 - RNA, 38 nt, Artificial Sequence
  Description of Artificial Sequence:  Enzymatic Nucleic Acid
gaagccaccugaugaggccguuaggccgaaaagcuaaa

SEQ ID NO: 10055 - RNA, 38 nt, Artificial Sequence
  Description of Artificial Sequence:  Enzymatic Nucleic Acid
ccaucaggcugaugaggccguuaggccgaaagccacaa

SEQ ID NO: 10056 - RNA, 38 nt, Artificial Sequence
  Description of Artificial Sequence:  Enzymatic Nucleic Acid
gccaucagcugaugaggccguuaggccgaaaagccaca

SEQ ID NO: 10057 - RNA, 38 nt, Artificial Sequence
  Description of Artificial Sequence:  Enzymatic Nucleic Acid
ccaauuaacugaugaggccguuaggccgaaauuuuucu

SEQ ID NO: 10058 - RNA, 38 nt, Artificial Sequence
  Description of Artificial Sequence:  Enzymatic Nucleic Acid
aaccaauucugaugaggccguuaggccgaaagauuuuu

SEQ ID NO: 10059 - RNA, 38 nt, Artificial Sequence
  Description of Artificial Sequence:  Enzymatic Nucleic Acid
caaccaaucugaugaggccguuaggccgaaaagauuuu

SEQ ID NO: 10060 - RNA, 38 nt, Artificial Sequence
  Description of Artificial Sequence:  Enzymatic Nucleic Acid
aaccaacccugaugaggccguuaggccgaaauuaagau

SEQ ID NO: 10061 - RNA, 38 nt, Artificial Sequence
  Description of Artificial Sequence:  Enzymatic Nucleic Acid
agcaaacccugaugaggccguuaggccgaaaccaauua

SEQ ID NO: 10062 - RNA, 38 nt, Artificial Sequence
  Description of Artificial Sequence:  Enzymatic Nucleic Acid
ggagagcacugaugaggccguuaggccgaaaccaacca

SEQ ID NO: 10063 - RNA, 38 nt, Artificial Sequence
  Description of Artificial Sequence:  Enzymatic Nucleic Acid
uggagagccugaugaggccguuaggccgaaaaccaacc

SEQ ID NO: 10064 - RNA, 38 nt, Artificial Sequence
  Description of Artificial Sequence:  Enzymatic Nucleic Acid
uaucuggacugaugaggccguuaggccgaaagcaaacc

SEQ ID NO: 10065 - RNA, 38 nt, Artificial Sequence
  Description of Artificial Sequence:  Enzymatic Nucleic Acid
auuaucugcugaugaggccguuaggccgaaagagcaaa

SEQ ID NO: 10066 - RNA, 38 nt, Artificial Sequence
  Description of Artificial Sequence:  Enzymatic Nucleic Acid
cuagugaucugaugaggccguuaggccgaaaucuggag

SEQ ID NO: 10067 - RNA, 38 nt, Artificial Sequence
  Description of Artificial Sequence:  Enzymatic Nucleic Acid
uggcuagucugaugaggccguuaggccgaaauuaucug

SEQ ID NO: 10068 - RNA, 38 nt, Artificial Sequence
  Description of Artificial Sequence:  Enzymatic Nucleic Acid
aaucuggccugaugaggccguuaggccgaaagugauua

SEQ ID NO: 10069 - RNA, 38 nt, Artificial Sequence
  Description of Artificial Sequence:  Enzymatic Nucleic Acid
aauuucgacugaugaggccguuaggccgaaaucuggcu

SEQ ID NO: 10070 - RNA, 38 nt, Artificial Sequence
  Description of Artificial Sequence:  Enzymatic Nucleic Acid
uaauuucgcugaugaggccguuaggccgaaaaucuggc

SEQ ID NO: 10071 - RNA, 38 nt, Artificial Sequence
  Description of Artificial Sequence:  Enzymatic Nucleic Acid
guaauuuccugaugaggccguuaggccgaaaaaucugg

SEQ ID NO: 10072 - RNA, 38 nt, Artificial Sequence
  Description of Artificial Sequence:  Enzymatic Nucleic Acid
uaaaaagucugaugaggccguuaggccgaaauuucgaa

SEQ ID NO: 10073 - RNA, 38 nt, Artificial Sequence
  Description of Artificial Sequence:  Enzymatic Nucleic Acid
cuaaaaagcugaugaggccguuaggccgaaaauuucga

SEQ ID NO: 10074 - RNA, 38 nt, Artificial Sequence
  Description of Artificial Sequence:  Enzymatic Nucleic Acid
cggcuaaacugaugaggccguuaggccgaaaguaauuu

SEQ ID NO: 10075 - RNA, 38 nt, Artificial Sequence
  Description of Artificial Sequence:  Enzymatic Nucleic Acid
ucggcuaacugaugaggccguuaggccgaaaaguaauu

SEQ ID NO: 10076 - RNA, 38 nt, Artificial Sequence
  Description of Artificial Sequence:  Enzymatic Nucleic Acid
cucggcuacugaugaggccguuaggccgaaaaaguaau

SEQ ID NO: 10077 - RNA, 38 nt, Artificial Sequence
  Description of Artificial Sequence:  Enzymatic Nucleic Acid
ccucggcucugaugaggccguuaggccgaaaaaaguaa

SEQ ID NO: 10078 - RNA, 38 nt, Artificial Sequence
  Description of Artificial Sequence:  Enzymatic Nucleic Acid
accucggccugaugaggccguuaggccgaaaaaaagua

SEQ ID NO: 10079 - RNA, 38 nt, Artificial Sequence
  Description of Artificial Sequence:  Enzymatic Nucleic Acid
guuaucaucugaugaggccguuaggccgaaaccucggc

SEQ ID NO: 10080 - RNA, 38 nt, Artificial Sequence
  Description of Artificial Sequence:  Enzymatic Nucleic Acid
uguuaucacugaugaggccguuaggccgaaaaccucgg

SEQ ID NO: 10081 - RNA, 38 nt, Artificial Sequence
  Description of Artificial Sequence:  Enzymatic Nucleic Acid
guagaugucugaugaggccguuaggccgaaaucauaac

SEQ ID NO: 10082 - RNA, 38 nt, Artificial Sequence
  Description of Artificial Sequence:  Enzymatic Nucleic Acid
auacaguacugaugaggccguuaggccgaaauguuauc

SEQ ID NO: 10083 - RNA, 38 nt, Artificial Sequence
  Description of Artificial Sequence:  Enzymatic Nucleic Acid
ggauacagcugaugaggccguuaggccgaaagauguua

SEQ ID NO: 10084 - RNA, 38 nt, Artificial Sequence
  Description of Artificial Sequence:  Enzymatic Nucleic Acid
cuaaaggacugaugaggccguuaggccgaaacaguaga

SEQ ID NO: 10085 - RNA, 38 nt, Artificial Sequence
  Description of Artificial Sequence:  Enzymatic Nucleic Acid
uucuaaagcugaugaggccguuaggccgaaauacagua

SEQ ID NO: 10086 - RNA, 38 nt, Artificial Sequence
  Description of Artificial Sequence:  Enzymatic Nucleic Acid
aaauucuacugaugaggccguuaggccgaaaggauaca

SEQ ID NO: 10087 - RNA, 38 nt, Artificial Sequence
  Description of Artificial Sequence:  Enzymatic Nucleic Acid
aaaauucucugaugaggccguuaggccgaaaaggauac

SEQ ID NO: 10088 - RNA, 38 nt, Artificial Sequence
  Description of Artificial Sequence:  Enzymatic Nucleic Acid
uaaaauuccugaugaggccguuaggccgaaaaaggaua

SEQ ID NO: 10089 - RNA, 38 nt, Artificial Sequence
  Description of Artificial Sequence:  Enzymatic Nucleic Acid
uagguuaacugaugaggccguuaggccgaaauucuaaa

SEQ ID NO: 10090 - RNA, 38 nt, Artificial Sequence
  Description of Artificial Sequence:  Enzymatic Nucleic Acid
auagguuacugaugaggccguuaggccgaaaauucuaa

SEQ ID NO: 10091 - RNA, 38 nt, Artificial Sequence
  Description of Artificial Sequence:  Enzymatic Nucleic Acid
uauagguucugaugaggccguuaggccgaaaaauucua

SEQ ID NO: 10092 - RNA, 38 nt, Artificial Sequence
  Description of Artificial Sequence:  Enzymatic Nucleic Acid
uuauaggucugaugaggccguuaggccgaaaaaauucu

SEQ ID NO: 10093 - RNA, 38 nt, Artificial Sequence
  Description of Artificial Sequence:  Enzymatic Nucleic Acid
uaguuuuacugaugaggccguuaggccgaaagguuaaa

SEQ ID NO: 10094 - RNA, 38 nt, Artificial Sequence
  Description of Artificial Sequence:  Enzymatic Nucleic Acid
cauaguuucugaugaggccguuaggccgaaauagguua

SEQ ID NO: 10095 - RNA, 38 nt, Artificial Sequence
  Description of Artificial Sequence:  Enzymatic Nucleic Acid
aguagacacugaugaggccguuaggccgaaaguuuuau

SEQ ID NO: 10096 - RNA, 38 nt, Artificial Sequence
  Description of Artificial Sequence:  Enzymatic Nucleic Acid
aaccaguacugaugaggccguuaggccgaaacauaguu

SEQ ID NO: 10097 - RNA, 38 nt, Artificial Sequence
  Description of Artificial Sequence:  Enzymatic Nucleic Acid
gaaaccagcugaugaggccguuaggccgaaagacauag

SEQ ID NO: 10098 - RNA, 38 nt, Artificial Sequence
  Description of Artificial Sequence:  Enzymatic Nucleic Acid
caggcagacugaugaggccguuaggccgaaaccaguag

SEQ ID NO: 10099 - RNA, 38 nt, Artificial Sequence
  Description of Artificial Sequence:  Enzymatic Nucleic Acid
acaggcagcugaugaggccguuaggccgaaaaccagua

SEQ ID NO: 10100 - RNA, 38 nt, Artificial Sequence
  Description of Artificial Sequence:  Enzymatic Nucleic Acid
cacaggcacugaugaggccguuaggccgaaaaaccagu

SEQ ID NO: 10101 - RNA, 54 nt, Artificial Sequence
  Description of Artificial Sequence:  Enzymatic Nucleic Acid
gggacacaagaagggcccaccagagaaacacacguugugguacauuaccuggua

SEQ ID NO: 10102 - RNA, 54 nt, Artificial Sequence
  Description of Artificial Sequence:  Enzymatic Nucleic Acid
guuaucccagaagcgggaaccagagaaacacacguugugguacauuaccuggua

SEQ ID NO: 10103 - RNA, 54 nt, Artificial Sequence
  Description of Artificial Sequence:  Enzymatic Nucleic Acid
ggaaucggagaagccaggaccagagaaacacacguugugguacauuaccuggua

SEQ ID NO: 10104 - RNA, 54 nt, Artificial Sequence
  Description of Artificial Sequence:  Enzymatic Nucleic Acid
uccgcggaagaaggucagaccagagaaacacacguugugguacauuaccuggua

SEQ ID NO: 10105 - RNA, 54 nt, Artificial Sequence
  Description of Artificial Sequence:  Enzymatic Nucleic Acid
cggcugucagaaguguccaccagagaaacacacguugugguacauuaccuggua

SEQ ID NO: 10106 - RNA, 54 nt, Artificial Sequence
  Description of Artificial Sequence:  Enzymatic Nucleic Acid
ccagccgcagaagucagcaccagagaaacacacguugugguacauuaccuggua

SEQ ID NO: 10107 - RNA, 54 nt, Artificial Sequence
  Description of Artificial Sequence:  Enzymatic Nucleic Acid
cuggcuccagaagcggcuaccagagaaacacacguugugguacauuaccuggua

SEQ ID NO: 10108 - RNA, 54 nt, Artificial Sequence
  Description of Artificial Sequence:  Enzymatic Nucleic Acid
cagcgcaaagaaggggagaccagagaaacacacguugugguacauuaccuggua

SEQ ID NO: 10109 - RNA, 54 nt, Artificial Sequence
  Description of Artificial Sequence:  Enzymatic Nucleic Acid
gucacagaagaaguauggaccagagaaacacacguugugguacauuaccuggua

SEQ ID NO: 10110 - RNA, 54 nt, Artificial Sequence
  Description of Artificial Sequence:  Enzymatic Nucleic Acid
cacagagcagaagcuagcaccagagaaacacacguugugguacauuaccuggua

SEQ ID NO: 10111 - RNA, 54 nt, Artificial Sequence
  Description of Artificial Sequence:  Enzymatic Nucleic Acid
cccacagaagaagcucggaccagagaaacacacguugugguacauuaccuggua

SEQ ID NO: 10112 - RNA, 54 nt, Artificial Sequence
  Description of Artificial Sequence:  Enzymatic Nucleic Acid
ugcaaguaagaagaagggaccagagaaacacacguugugguacauuaccuggua

SEQ ID NO: 10113 - RNA, 54 nt, Artificial Sequence
  Description of Artificial Sequence:  Enzymatic Nucleic Acid
uagacauaagaaguggagaccagagaaacacacguugugguacauuaccuggua

SEQ ID NO: 10114 - RNA, 54 nt, Artificial Sequence
  Description of Artificial Sequence:  Enzymatic Nucleic Acid
gaauggugagaaguaaucaccagagaaacacacguugugguacauuaccuggua

SEQ ID NO: 10115 - RNA, 54 nt, Artificial Sequence
  Description of Artificial Sequence:  Enzymatic Nucleic Acid
cgacccucagaaggggauaccagagaaacacacguugugguacauuaccuggua

SEQ ID NO: 10116 - RNA, 54 nt, Artificial Sequence
  Description of Artificial Sequence:  Enzymatic Nucleic Acid
cuguuuccagaaggaacaaccagagaaacacacguugugguacauuaccuggua

SEQ ID NO: 10117 - RNA, 54 nt, Artificial Sequence
  Description of Artificial Sequence:  Enzymatic Nucleic Acid
acaugauaagaagauaggaccagagaaacacacguugugguacauuaccuggua

SEQ ID NO: 10118 - RNA, 54 nt, Artificial Sequence
  Description of Artificial Sequence:  Enzymatic Nucleic Acid
uuuucuccagaagauagcaccagagaaacacacguugugguacauuaccuggua

SEQ ID NO: 10119 - RNA, 54 nt, Artificial Sequence
  Description of Artificial Sequence:  Enzymatic Nucleic Acid
ucuugaucagaaguccacaccagagaaacacacguugugguacauuaccuggua

SEQ ID NO: 10120 - RNA, 54 nt, Artificial Sequence
  Description of Artificial Sequence:  Enzymatic Nucleic Acid
auaucaggagaaggguaaaccagagaaacacacguugugguacauuaccuggua

SEQ ID NO: 10121 - RNA, 54 nt, Artificial Sequence
  Description of Artificial Sequence:  Enzymatic Nucleic Acid
ucucaccgagaaggggugaccagagaaacacacguugugguacauuaccuggua

SEQ ID NO: 10122 - RNA, 54 nt, Artificial Sequence
  Description of Artificial Sequence:  Enzymatic Nucleic Acid
uuggcguaagaagugcauaccagagaaacacacguugugguacauuaccuggua

SEQ ID NO: 10123 - RNA, 54 nt, Artificial Sequence
  Description of Artificial Sequence:  Enzymatic Nucleic Acid
ucuguaggagaaggcuucaccagagaaacacacguugugguacauuaccuggua

SEQ ID NO: 10124 - RNA, 54 nt, Artificial Sequence
  Description of Artificial Sequence:  Enzymatic Nucleic Acid
uuggccggagaaguaggaaccagagaaacacacguugugguacauuaccuggua

SEQ ID NO: 10125 - RNA, 54 nt, Artificial Sequence
  Description of Artificial Sequence:  Enzymatic Nucleic Acid
uuccuucaagaagggcauaccagagaaacacacguugugguacauuaccuggua

SEQ ID NO: 10126 - RNA, 54 nt, Artificial Sequence
  Description of Artificial Sequence:  Enzymatic Nucleic Acid
ggcugggcagaagguugcaccagagaaacacacguugugguacauuaccuggua

SEQ ID NO: 10127 - RNA, 54 nt, Artificial Sequence
  Description of Artificial Sequence:  Enzymatic Nucleic Acid
guuggcugagaagcagguaccagagaaacacacguugugguacauuaccuggua

SEQ ID NO: 10128 - RNA, 54 nt, Artificial Sequence
  Description of Artificial Sequence:  Enzymatic Nucleic Acid
cagugcacagaagggacaaccagagaaacacacguugugguacauuaccuggua

SEQ ID NO: 10129 - RNA, 54 nt, Artificial Sequence
  Description of Artificial Sequence:  Enzymatic Nucleic Acid
cccaugugagaagauguuaccagagaaacacacguugugguacauuaccuggua

SEQ ID NO: 10130 - RNA, 54 nt, Artificial Sequence
  Description of Artificial Sequence:  Enzymatic Nucleic Acid
uuaucuugagaagagcaaaccagagaaacacacguugugguacauuaccuggua

SEQ ID NO: 10131 - RNA, 54 nt, Artificial Sequence
  Description of Artificial Sequence:  Enzymatic Nucleic Acid
ggaugaugagaaguuugaaccagagaaacacacguugugguacauuaccuggua

SEQ ID NO: 10132 - RNA, 54 nt, Artificial Sequence
  Description of Artificial Sequence:  Enzymatic Nucleic Acid
ugcggauaagaagguuccaccagagaaacacacguugugguacauuaccuggua

SEQ ID NO: 10133 - RNA, 54 nt, Artificial Sequence
  Description of Artificial Sequence:  Enzymatic Nucleic Acid
gcuuaacgagaaguaggaaccagagaaacacacguugugguacauuaccuggua

SEQ ID NO: 10134 - RNA, 54 nt, Artificial Sequence
  Description of Artificial Sequence:  Enzymatic Nucleic Acid
ggcaauucagaaggauccaccagagaaacacacguugugguacauuaccuggua

SEQ ID NO: 10135 - RNA, 54 nt, Artificial Sequence
  Description of Artificial Sequence:  Enzymatic Nucleic Acid
cuaguuucagaaggucccaccagagaaacacacguugugguacauuaccuggua

SEQ ID NO: 10136 - RNA, 54 nt, Artificial Sequence
  Description of Artificial Sequence:  Enzymatic Nucleic Acid
ccaaaagcagaagccucaaccagagaaacacacguugugguacauuaccuggua

SEQ ID NO: 10137 - RNA, 54 nt, Artificial Sequence
  Description of Artificial Sequence:  Enzymatic Nucleic Acid
aaagccugagaaggcagaaccagagaaacacacguugugguacauuaccuggua

SEQ ID NO: 10138 - RNA, 54 nt, Artificial Sequence
  Description of Artificial Sequence:  Enzymatic Nucleic Acid
ccgggccaagaagaagucaccagagaaacacacguugugguacauuaccuggua

SEQ ID NO: 10139 - RNA, 54 nt, Artificial Sequence
  Description of Artificial Sequence:  Enzymatic Nucleic Acid
cugacauaagaagggucuaccagagaaacacacguugugguacauuaccuggua

SEQ ID NO: 10140 - RNA, 54 nt, Artificial Sequence
  Description of Artificial Sequence:  Enzymatic Nucleic Acid
caaagggaagaaggcaucaccagagaaacacacguugugguacauuaccuggua

SEQ ID NO: 10141 - RNA, 54 nt, Artificial Sequence
  Description of Artificial Sequence:  Enzymatic Nucleic Acid
guaguguaagaaggagccaccagagaaacacacguugugguacauuaccuggua

SEQ ID NO: 10142 - RNA, 54 nt, Artificial Sequence
  Description of Artificial Sequence:  Enzymatic Nucleic Acid
cucaugccagaaguccagaccagagaaacacacguugugguacauuaccuggua

SEQ ID NO: 10143 - RNA, 54 nt, Artificial Sequence
  Description of Artificial Sequence:  Enzymatic Nucleic Acid
gugagguaagaagggagaaccagagaaacacacguugugguacauuaccuggua

SEQ ID NO: 10144 - RNA, 54 nt, Artificial Sequence
  Description of Artificial Sequence:  Enzymatic Nucleic Acid
uggcugucagaagggaucaccagagaaacacacguugugguacauuaccuggua

SEQ ID NO: 10145 - RNA, 54 nt, Artificial Sequence
  Description of Artificial Sequence:  Enzymatic Nucleic Acid
agccacugagaagguuggaccagagaaacacacguugugguacauuaccuggua

SEQ ID NO: 10146 - RNA, 54 nt, Artificial Sequence
  Description of Artificial Sequence:  Enzymatic Nucleic Acid
gauacccaagaagguagcaccagagaaacacacguugugguacauuaccuggua

SEQ ID NO: 10147 - RNA, 54 nt, Artificial Sequence
  Description of Artificial Sequence:  Enzymatic Nucleic Acid
ucagcgugagaagcagcaaccagagaaacacacguugugguacauuaccuggua

SEQ ID NO: 10148 - RNA, 54 nt, Artificial Sequence
  Description of Artificial Sequence:  Enzymatic Nucleic Acid
gucccugaagaagcgugaaccagagaaacacacguugugguacauuaccuggua

SEQ ID NO: 10149 - RNA, 54 nt, Artificial Sequence
  Description of Artificial Sequence:  Enzymatic Nucleic Acid
aggaggugagaagcagugaccagagaaacacacguugugguacauuaccuggua

SEQ ID NO: 10150 - RNA, 54 nt, Artificial Sequence
  Description of Artificial Sequence:  Enzymatic Nucleic Acid
uccauuuaagaaggagguaccagagaaacacacguugugguacauuaccuggua

SEQ ID NO: 10151 - RNA, 54 nt, Artificial Sequence
  Description of Artificial Sequence:  Enzymatic Nucleic Acid
ggagccggagaaggaccaaccagagaaacacacguugugguacauuaccuggua

SEQ ID NO: 10152 - RNA, 54 nt, Artificial Sequence
  Description of Artificial Sequence:  Enzymatic Nucleic Acid
gggggcggagaagggacaaccagagaaacacacguugugguacauuaccuggua

SEQ ID NO: 10153 - RNA, 54 nt, Artificial Sequence
  Description of Artificial Sequence:  Enzymatic Nucleic Acid
gaguugggagaagagccgaccagagaaacacacguugugguacauuaccuggua

SEQ ID NO: 10154 - RNA, 54 nt, Artificial Sequence
  Description of Artificial Sequence:  Enzymatic Nucleic Acid
aaaaucuaagaagcaccuaccagagaaacacacguugugguacauuaccuggua

SEQ ID NO: 10155 - RNA, 54 nt, Artificial Sequence
  Description of Artificial Sequence:  Enzymatic Nucleic Acid
uccuugcaagaagaggucaccagagaaacacacguugugguacauuaccuggua

SEQ ID NO: 10156 - RNA, 54 nt, Artificial Sequence
  Description of Artificial Sequence:  Enzymatic Nucleic Acid
gagaccacagaagggcacaccagagaaacacacguugugguacauuaccuggua

SEQ ID NO: 10157 - RNA, 54 nt, Artificial Sequence
  Description of Artificial Sequence:  Enzymatic Nucleic Acid
ucuuggagagaagaguccaccagagaaacacacguugugguacauuaccuggua

SEQ ID NO: 10158 - RNA, 54 nt, Artificial Sequence
  Description of Artificial Sequence:  Enzymatic Nucleic Acid
ccaagguaagaagacucgaccagagaaacacacguugugguacauuaccuggua

SEQ ID NO: 10159 - RNA, 54 nt, Artificial Sequence
  Description of Artificial Sequence:  Enzymatic Nucleic Acid
caggcuccagaagcucucaccagagaaacacacguugugguacauuaccuggua

SEQ ID NO: 10160 - RNA, 54 nt, Artificial Sequence
  Description of Artificial Sequence:  Enzymatic Nucleic Acid
cacaaugcagaagcaggcaccagagaaacacacguugugguacauuaccuggua

SEQ ID NO: 10161 - RNA, 54 nt, Artificial Sequence
  Description of Artificial Sequence:  Enzymatic Nucleic Acid
acccugccagaagccuuuaccagagaaacacacguugugguacauuaccuggua

SEQ ID NO: 10162 - RNA, 54 nt, Artificial Sequence
  Description of Artificial Sequence:  Enzymatic Nucleic Acid
uguaacccagaagugaagaccagagaaacacacguugugguacauuaccuggua

SEQ ID NO: 10163 - RNA, 54 nt, Artificial Sequence
  Description of Artificial Sequence:  Enzymatic Nucleic Acid
acguaagaagaaggaaggaccagagaaacacacguugugguacauuaccuggua

SEQ ID NO: 10164 - RNA, 54 nt, Artificial Sequence
  Description of Artificial Sequence:  Enzymatic Nucleic Acid
aaggagcaagaagcaucaaccagagaaacacacguugugguacauuaccuggua

SEQ ID NO: 10165 - RNA, 54 nt, Artificial Sequence
  Description of Artificial Sequence:  Enzymatic Nucleic Acid
ucggccccagaaggagccaccagagaaacacacguugugguacauuaccuggua

SEQ ID NO: 10166 - RNA, 54 nt, Artificial Sequence
  Description of Artificial Sequence:  Enzymatic Nucleic Acid
cuccacccagaagaaaccaccagagaaacacacguugugguacauuaccuggua

SEQ ID NO: 10167 - RNA, 54 nt, Artificial Sequence
  Description of Artificial Sequence:  Enzymatic Nucleic Acid
uuucugccagaaggaagcaccagagaaacacacguugugguacauuaccuggua

SEQ ID NO: 10168 - RNA, 54 nt, Artificial Sequence
  Description of Artificial Sequence:  Enzymatic Nucleic Acid
auuucgaaagaaggcuagaccagagaaacacacguugugguacauuaccuggua

SEQ ID NO: 10169 - RNA, 54 nt, Artificial Sequence
  Description of Artificial Sequence:  Enzymatic Nucleic Acid
agcacacaagaagaaaccaccagagaaacacacguugugguacauuaccuggua

SEQ ID NO: 10170 - RNA, 38 nt, Artificial Sequence
  Description of Artificial Sequence:  Enzymatic Nucleic Acid
gugagcaacugaugaggccguuaggccgaaacgcggcc

SEQ ID NO: 10171 - RNA, 38 nt, Artificial Sequence
  Description of Artificial Sequence:  Enzymatic Nucleic Acid
uggugagccugaugaggccguuaggccgaaagacgcgg

SEQ ID NO: 10172 - RNA, 38 nt, Artificial Sequence
  Description of Artificial Sequence:  Enzymatic Nucleic Acid
accauggucugaugaggccguuaggccgaaagcaagac

SEQ ID NO: 10173 - RNA, 38 nt, Artificial Sequence
  Description of Artificial Sequence:  Enzymatic Nucleic Acid
cagcagcucugaugaggccguuaggccgaaaccauggu

SEQ ID NO: 10174 - RNA, 38 nt, Artificial Sequence
  Description of Artificial Sequence:  Enzymatic Nucleic Acid
uaaggcaacugaugaggccguuaggccgaaaccgcggu

SEQ ID NO: 10175 - RNA, 38 nt, Artificial Sequence
  Description of Artificial Sequence:  Enzymatic Nucleic Acid
cguaaggccugaugaggccguuaggccgaaagaccgcg

SEQ ID NO: 10176 - RNA, 38 nt, Artificial Sequence
  Description of Artificial Sequence:  Enzymatic Nucleic Acid
cagcgcgucugaugaggccguuaggccgaaaggcaaga

SEQ ID NO: 10177 - RNA, 38 nt, Artificial Sequence
  Description of Artificial Sequence:  Enzymatic Nucleic Acid
gcagcgcgcugaugaggccguuaggccgaaaaggcaag

SEQ ID NO: 10178 - RNA, 38 nt, Artificial Sequence
  Description of Artificial Sequence:  Enzymatic Nucleic Acid
agacaccccugaugaggccguuaggccgaaagcagcgc

SEQ ID NO: 10179 - RNA, 38 nt, Artificial Sequence
  Description of Artificial Sequence:  Enzymatic Nucleic Acid
gagaagcacugaugaggccguuaggccgaaacacccga

SEQ ID NO: 10180 - RNA, 38 nt, Artificial Sequence
  Description of Artificial Sequence:  Enzymatic Nucleic Acid
uauccugucugaugaggccguuaggccgaaagaagcag

SEQ ID NO: 10181 - RNA, 38 nt, Artificial Sequence
  Description of Artificial Sequence:  Enzymatic Nucleic Acid
cugagccacugaugaggccguuaggccgaaauccugug

SEQ ID NO: 10182 - RNA, 38 nt, Artificial Sequence
  Description of Artificial Sequence:  Enzymatic Nucleic Acid
ucgacccucugaugaggccguuaggccgaaagccauau

SEQ ID NO: 10183 - RNA, 38 nt, Artificial Sequence
  Description of Artificial Sequence:  Enzymatic Nucleic Acid
uuaacuuccugaugaggccguuaggccgaaacccugag

SEQ ID NO: 10184 - RNA, 38 nt, Artificial Sequence
  Description of Artificial Sequence:  Enzymatic Nucleic Acid
gcacuuuucugaugaggccguuaggccgaaacuucgac

SEQ ID NO: 10185 - RNA, 38 nt, Artificial Sequence
  Description of Artificial Sequence:  Enzymatic Nucleic Acid
ggcacuuucugaugaggccguuaggccgaaaacuucga

SEQ ID NO: 10186 - RNA, 38 nt, Artificial Sequence
  Description of Artificial Sequence:  Enzymatic Nucleic Acid
gcuugcaucugaugaggccguuaggccgaaacaugcug

SEQ ID NO: 10187 - RNA, 38 nt, Artificial Sequence
  Description of Artificial Sequence:  Enzymatic Nucleic Acid
gagaaagacugaugaggccguuaggccgaaagucuggc

SEQ ID NO: 10188 - RNA, 38 nt, Artificial Sequence
  Description of Artificial Sequence:  Enzymatic Nucleic Acid
uugagaaacugaugaggccguuaggccgaaagagucug

SEQ ID NO: 10189 - RNA, 38 nt, Artificial Sequence
  Description of Artificial Sequence:  Enzymatic Nucleic Acid
acuugagacugaugaggccguuaggccgaaagagaguc

SEQ ID NO: 10190 - RNA, 38 nt, Artificial Sequence
  Description of Artificial Sequence:  Enzymatic Nucleic Acid
cacuugagcugaugaggccguuaggccgaaaagagagu

SEQ ID NO: 10191 - RNA, 38 nt, Artificial Sequence
  Description of Artificial Sequence:  Enzymatic Nucleic Acid
gcacuugacugaugaggccguuaggccgaaaaagagag

SEQ ID NO: 10192 - RNA, 38 nt, Artificial Sequence
  Description of Artificial Sequence:  Enzymatic Nucleic Acid
cugcacuucugaugaggccguuaggccgaaagaaagag

SEQ ID NO: 10193 - RNA, 38 nt, Artificial Sequence
  Description of Artificial Sequence:  Enzymatic Nucleic Acid
gagaccaucugaugaggccguuaggccgaaagugggcu

SEQ ID NO: 10194 - RNA, 38 nt, Artificial Sequence
  Description of Artificial Sequence:  Enzymatic Nucleic Acid
ugggcagacugaugaggccguuaggccgaaaccaugag

SEQ ID NO: 10195 - RNA, 38 nt, Artificial Sequence
  Description of Artificial Sequence:  Enzymatic Nucleic Acid
cgugggcacugaugaggccguuaggccgaaagaccaug

SEQ ID NO: 10196 - RNA, 38 nt, Artificial Sequence
  Description of Artificial Sequence:  Enzymatic Nucleic Acid
gggggagucugaugaggccguuaggccgaaaugcucag

SEQ ID NO: 10197 - RNA, 38 nt, Artificial Sequence
  Description of Artificial Sequence:  Enzymatic Nucleic Acid
cgauggggcugaugaggccguuaggccgaaagugaugc

SEQ ID NO: 10198 - RNA, 38 nt, Artificial Sequence
  Description of Artificial Sequence:  Enzymatic Nucleic Acid
cacaggcccugaugaggccguuaggccgaaauggggga

SEQ ID NO: 10199 - RNA, 38 nt, Artificial Sequence
  Description of Artificial Sequence:  Enzymatic Nucleic Acid
uugccugucugaugaggccguuaggccgaaaucccucc

SEQ ID NO: 10200 - RNA, 38 nt, Artificial Sequence
  Description of Artificial Sequence:  Enzymatic Nucleic Acid
ugcugcagcugaugaggccguuaggccgaaauugccug

SEQ ID NO: 10201 - RNA, 38 nt, Artificial Sequence
  Description of Artificial Sequence:  Enzymatic Nucleic Acid
gugcugcacugaugaggccguuaggccgaaaauugccu

SEQ ID NO: 10202 - RNA, 38 nt, Artificial Sequence
  Description of Artificial Sequence:  Enzymatic Nucleic Acid
ccaagguccugaugaggccguuaggccgaaaggugcug

SEQ ID NO: 10203 - RNA, 38 nt, Artificial Sequence
  Description of Artificial Sequence:  Enzymatic Nucleic Acid
ccgugucccugaugaggccguuaggccgaaaggucaag

SEQ ID NO: 10204 - RNA, 38 nt, Artificial Sequence
  Description of Artificial Sequence:  Enzymatic Nucleic Acid
cagguguacugaugaggccguuaggccgaaaggcccgu

SEQ ID NO: 10205 - RNA, 38 nt, Artificial Sequence
  Description of Artificial Sequence:  Enzymatic Nucleic Acid
uacaggugcugaugaggccguuaggccgaaagaggccc

SEQ ID NO: 10206 - RNA, 38 nt, Artificial Sequence
  Description of Artificial Sequence:  Enzymatic Nucleic Acid
gagguauccugaugaggccguuaggccgaaacaggugu

SEQ ID NO: 10207 - RNA, 38 nt, Artificial Sequence
  Description of Artificial Sequence:  Enzymatic Nucleic Acid
uagggaggcugaugaggccguuaggccgaaaucuacag

SEQ ID NO: 10208 - RNA, 38 nt, Artificial Sequence
  Description of Artificial Sequence:  Enzymatic Nucleic Acid
gauguaggcugaugaggccguuaggccgaaagguaucu

SEQ ID NO: 10209 - RNA, 38 nt, Artificial Sequence
  Description of Artificial Sequence:  Enzymatic Nucleic Acid
aguagaugcugaugaggccguuaggccgaaagggaggu

SEQ ID NO: 10210 - RNA, 38 nt, Artificial Sequence
  Description of Artificial Sequence:  Enzymatic Nucleic Acid
ucgaaguacugaugaggccguuaggccgaaauguaggg

SEQ ID NO: 10211 - RNA, 38 nt, Artificial Sequence
  Description of Artificial Sequence:  Enzymatic Nucleic Acid
cuucgaagcugaugaggccguuaggccgaaagauguag

SEQ ID NO: 10212 - RNA, 38 nt, Artificial Sequence
  Description of Artificial Sequence:  Enzymatic Nucleic Acid
uuucuucgcugaugaggccguuaggccgaaaguagaug

SEQ ID NO: 10213 - RNA, 38 nt, Artificial Sequence
  Description of Artificial Sequence:  Enzymatic Nucleic Acid
uuuucuuccugaugaggccguuaggccgaaaaguagau

SEQ ID NO: 10214 - RNA, 38 nt, Artificial Sequence
  Description of Artificial Sequence:  Enzymatic Nucleic Acid
agauugaacugaugaggccguuaggccgaaauuccgcu

SEQ ID NO: 10215 - RNA, 38 nt, Artificial Sequence
  Description of Artificial Sequence:  Enzymatic Nucleic Acid
guagauugcugaugaggccguuaggccgaaagauuccg

SEQ ID NO: 10216 - RNA, 38 nt, Artificial Sequence
  Description of Artificial Sequence:  Enzymatic Nucleic Acid
uguagauucugaugaggccguuaggccgaaaagauucc

SEQ ID NO: 10217 - RNA, 38 nt, Artificial Sequence
  Description of Artificial Sequence:  Enzymatic Nucleic Acid
aauauguacugaugaggccguuaggccgaaauugaaga

SEQ ID NO: 10218 - RNA, 38 nt, Artificial Sequence
  Description of Artificial Sequence:  Enzymatic Nucleic Acid
caaauaugcugaugaggccguuaggccgaaagauugaa

SEQ ID NO: 10219 - RNA, 38 nt, Artificial Sequence
  Description of Artificial Sequence:  Enzymatic Nucleic Acid
cuaacaaacugaugaggccguuaggccgaaauguagau

SEQ ID NO: 10220 - RNA, 38 nt, Artificial Sequence
  Description of Artificial Sequence:  Enzymatic Nucleic Acid
cacuaacacugaugaggccguuaggccgaaauauguag

SEQ ID NO: 10221 - RNA, 38 nt, Artificial Sequence
  Description of Artificial Sequence:  Enzymatic Nucleic Acid
ucacuaaccugaugaggccguuaggccgaaaauaugua

SEQ ID NO: 10222 - RNA, 38 nt, Artificial Sequence
  Description of Artificial Sequence:  Enzymatic Nucleic Acid
gcaucacucugaugaggccguuaggccgaaacaaauau

SEQ ID NO: 10223 - RNA, 38 nt, Artificial Sequence
  Description of Artificial Sequence:  Enzymatic Nucleic Acid
ugcaucaccugaugaggccguuaggccgaaaacaaaua

SEQ ID NO: 10224 - RNA, 38 nt, Artificial Sequence
  Description of Artificial Sequence:  Enzymatic Nucleic Acid
uaugaaagcugaugaggccguuaggccgaaacucccug

SEQ ID NO: 10225 - RNA, 38 nt, Artificial Sequence
  Description of Artificial Sequence:  Enzymatic Nucleic Acid
cucuaugacugaugaggccguuaggccgaaaggacucc

SEQ ID NO: 10226 - RNA, 38 nt, Artificial Sequence
  Description of Artificial Sequence:  Enzymatic Nucleic Acid
ucucuaugcugaugaggccguuaggccgaaaaggacuc

SEQ ID NO: 10227 - RNA, 38 nt, Artificial Sequence
  Description of Artificial Sequence:  Enzymatic Nucleic Acid
aucucuaucugaugaggccguuaggccgaaaaaggacu

SEQ ID NO: 10228 - RNA, 38 nt, Artificial Sequence
  Description of Artificial Sequence:  Enzymatic Nucleic Acid
ugcaucuccugaugaggccguuaggccgaaaugaaagg

SEQ ID NO: 10229 - RNA, 38 nt, Artificial Sequence
  Description of Artificial Sequence:  Enzymatic Nucleic Acid
aguuugggcugaugaggccguuaggccgaaaugucagu

SEQ ID NO: 10230 - RNA, 38 nt, Artificial Sequence
  Description of Artificial Sequence:  Enzymatic Nucleic Acid
augugcaccugaugaggccguuaggccgaaaguuuggg

SEQ ID NO: 10231 - RNA, 38 nt, Artificial Sequence
  Description of Artificial Sequence:  Enzymatic Nucleic Acid
gggaugaucugaugaggccguuaggccgaaagcugucu

SEQ ID NO: 10232 - RNA, 38 nt, Artificial Sequence
  Description of Artificial Sequence:  Enzymatic Nucleic Acid
caggggaucugaugaggccguuaggccgaaaugagcug

SEQ ID NO: 10233 - RNA, 38 nt, Artificial Sequence
  Description of Artificial Sequence:  Enzymatic Nucleic Acid
cggcagggcugaugaggccguuaggccgaaaugaugag

SEQ ID NO: 10234 - RNA, 38 nt, Artificial Sequence
  Description of Artificial Sequence:  Enzymatic Nucleic Acid
cguugggucugaugaggccguuaggccgaaacgucacc

SEQ ID NO: 10235 - RNA, 38 nt, Artificial Sequence
  Description of Artificial Sequence:  Enzymatic Nucleic Acid
gugacugucugaugaggccguuaggccgaaacguuggg

SEQ ID NO: 10236 - RNA, 38 nt, Artificial Sequence
  Description of Artificial Sequence:  Enzymatic Nucleic Acid
uuuagggucugaugaggccguuaggccgaaacugugac

SEQ ID NO: 10237 - RNA, 38 nt, Artificial Sequence
  Description of Artificial Sequence:  Enzymatic Nucleic Acid
aacuuuuucugaugaggccguuaggccgaaagggugac

SEQ ID NO: 10238 - RNA, 38 nt, Artificial Sequence
  Description of Artificial Sequence:  Enzymatic Nucleic Acid
caaauggacugaugaggccguuaggccgaaacuuuuuu

SEQ ID NO: 10239 - RNA, 38 nt, Artificial Sequence
  Description of Artificial Sequence:  Enzymatic Nucleic Acid
ucaaauggcugaugaggccguuaggccgaaaacuuuuu

SEQ ID NO: 10240 - RNA, 38 nt, Artificial Sequence
  Description of Artificial Sequence:  Enzymatic Nucleic Acid
aucaaaugcugaugaggccguuaggccgaaaaacuuuu

SEQ ID NO: 10241 - RNA, 38 nt, Artificial Sequence
  Description of Artificial Sequence:  Enzymatic Nucleic Acid
gaguaucacugaugaggccguuaggccgaaauggaaac

SEQ ID NO: 10242 - RNA, 38 nt, Artificial Sequence
  Description of Artificial Sequence:  Enzymatic Nucleic Acid
agaguauccugaugaggccguuaggccgaaaauggaaa

SEQ ID NO: 10243 - RNA, 38 nt, Artificial Sequence
  Description of Artificial Sequence:  Enzymatic Nucleic Acid
gguaagagcugaugaggccguuaggccgaaaucaaaug

SEQ ID NO: 10244 - RNA, 38 nt, Artificial Sequence
  Description of Artificial Sequence:  Enzymatic Nucleic Acid
agggguaacugaugaggccguuaggccgaaaguaucaa

SEQ ID NO: 10245 - RNA, 38 nt, Artificial Sequence
  Description of Artificial Sequence:  Enzymatic Nucleic Acid
ucaggggucugaugaggccguuaggccgaaagaguauc

SEQ ID NO: 10246 - RNA, 38 nt, Artificial Sequence
  Description of Artificial Sequence:  Enzymatic Nucleic Acid
aucaggggcugaugaggccguuaggccgaaaagaguau

SEQ ID NO: 10247 - RNA, 38 nt, Artificial Sequence
  Description of Artificial Sequence:  Enzymatic Nucleic Acid
ucccaugucugaugaggccguuaggccgaaauucuuug

SEQ ID NO: 10248 - RNA, 38 nt, Artificial Sequence
  Description of Artificial Sequence:  Enzymatic Nucleic Acid
gccucucccugaugaggccguuaggccgaaacuguccc

SEQ ID NO: 10249 - RNA, 38 nt, Artificial Sequence
  Description of Artificial Sequence:  Enzymatic Nucleic Acid
cuauuauacugaugaggccguuaggccgaaagccucuc

SEQ ID NO: 10250 - RNA, 38 nt, Artificial Sequence
  Description of Artificial Sequence:  Enzymatic Nucleic Acid
gcuauuaucugaugaggccguuaggccgaaaagccucu

SEQ ID NO: 10251 - RNA, 38 nt, Artificial Sequence
  Description of Artificial Sequence:  Enzymatic Nucleic Acid
ugcuauuacugaugaggccguuaggccgaaaaagccuc

SEQ ID NO: 10252 - RNA, 38 nt, Artificial Sequence
  Description of Artificial Sequence:  Enzymatic Nucleic Acid
uuugcuaucugaugaggccguuaggccgaaauaaagcc

SEQ ID NO: 10253 - RNA, 38 nt, Artificial Sequence
  Description of Artificial Sequence:  Enzymatic Nucleic Acid
gcauuugccugaugaggccguuaggccgaaauuauaaa

SEQ ID NO: 10254 - RNA, 38 nt, Artificial Sequence
  Description of Artificial Sequence:  Enzymatic Nucleic Acid
ucucuuugcugaugaggccguuaggccgaaacguugca

SEQ ID NO: 10255 - RNA, 38 nt, Artificial Sequence
  Description of Artificial Sequence:  Enzymatic Nucleic Acid
agcagucccugaugaggccguuaggccgaaaucucuuu

SEQ ID NO: 10256 - RNA, 38 nt, Artificial Sequence
  Description of Artificial Sequence:  Enzymatic Nucleic Acid
ugcccguucugaugaggccguuaggccgaaacgguggc

SEQ ID NO: 10257 - RNA, 38 nt, Artificial Sequence
  Description of Artificial Sequence:  Enzymatic Nucleic Acid
uugucuggcugaugaggccguuaggccgaaacaggugc

SEQ ID NO: 10258 - RNA, 38 nt, Artificial Sequence
  Description of Artificial Sequence:  Enzymatic Nucleic Acid
gggucagacugaugaggccguuaggccgaaaguuuguc

SEQ ID NO: 10259 - RNA, 38 nt, Artificial Sequence
  Description of Artificial Sequence:  Enzymatic Nucleic Acid
augggucacugaugaggccguuaggccgaaauaguuug

SEQ ID NO: 10260 - RNA, 38 nt, Artificial Sequence
  Description of Artificial Sequence:  Enzymatic Nucleic Acid
ggucugcccugaugaggccguuaggccgaaauggguca

SEQ ID NO: 10261 - RNA, 38 nt, Artificial Sequence
  Description of Artificial Sequence:  Enzymatic Nucleic Acid
uaggauugcugaugaggccguuaggccgaaauuggucu

SEQ ID NO: 10262 - RNA, 38 nt, Artificial Sequence
  Description of Artificial Sequence:  Enzymatic Nucleic Acid
acaucuagcugaugaggccguuaggccgaaauuguauu

SEQ ID NO: 10263 - RNA, 38 nt, Artificial Sequence
  Description of Artificial Sequence:  Enzymatic Nucleic Acid
uggacauccugaugaggccguuaggccgaaaggauugu

SEQ ID NO: 10264 - RNA, 38 nt, Artificial Sequence
  Description of Artificial Sequence:  Enzymatic Nucleic Acid
cguauuugcugaugaggccguuaggccgaaacaucuag

SEQ ID NO: 10265 - RNA, 38 nt, Artificial Sequence
  Description of Artificial Sequence:  Enzymatic Nucleic Acid
ggcgggcgcugaugaggccguuaggccgaaauuuggac

SEQ ID NO: 10266 - RNA, 38 nt, Artificial Sequence
  Description of Artificial Sequence:  Enzymatic Nucleic Acid
ugcccgugcugaugaggccguuaggccgaaagcagucu

SEQ ID NO: 10267 - RNA, 38 nt, Artificial Sequence
  Description of Artificial Sequence:  Enzymatic Nucleic Acid
gaggacaacugaugaggccguuaggccgaaagucugcc

SEQ ID NO: 10268 - RNA, 38 nt, Artificial Sequence
  Description of Artificial Sequence:  Enzymatic Nucleic Acid
uugaggaccugaugaggccguuaggccgaaagagucug

SEQ ID NO: 10269 - RNA, 38 nt, Artificial Sequence
  Description of Artificial Sequence:  Enzymatic Nucleic Acid
caguugagcugaugaggccguuaggccgaaacaagagu

SEQ ID NO: 10270 - RNA, 38 nt, Artificial Sequence
  Description of Artificial Sequence:  Enzymatic Nucleic Acid
gugcaguucugaugaggccguuaggccgaaaggacaag

SEQ ID NO: 10271 - RNA, 38 nt, Artificial Sequence
  Description of Artificial Sequence:  Enzymatic Nucleic Acid
cucguauucugaugaggccguuaggccgaaagcuccgu

SEQ ID NO: 10272 - RNA, 38 nt, Artificial Sequence
  Description of Artificial Sequence:  Enzymatic Nucleic Acid
cacccucgcugaugaggccguuaggccgaaauugagcu

SEQ ID NO: 10273 - RNA, 38 nt, Artificial Sequence
  Description of Artificial Sequence:  Enzymatic Nucleic Acid
accagggucugaugaggccguuaggccgaaauuccagc

SEQ ID NO: 10274 - RNA, 38 nt, Artificial Sequence
  Description of Artificial Sequence:  Enzymatic Nucleic Acid
uaccagggcugaugaggccguuaggccgaaaauuccag

SEQ ID NO: 10275 - RNA, 38 nt, Artificial Sequence
  Description of Artificial Sequence:  Enzymatic Nucleic Acid
aguugcuucugaugaggccguuaggccgaaaccagggu

SEQ ID NO: 10276 - RNA, 38 nt, Artificial Sequence
  Description of Artificial Sequence:  Enzymatic Nucleic Acid
ugcucucucugaugaggccguuaggccgaaaguugcuu

SEQ ID NO: 10277 - RNA, 38 nt, Artificial Sequence
  Description of Artificial Sequence:  Enzymatic Nucleic Acid
gccuuauacugaugaggccguuaggccgaaaugcucuc

SEQ ID NO: 10278 - RNA, 38 nt, Artificial Sequence
  Description of Artificial Sequence:  Enzymatic Nucleic Acid
cugccuuacugaugaggccguuaggccgaaagaugcuc

SEQ ID NO: 10279 - RNA, 38 nt, Artificial Sequence
  Description of Artificial Sequence:  Enzymatic Nucleic Acid
cgcugccucugaugaggccguuaggccgaaauagaugc

SEQ ID NO: 10280 - RNA, 38 nt, Artificial Sequence
  Description of Artificial Sequence:  Enzymatic Nucleic Acid
cuccgguccugaugaggccguuaggccgaaauccgcug

SEQ ID NO: 10281 - RNA, 38 nt, Artificial Sequence
  Description of Artificial Sequence:  Enzymatic Nucleic Acid
guugugggcugaugaggccguuaggccgaaauggcucc

SEQ ID NO: 10282 - RNA, 38 nt, Artificial Sequence
  Description of Artificial Sequence:  Enzymatic Nucleic Acid
uguuguggcugaugaggccguuaggccgaaaauggcuc

SEQ ID NO: 10283 - RNA, 38 nt, Artificial Sequence
  Description of Artificial Sequence:  Enzymatic Nucleic Acid
cacuguggcugaugaggccguuaggccgaaacacauug

SEQ ID NO: 10284 - RNA, 38 nt, Artificial Sequence
  Description of Artificial Sequence:  Enzymatic Nucleic Acid
acacugugcugaugaggccguuaggccgaaaacacauu

SEQ ID NO: 10285 - RNA, 38 nt, Artificial Sequence
  Description of Artificial Sequence:  Enzymatic Nucleic Acid
aucuuaagcugaugaggccguuaggccgaaacacugug

SEQ ID NO: 10286 - RNA, 38 nt, Artificial Sequence
  Description of Artificial Sequence:  Enzymatic Nucleic Acid
gaucuuaacugaugaggccguuaggccgaaaacacugu

SEQ ID NO: 10287 - RNA, 38 nt, Artificial Sequence
  Description of Artificial Sequence:  Enzymatic Nucleic Acid
uugaucuucugaugaggccguuaggccgaaagaacacu

SEQ ID NO: 10288 - RNA, 38 nt, Artificial Sequence
  Description of Artificial Sequence:  Enzymatic Nucleic Acid
guugaucucugaugaggccguuaggccgaaaagaacac

SEQ ID NO: 10289 - RNA, 38 nt, Artificial Sequence
  Description of Artificial Sequence:  Enzymatic Nucleic Acid
acauuguucugaugaggccguuaggccgaaaucuuaag

SEQ ID NO: 10290 - RNA, 38 nt, Artificial Sequence
  Description of Artificial Sequence:  Enzymatic Nucleic Acid
cagguguacugaugaggccguuaggccgaaagccccuu

SEQ ID NO: 10291 - RNA, 38 nt, Artificial Sequence
  Description of Artificial Sequence:  Enzymatic Nucleic Acid
gacaggugcugaugaggccguuaggccgaaagagcccc

SEQ ID NO: 10292 - RNA, 38 nt, Artificial Sequence
  Description of Artificial Sequence:  Enzymatic Nucleic Acid
cuucacgccugaugaggccguuaggccgaaacaggugu

SEQ ID NO: 10293 - RNA, 38 nt, Artificial Sequence
  Description of Artificial Sequence:  Enzymatic Nucleic Acid
ggaacgagcugaugaggccguuaggccgaaacccacuc

SEQ ID NO: 10294 - RNA, 38 nt, Artificial Sequence
  Description of Artificial Sequence:  Enzymatic Nucleic Acid
acuggaaccugaugaggccguuaggccgaaaggaccca

SEQ ID NO: 10295 - RNA, 38 nt, Artificial Sequence
  Description of Artificial Sequence:  Enzymatic Nucleic Acid
aagacuggcugaugaggccguuaggccgaaacgaggac

SEQ ID NO: 10296 - RNA, 38 nt, Artificial Sequence
  Description of Artificial Sequence:  Enzymatic Nucleic Acid
aaagacugcugaugaggccguuaggccgaaaacgagga

SEQ ID NO: 10297 - RNA, 38 nt, Artificial Sequence
  Description of Artificial Sequence:  Enzymatic Nucleic Acid
uguugaaacugaugaggccguuaggccgaaacuggaac

SEQ ID NO: 10298 - RNA, 38 nt, Artificial Sequence
  Description of Artificial Sequence:  Enzymatic Nucleic Acid
gguguugacugaugaggccguuaggccgaaagacugga

SEQ ID NO: 10299 - RNA, 38 nt, Artificial Sequence
  Description of Artificial Sequence:  Enzymatic Nucleic Acid
agguguugcugaugaggccguuaggccgaaaagacugg

SEQ ID NO: 10300 - RNA, 38 nt, Artificial Sequence
  Description of Artificial Sequence:  Enzymatic Nucleic Acid
gagguguucugaugaggccguuaggccgaaaaagacug

SEQ ID NO: 10301 - RNA, 38 nt, Artificial Sequence
  Description of Artificial Sequence:  Enzymatic Nucleic Acid
caugcacgcugaugaggccguuaggccgaaagguguug

SEQ ID NO: 10302 - RNA, 38 nt, Artificial Sequence
  Description of Artificial Sequence:  Enzymatic Nucleic Acid
cuuuuucacugaugaggccguuaggccgaaacacaugc

SEQ ID NO: 10303 - RNA, 38 nt, Artificial Sequence
  Description of Artificial Sequence:  Enzymatic Nucleic Acid
cacugaugcugaugaggccguuaggccgaaauccuuuu

SEQ ID NO: 10304 - RNA, 38 nt, Artificial Sequence
  Description of Artificial Sequence:  Enzymatic Nucleic Acid
acacugaucugaugaggccguuaggccgaaaauccuuu

SEQ ID NO: 10305 - RNA, 38 nt, Artificial Sequence
  Description of Artificial Sequence:  Enzymatic Nucleic Acid
uucacacucugaugaggccguuaggccgaaaugaaucc

SEQ ID NO: 10306 - RNA, 38 nt, Artificial Sequence
  Description of Artificial Sequence:  Enzymatic Nucleic Acid
cugcuucccugaugaggccguuaggccgaaauguuuca

SEQ ID NO: 10307 - RNA, 38 nt, Artificial Sequence
  Description of Artificial Sequence:  Enzymatic Nucleic Acid
gccgauagcugaugaggccguuaggccgaaaccgucuu

SEQ ID NO: 10308 - RNA, 38 nt, Artificial Sequence
  Description of Artificial Sequence:  Enzymatic Nucleic Acid
acagccgacugaugaggccguuaggccgaaaggaccgu

SEQ ID NO: 10309 - RNA, 38 nt, Artificial Sequence
  Description of Artificial Sequence:  Enzymatic Nucleic Acid
ggacagcccugaugaggccguuaggccgaaauaggacc

SEQ ID NO: 10310 - RNA, 38 nt, Artificial Sequence
  Description of Artificial Sequence:  Enzymatic Nucleic Acid
cuuucaugcugaugaggccguuaggccgaaacagccga

SEQ ID NO: 10311 - RNA, 38 nt, Artificial Sequence
  Description of Artificial Sequence:  Enzymatic Nucleic Acid
gggaggggcugaugaggccguuaggccgaaaggccuuc

SEQ ID NO: 10312 - RNA, 38 nt, Artificial Sequence
  Description of Artificial Sequence:  Enzymatic Nucleic Acid
ggggagggcugaugaggccguuaggccgaaaaggccuu

SEQ ID NO: 10313 - RNA, 38 nt, Artificial Sequence
  Description of Artificial Sequence:  Enzymatic Nucleic Acid
uuucugggcugaugaggccguuaggccgaaaggggaag

SEQ ID NO: 10314 - RNA, 38 nt, Artificial Sequence
  Description of Artificial Sequence:  Enzymatic Nucleic Acid
aaccauaccugaugaggccguuaggccgaaauuucugg

SEQ ID NO: 10315 - RNA, 38 nt, Artificial Sequence
  Description of Artificial Sequence:  Enzymatic Nucleic Acid
uuuaaccacugaugaggccguuaggccgaaacgauuuc

SEQ ID NO: 10316 - RNA, 38 nt, Artificial Sequence
  Description of Artificial Sequence:  Enzymatic Nucleic Acid
caucuuuucugaugaggccguuaggccgaaaccauacg

SEQ ID NO: 10317 - RNA, 38 nt, Artificial Sequence
  Description of Artificial Sequence:  Enzymatic Nucleic Acid
uugcaggccugaugaggccguuaggccgaaagccaucu

SEQ ID NO: 10318 - RNA, 38 nt, Artificial Sequence
  Description of Artificial Sequence:  Enzymatic Nucleic Acid
cagacuuccugaugaggccguuaggccgaaauguugca

SEQ ID NO: 10319 - RNA, 38 nt, Artificial Sequence
  Description of Artificial Sequence:  Enzymatic Nucleic Acid
agcgagcacugaugaggccguuaggccgaaacuucaau

SEQ ID NO: 10320 - RNA, 38 nt, Artificial Sequence
  Description of Artificial Sequence:  Enzymatic Nucleic Acid
caaauagccugaugaggccguuaggccgaaagcagacu

SEQ ID NO: 10321 - RNA, 38 nt, Artificial Sequence
  Description of Artificial Sequence:  Enzymatic Nucleic Acid
guaccaaacugaugaggccguuaggccgaaagcgagca

SEQ ID NO: 10322 - RNA, 38 nt, Artificial Sequence
  Description of Artificial Sequence:  Enzymatic Nucleic Acid
auguaccacugaugaggccguuaggccgaaauagcgag

SEQ ID NO: 10323 - RNA, 38 nt, Artificial Sequence
  Description of Artificial Sequence:  Enzymatic Nucleic Acid
cauguacccugaugaggccguuaggccgaaaauagcga

SEQ ID NO: 10324 - RNA, 38 nt, Artificial Sequence
  Description of Artificial Sequence:  Enzymatic Nucleic Acid
uagccaugcugaugaggccguuaggccgaaaccaaaua

SEQ ID NO: 10325 - RNA, 38 nt, Artificial Sequence
  Description of Artificial Sequence:  Enzymatic Nucleic Acid
uuaaugagcugaugaggccguuaggccgaaagccaugu

SEQ ID NO: 10326 - RNA, 38 nt, Artificial Sequence
  Description of Artificial Sequence:  Enzymatic Nucleic Acid
uaauuaaucugaugaggccguuaggccgaaaguagcca

SEQ ID NO: 10327 - RNA, 38 nt, Artificial Sequence
  Description of Artificial Sequence:  Enzymatic Nucleic Acid
ugauaauucugaugaggccguuaggccgaaaugaguag

SEQ ID NO: 10328 - RNA, 38 nt, Artificial Sequence
  Description of Artificial Sequence:  Enzymatic Nucleic Acid
uugauaaucugaugaggccguuaggccgaaaaugagua

SEQ ID NO: 10329 - RNA, 38 nt, Artificial Sequence
  Description of Artificial Sequence:  Enzymatic Nucleic Acid
ucuuugaucugaugaggccguuaggccgaaauuaauga

SEQ ID NO: 10330 - RNA, 38 nt, Artificial Sequence
  Description of Artificial Sequence:  Enzymatic Nucleic Acid
aucuuugacugaugaggccguuaggccgaaaauuaaug

SEQ ID NO: 10331 - RNA, 38 nt, Artificial Sequence
  Description of Artificial Sequence:  Enzymatic Nucleic Acid
acaucuuucugaugaggccguuaggccgaaauaauuaa

SEQ ID NO: 10332 - RNA, 38 nt, Artificial Sequence
  Description of Artificial Sequence:  Enzymatic Nucleic Acid
agaucguacugaugaggccguuaggccgaaaguccccu

SEQ ID NO: 10333 - RNA, 38 nt, Artificial Sequence
  Description of Artificial Sequence:  Enzymatic Nucleic Acid
caagaucgcugaugaggccguuaggccgaaauaguccc

SEQ ID NO: 10334 - RNA, 38 nt, Artificial Sequence
  Description of Artificial Sequence:  Enzymatic Nucleic Acid
cccagcaacugaugaggccguuaggccgaaaucguaua

SEQ ID NO: 10335 - RNA, 38 nt, Artificial Sequence
  Description of Artificial Sequence:  Enzymatic Nucleic Acid
ugcccagccugaugaggccguuaggccgaaagaucgua

SEQ ID NO: 10336 - RNA, 38 nt, Artificial Sequence
  Description of Artificial Sequence:  Enzymatic Nucleic Acid
gacugcuucugaugaggccguuaggccgaaaugcccag

SEQ ID NO: 10337 - RNA, 38 nt, Artificial Sequence
  Description of Artificial Sequence:  Enzymatic Nucleic Acid
auagccuucugaugaggccguuaggccgaaacugcuuu

SEQ ID NO: 10338 - RNA, 38 nt, Artificial Sequence
  Description of Artificial Sequence:  Enzymatic Nucleic Acid
uuuuuaaacugaugaggccguuaggccgaaagccuuga

SEQ ID NO: 10339 - RNA, 38 nt, Artificial Sequence
  Description of Artificial Sequence:  Enzymatic Nucleic Acid
gguuuuuacugaugaggccguuaggccgaaauagccuu

SEQ ID NO: 10340 - RNA, 38 nt, Artificial Sequence
  Description of Artificial Sequence:  Enzymatic Nucleic Acid
agguuuuucugaugaggccguuaggccgaaaauagccu

SEQ ID NO: 10341 - RNA, 38 nt, Artificial Sequence
  Description of Artificial Sequence:  Enzymatic Nucleic Acid
gagguuuucugaugaggccguuaggccgaaaaauagcc

SEQ ID NO: 10342 - RNA, 38 nt, Artificial Sequence
  Description of Artificial Sequence:  Enzymatic Nucleic Acid
uacaaugacugaugaggccguuaggccgaaaguggcag

SEQ ID NO: 10343 - RNA, 38 nt, Artificial Sequence
  Description of Artificial Sequence:  Enzymatic Nucleic Acid
uuuacaaucugaugaggccguuaggccgaaagaguggc

SEQ ID NO: 10344 - RNA, 38 nt, Artificial Sequence
  Description of Artificial Sequence:  Enzymatic Nucleic Acid
acguuuaccugaugaggccguuaggccgaaaugagagu

SEQ ID NO: 10345 - RNA, 38 nt, Artificial Sequence
  Description of Artificial Sequence:  Enzymatic Nucleic Acid
uucacguucugaugaggccguuaggccgaaacaaugag

SEQ ID NO: 10346 - RNA, 38 nt, Artificial Sequence
  Description of Artificial Sequence:  Enzymatic Nucleic Acid
guagaucucugaugaggccguuaggccgaaagguuuca

SEQ ID NO: 10347 - RNA, 38 nt, Artificial Sequence
  Description of Artificial Sequence:  Enzymatic Nucleic Acid
uuuucguacugaugaggccguuaggccgaaaucugagg

SEQ ID NO: 10348 - RNA, 38 nt, Artificial Sequence
  Description of Artificial Sequence:  Enzymatic Nucleic Acid
acuuuucgcugaugaggccguuaggccgaaagaucuga

SEQ ID NO: 10349 - RNA, 38 nt, Artificial Sequence
  Description of Artificial Sequence:  Enzymatic Nucleic Acid
aggacacgcugaugaggccguuaggccgaaacuuuucg

SEQ ID NO: 10350 - RNA, 38 nt, Artificial Sequence
  Description of Artificial Sequence:  Enzymatic Nucleic Acid
gaagcgagcugaugaggccguuaggccgaaacacggac

SEQ ID NO: 10351 - RNA, 38 nt, Artificial Sequence
  Description of Artificial Sequence:  Enzymatic Nucleic Acid
uuggaagccugaugaggccguuaggccgaaaggacacg

SEQ ID NO: 10352 - RNA, 38 nt, Artificial Sequence
  Description of Artificial Sequence:  Enzymatic Nucleic Acid
gggcuuggcugaugaggccguuaggccgaaagcgagga

SEQ ID NO: 10353 - RNA, 38 nt, Artificial Sequence
  Description of Artificial Sequence:  Enzymatic Nucleic Acid
ugggcuugcugaugaggccguuaggccgaaaagcgagg

SEQ ID NO: 10354 - RNA, 38 nt, Artificial Sequence
  Description of Artificial Sequence:  Enzymatic Nucleic Acid
cggauagacugaugaggccguuaggccgaaaggugggc

SEQ ID NO: 10355 - RNA, 38 nt, Artificial Sequence
  Description of Artificial Sequence:  Enzymatic Nucleic Acid
agcggauacugaugaggccguuaggccgaaagaggugg

SEQ ID NO: 10356 - RNA, 38 nt, Artificial Sequence
  Description of Artificial Sequence:  Enzymatic Nucleic Acid
ccagcggacugaugaggccguuaggccgaaagagaggu

SEQ ID NO: 10357 - RNA, 38 nt, Artificial Sequence
  Description of Artificial Sequence:  Enzymatic Nucleic Acid
gcccagcgcugaugaggccguuaggccgaaauagagag

SEQ ID NO: 10358 - RNA, 38 nt, Artificial Sequence
  Description of Artificial Sequence:  Enzymatic Nucleic Acid
caagugagcugaugaggccguuaggccgaaacuugucu

SEQ ID NO: 10359 - RNA, 38 nt, Artificial Sequence
  Description of Artificial Sequence:  Enzymatic Nucleic Acid
gugcaagucugaugaggccguuaggccgaaaggacuug

SEQ ID NO: 10360 - RNA, 38 nt, Artificial Sequence
  Description of Artificial Sequence:  Enzymatic Nucleic Acid
cacggugccugaugaggccguuaggccgaaagugagga

SEQ ID NO: 10361 - RNA, 38 nt, Artificial Sequence
  Description of Artificial Sequence:  Enzymatic Nucleic Acid
ggaugccacugaugaggccguuaggccgaaacacggug

SEQ ID NO: 10362 - RNA, 38 nt, Artificial Sequence
  Description of Artificial Sequence:  Enzymatic Nucleic Acid
ggccgaggcugaugaggccguuaggccgaaaugccaua

SEQ ID NO: 10363 - RNA, 38 nt, Artificial Sequence
  Description of Artificial Sequence:  Enzymatic Nucleic Acid
uguuggcccugaugaggccguuaggccgaaagggaugc

SEQ ID NO: 10364 - RNA, 38 nt, Artificial Sequence
  Description of Artificial Sequence:  Enzymatic Nucleic Acid
agccacgucugaugaggccguuaggccgaaauuguugg

SEQ ID NO: 10365 - RNA, 38 nt, Artificial Sequence
  Description of Artificial Sequence:  Enzymatic Nucleic Acid
gggugccacugaugaggccguuaggccgaaagccacgu

SEQ ID NO: 10366 - RNA, 38 nt, Artificial Sequence
  Description of Artificial Sequence:  Enzymatic Nucleic Acid
auuguggucugaugaggccguuaggccgaaacaggggu

SEQ ID NO: 10367 - RNA, 38 nt, Artificial Sequence
  Description of Artificial Sequence:  Enzymatic Nucleic Acid
uuuggagucugaugaggccguuaggccgaaauuguggu

SEQ ID NO: 10368 - RNA, 38 nt, Artificial Sequence
  Description of Artificial Sequence:  Enzymatic Nucleic Acid
uuucuuugcugaugaggccguuaggccgaaagugauug

SEQ ID NO: 10369 - RNA, 38 nt, Artificial Sequence
  Description of Artificial Sequence:  Enzymatic Nucleic Acid
agaagucacugaugaggccguuaggccgaaaccuuucu

SEQ ID NO: 10370 - RNA, 38 nt, Artificial Sequence
  Description of Artificial Sequence:  Enzymatic Nucleic Acid
cagugcagcugaugaggccguuaggccgaaagucauac

SEQ ID NO: 10371 - RNA, 38 nt, Artificial Sequence
  Description of Artificial Sequence:  Enzymatic Nucleic Acid
ucagugcacugaugaggccguuaggccgaaaagucaua

SEQ ID NO: 10372 - RNA, 38 nt, Artificial Sequence
  Description of Artificial Sequence:  Enzymatic Nucleic Acid
ggauaaagcugaugaggccguuaggccgaaauucuuca

SEQ ID NO: 10373 - RNA, 38 nt, Artificial Sequence
  Description of Artificial Sequence:  Enzymatic Nucleic Acid
ccaggauacugaugaggccguuaggccgaaaggauucu

SEQ ID NO: 10374 - RNA, 38 nt, Artificial Sequence
  Description of Artificial Sequence:  Enzymatic Nucleic Acid
uccaggaucugaugaggccguuaggccgaaaaggauuc

SEQ ID NO: 10375 - RNA, 38 nt, Artificial Sequence
  Description of Artificial Sequence:  Enzymatic Nucleic Acid
auccaggacugaugaggccguuaggccgaaaaaggauu

SEQ ID NO: 10376 - RNA, 38 nt, Artificial Sequence
  Description of Artificial Sequence:  Enzymatic Nucleic Acid
ggauccagcugaugaggccguuaggccgaaauaaagga

SEQ ID NO: 10377 - RNA, 38 nt, Artificial Sequence
  Description of Artificial Sequence:  Enzymatic Nucleic Acid
gcugcuggcugaugaggccguuaggccgaaauccagga

SEQ ID NO: 10378 - RNA, 38 nt, Artificial Sequence
  Description of Artificial Sequence:  Enzymatic Nucleic Acid
uguuuccucugaugaggccguuaggccgaaaguugcug

SEQ ID NO: 10379 - RNA, 38 nt, Artificial Sequence
  Description of Artificial Sequence:  Enzymatic Nucleic Acid
cuguuucccugaugaggccguuaggccgaaaaguugcu

SEQ ID NO: 10380 - RNA, 38 nt, Artificial Sequence
  Description of Artificial Sequence:  Enzymatic Nucleic Acid
cgcugagacugaugaggccguuaggccgaaaugcucuc

SEQ ID NO: 10381 - RNA, 38 nt, Artificial Sequence
  Description of Artificial Sequence:  Enzymatic Nucleic Acid
ugcgcugacugaugaggccguuaggccgaaagaugcuc

SEQ ID NO: 10382 - RNA, 38 nt, Artificial Sequence
  Description of Artificial Sequence:  Enzymatic Nucleic Acid
caugcgcucugaugaggccguuaggccgaaagagaugc

SEQ ID NO: 10383 - RNA, 38 nt, Artificial Sequence
  Description of Artificial Sequence:  Enzymatic Nucleic Acid
ccuucuaucugaugaggccguuaggccgaaaccgucau

SEQ ID NO: 10384 - RNA, 38 nt, Artificial Sequence
  Description of Artificial Sequence:  Enzymatic Nucleic Acid
guuccuuccugaugaggccguuaggccgaaaugaccgu

SEQ ID NO: 10385 - RNA, 38 nt, Artificial Sequence
  Description of Artificial Sequence:  Enzymatic Nucleic Acid
aaccgucucugaugaggccguuaggccgaaauuuguuc

SEQ ID NO: 10386 - RNA, 38 nt, Artificial Sequence
  Description of Artificial Sequence:  Enzymatic Nucleic Acid
aaugugcucugaugaggccguuaggccgaaaccgucuu

SEQ ID NO: 10387 - RNA, 38 nt, Artificial Sequence
  Description of Artificial Sequence:  Enzymatic Nucleic Acid
caaugugccugaugaggccguuaggccgaaaaccgucu

SEQ ID NO: 10388 - RNA, 38 nt, Artificial Sequence
  Description of Artificial Sequence:  Enzymatic Nucleic Acid
ccaccacccugaugaggccguuaggccgaaaugugcua

SEQ ID NO: 10389 - RNA, 38 nt, Artificial Sequence
  Description of Artificial Sequence:  Enzymatic Nucleic Acid
gggucugacugaugaggccguuaggccgaaagucagcc

SEQ ID NO: 10390 - RNA, 38 nt, Artificial Sequence
  Description of Artificial Sequence:  Enzymatic Nucleic Acid
aggggucucugaugaggccguuaggccgaaagagucag

SEQ ID NO: 10391 - RNA, 38 nt, Artificial Sequence
  Description of Artificial Sequence:  Enzymatic Nucleic Acid
cagcuguacugaugaggccguuaggccgaaauuccagg

SEQ ID NO: 10392 - RNA, 38 nt, Artificial Sequence
  Description of Artificial Sequence:  Enzymatic Nucleic Acid
ggcagcugcugaugaggccguuaggccgaaagauucca

SEQ ID NO: 10393 - RNA, 38 nt, Artificial Sequence
  Description of Artificial Sequence:  Enzymatic Nucleic Acid
uuuuauugcugaugaggccguuaggccgaaaggcccgg

SEQ ID NO: 10394 - RNA, 38 nt, Artificial Sequence
  Description of Artificial Sequence:  Enzymatic Nucleic Acid
auuuuauucugaugaggccguuaggccgaaaaggcccg

SEQ ID NO: 10395 - RNA, 38 nt, Artificial Sequence
  Description of Artificial Sequence:  Enzymatic Nucleic Acid
cccuauuucugaugaggccguuaggccgaaauugaagg

SEQ ID NO: 10396 - RNA, 38 nt, Artificial Sequence
  Description of Artificial Sequence:  Enzymatic Nucleic Acid
acaguccccugaugaggccguuaggccgaaauuuuauu

SEQ ID NO: 10397 - RNA, 38 nt, Artificial Sequence
  Description of Artificial Sequence:  Enzymatic Nucleic Acid
uaaaauuucugaugaggccguuaggccgaaauguuucu

SEQ ID NO: 10398 - RNA, 38 nt, Artificial Sequence
  Description of Artificial Sequence:  Enzymatic Nucleic Acid
ugacauaacugaugaggccguuaggccgaaauuuuaug

SEQ ID NO: 10399 - RNA, 38 nt, Artificial Sequence
  Description of Artificial Sequence:  Enzymatic Nucleic Acid
gugacauacugaugaggccguuaggccgaaaauuuuau

SEQ ID NO: 10400 - RNA, 38 nt, Artificial Sequence
  Description of Artificial Sequence:  Enzymatic Nucleic Acid
ugugacaucugaugaggccguuaggccgaaaaauuuua

SEQ ID NO: 10401 - RNA, 38 nt, Artificial Sequence
  Description of Artificial Sequence:  Enzymatic Nucleic Acid
cugugacacugaugaggccguuaggccgaaaaaauuuu

SEQ ID NO: 10402 - RNA, 38 nt, Artificial Sequence
  Description of Artificial Sequence:  Enzymatic Nucleic Acid
acaucugucugaugaggccguuaggccgaaacauaaaa

SEQ ID NO: 10403 - RNA, 38 nt, Artificial Sequence
  Description of Artificial Sequence:  Enzymatic Nucleic Acid
aaacgugacugaugaggccguuaggccgaaagccauuc

SEQ ID NO: 10404 - RNA, 38 nt, Artificial Sequence
  Description of Artificial Sequence:  Enzymatic Nucleic Acid
gaaacgugcugaugaggccguuaggccgaaaagccauu

SEQ ID NO: 10405 - RNA, 38 nt, Artificial Sequence
  Description of Artificial Sequence:  Enzymatic Nucleic Acid
ggaaacgucugaugaggccguuaggccgaaaaagccau

SEQ ID NO: 10406 - RNA, 38 nt, Artificial Sequence
  Description of Artificial Sequence:  Enzymatic Nucleic Acid
uccaaggacugaugaggccguuaggccgaaacgugaaa

SEQ ID NO: 10407 - RNA, 38 nt, Artificial Sequence
  Description of Artificial Sequence:  Enzymatic Nucleic Acid
uuccaaggcugaugaggccguuaggccgaaaacgugaa

SEQ ID NO: 10408 - RNA, 38 nt, Artificial Sequence
  Description of Artificial Sequence:  Enzymatic Nucleic Acid
uuuccaagcugaugaggccguuaggccgaaaaacguga

SEQ ID NO: 10409 - RNA, 38 nt, Artificial Sequence
  Description of Artificial Sequence:  Enzymatic Nucleic Acid
ucuuuucccugaugaggccguuaggccgaaaggaaacg

SEQ ID NO: 10410 - RNA, 38 nt, Artificial Sequence
  Description of Artificial Sequence:  Enzymatic Nucleic Acid
ccacacagcugaugaggccguuaggccgaaacaguuuc

SEQ ID NO: 10411 - RNA, 38 nt, Artificial Sequence
  Description of Artificial Sequence:  Enzymatic Nucleic Acid
aauuuauucugaugaggccguuaggccgaaaccacaca

SEQ ID NO: 10412 - RNA, 38 nt, Artificial Sequence
  Description of Artificial Sequence:  Enzymatic Nucleic Acid
caggaauucugaugaggccguuaggccgaaauugacca

SEQ ID NO: 10413 - RNA, 38 nt, Artificial Sequence
  Description of Artificial Sequence:  Enzymatic Nucleic Acid
uguacaggcugaugaggccguuaggccgaaauuuauug

SEQ ID NO: 10414 - RNA, 38 nt, Artificial Sequence
  Description of Artificial Sequence:  Enzymatic Nucleic Acid
cuguacagcugaugaggccguuaggccgaaaauuuauu

SEQ ID NO: 10415 - RNA, 38 nt, Artificial Sequence
  Description of Artificial Sequence:  Enzymatic Nucleic Acid
ugucucugcugaugaggccguuaggccgaaacaggaau

SEQ ID NO: 10416 - RNA, 38 nt, Artificial Sequence
  Description of Artificial Sequence:  Enzymatic Nucleic Acid
auccaggucugaugaggccguuaggccgaaaugucucu

SEQ ID NO: 10417 - RNA, 38 nt, Artificial Sequence
  Description of Artificial Sequence:  Enzymatic Nucleic Acid
aauccaggcugaugaggccguuaggccgaaaaugucuc

SEQ ID NO: 10418 - RNA, 38 nt, Artificial Sequence
  Description of Artificial Sequence:  Enzymatic Nucleic Acid
cguagcagcugaugaggccguuaggccgaaauccaggu

SEQ ID NO: 10419 - RNA, 38 nt, Artificial Sequence
  Description of Artificial Sequence:  Enzymatic Nucleic Acid
ccguagcacugaugaggccguuaggccgaaaauccagg

SEQ ID NO: 10420 - RNA, 38 nt, Artificial Sequence
  Description of Artificial Sequence:  Enzymatic Nucleic Acid
acuguccgcugaugaggccguuaggccgaaagcagaau

SEQ ID NO: 10421 - RNA, 38 nt, Artificial Sequence
  Description of Artificial Sequence:  Enzymatic Nucleic Acid
cuguuguucugaugaggccguuaggccgaaacuguccg

SEQ ID NO: 10422 - RNA, 38 nt, Artificial Sequence
  Description of Artificial Sequence:  Enzymatic Nucleic Acid
ucuguugucugaugaggccguuaggccgaaaacugucc

SEQ ID NO: 10423 - RNA, 38 nt, Artificial Sequence
  Description of Artificial Sequence:  Enzymatic Nucleic Acid
gcugauaccugaugaggccguuaggccgaaauggugca

SEQ ID NO: 10424 - RNA, 38 nt, Artificial Sequence
  Description of Artificial Sequence:  Enzymatic Nucleic Acid
cuugcugacugaugaggccguuaggccgaaacuauggu

SEQ ID NO: 10425 - RNA, 38 nt, Artificial Sequence
  Description of Artificial Sequence:  Enzymatic Nucleic Acid
ugcuugcucugaugaggccguuaggccgaaauacuaug

SEQ ID NO: 10426 - RNA, 38 nt, Artificial Sequence
  Description of Artificial Sequence:  Enzymatic Nucleic Acid
guaaucuucugaugaggccguuaggccgaaaguggugg

SEQ ID NO: 10427 - RNA, 38 nt, Artificial Sequence
  Description of Artificial Sequence:  Enzymatic Nucleic Acid
gauggagucugaugaggccguuaggccgaaaucuugag

SEQ ID NO: 10428 - RNA, 38 nt, Artificial Sequence
  Description of Artificial Sequence:  Enzymatic Nucleic Acid
ugauggagcugaugaggccguuaggccgaaaaucuuga

SEQ ID NO: 10429 - RNA, 38 nt, Artificial Sequence
  Description of Artificial Sequence:  Enzymatic Nucleic Acid
gagugaugcugaugaggccguuaggccgaaaguaaucu

SEQ ID NO: 10430 - RNA, 38 nt, Artificial Sequence
  Description of Artificial Sequence:  Enzymatic Nucleic Acid
uucagagucugaugaggccguuaggccgaaauggagua

SEQ ID NO: 10431 - RNA, 38 nt, Artificial Sequence
  Description of Artificial Sequence:  Enzymatic Nucleic Acid
aagguucacugaugaggccguuaggccgaaagugaugg

SEQ ID NO: 10432 - RNA, 38 nt, Artificial Sequence
  Description of Artificial Sequence:  Enzymatic Nucleic Acid
uugaugaccugaugaggccguuaggccgaaagguucag

SEQ ID NO: 10433 - RNA, 38 nt, Artificial Sequence
  Description of Artificial Sequence:  Enzymatic Nucleic Acid
uucuugaucugaugaggccguuaggccgaaacaagguu

SEQ ID NO: 10434 - RNA, 38 nt, Artificial Sequence
  Description of Artificial Sequence:  Enzymatic Nucleic Acid
acguucuucugaugaggccguuaggccgaaaugacaag

SEQ ID NO: 10435 - RNA, 38 nt, Artificial Sequence
  Description of Artificial Sequence:  Enzymatic Nucleic Acid
cuucuagacugaugaggccguuaggccgaaacacguuc

SEQ ID NO: 10436 - RNA, 38 nt, Artificial Sequence
  Description of Artificial Sequence:  Enzymatic Nucleic Acid
gucuucuacugaugaggccguuaggccgaaagacacgu

SEQ ID NO: 10437 - RNA, 38 nt, Artificial Sequence
  Description of Artificial Sequence:  Enzymatic Nucleic Acid
gagucuuccugaugaggccguuaggccgaaagagacac

SEQ ID NO: 10438 - RNA, 38 nt, Artificial Sequence
  Description of Artificial Sequence:  Enzymatic Nucleic Acid
aggugccccugaugaggccguuaggccgaaagucuucu

SEQ ID NO: 10439 - RNA, 38 nt, Artificial Sequence
  Description of Artificial Sequence:  Enzymatic Nucleic Acid
ugcacgcacugaugaggccguuaggccgaaaggugccc

SEQ ID NO: 10440 - RNA, 38 nt, Artificial Sequence
  Description of Artificial Sequence:  Enzymatic Nucleic Acid
ccuguguacugaugaggccguuaggccgaaauguuccu

SEQ ID NO: 10441 - RNA, 38 nt, Artificial Sequence
  Description of Artificial Sequence:  Enzymatic Nucleic Acid
ccccugugcugaugaggccguuaggccgaaauauguuc

SEQ ID NO: 10442 - RNA, 38 nt, Artificial Sequence
  Description of Artificial Sequence:  Enzymatic Nucleic Acid
uuccgaagcugaugaggccguuaggccgaaaugucuuc

SEQ ID NO: 10443 - RNA, 38 nt, Artificial Sequence
  Description of Artificial Sequence:  Enzymatic Nucleic Acid
gucuuccgcugaugaggccguuaggccgaaaggauguc

SEQ ID NO: 10444 - RNA, 38 nt, Artificial Sequence
  Description of Artificial Sequence:  Enzymatic Nucleic Acid
ugucuucccugaugaggccguuaggccgaaaaggaugu

SEQ ID NO: 10445 - RNA, 38 nt, Artificial Sequence
  Description of Artificial Sequence:  Enzymatic Nucleic Acid
cuaacgagcugaugaggccguuaggccgaaacuucugu

SEQ ID NO: 10446 - RNA, 38 nt, Artificial Sequence
  Description of Artificial Sequence:  Enzymatic Nucleic Acid
ucuaacgacugaugaggccguuaggccgaaaacuucug

SEQ ID NO: 10447 - RNA, 38 nt, Artificial Sequence
  Description of Artificial Sequence:  Enzymatic Nucleic Acid
ucucuaaccugaugaggccguuaggccgaaagaacuuc

SEQ ID NO: 10448 - RNA, 38 nt, Artificial Sequence
  Description of Artificial Sequence:  Enzymatic Nucleic Acid
gaaucucucugaugaggccguuaggccgaaacgagaac

SEQ ID NO: 10449 - RNA, 38 nt, Artificial Sequence
  Description of Artificial Sequence:  Enzymatic Nucleic Acid
cgaaucuccugaugaggccguuaggccgaaaacgagaa

SEQ ID NO: 10450 - RNA, 38 nt, Artificial Sequence
  Description of Artificial Sequence:  Enzymatic Nucleic Acid
cgcuuccgcugaugaggccguuaggccgaaaucucuaa

SEQ ID NO: 10451 - RNA, 38 nt, Artificial Sequence
  Description of Artificial Sequence:  Enzymatic Nucleic Acid
gcgcuucccugaugaggccguuaggccgaaaaucucua

SEQ ID NO: 10452 - RNA, 38 nt, Artificial Sequence
  Description of Artificial Sequence:  Enzymatic Nucleic Acid
agguuuugcugaugaggccguuaggccgaaagcaggug

SEQ ID NO: 10453 - RNA, 38 nt, Artificial Sequence
  Description of Artificial Sequence:  Enzymatic Nucleic Acid
gagguuuucugaugaggccguuaggccgaaaagcaggu

SEQ ID NO: 10454 - RNA, 38 nt, Artificial Sequence
  Description of Artificial Sequence:  Enzymatic Nucleic Acid
uagucacucugaugaggccguuaggccgaaagguuuug

SEQ ID NO: 10455 - RNA, 38 nt, Artificial Sequence
  Description of Artificial Sequence:  Enzymatic Nucleic Acid
agaccucgcugaugaggccguuaggccgaaagucacug

SEQ ID NO: 10456 - RNA, 38 nt, Artificial Sequence
  Description of Artificial Sequence:  Enzymatic Nucleic Acid
cugauggacugaugaggccguuaggccgaaaccucgua

SEQ ID NO: 10457 - RNA, 38 nt, Artificial Sequence
  Description of Artificial Sequence:  Enzymatic Nucleic Acid
cacugaugcugaugaggccguuaggccgaaagaccucg

SEQ ID NO: 10458 - RNA, 38 nt, Artificial Sequence
  Description of Artificial Sequence:  Enzymatic Nucleic Acid
gagccacucugaugaggccguuaggccgaaauggagac

SEQ ID NO: 10459 - RNA, 38 nt, Artificial Sequence
  Description of Artificial Sequence:  Enzymatic Nucleic Acid
aggucguacugaugaggccguuaggccgaaagccacug

SEQ ID NO: 10460 - RNA, 38 nt, Artificial Sequence
  Description of Artificial Sequence:  Enzymatic Nucleic Acid
uaaggucgcugaugaggccguuaggccgaaagagccac

SEQ ID NO: 10461 - RNA, 38 nt, Artificial Sequence
  Description of Artificial Sequence:  Enzymatic Nucleic Acid
gacagucucugaugaggccguuaggccgaaaggucgua

SEQ ID NO: 10462 - RNA, 38 nt, Artificial Sequence
  Description of Artificial Sequence:  Enzymatic Nucleic Acid
ugacaguccugaugaggccguuaggccgaaaaggucgu

SEQ ID NO: 10463 - RNA, 38 nt, Artificial Sequence
  Description of Artificial Sequence:  Enzymatic Nucleic Acid
ucuagcuucugaugaggccguuaggccgaaacagucua

SEQ ID NO: 10464 - RNA, 38 nt, Artificial Sequence
  Description of Artificial Sequence:  Enzymatic Nucleic Acid
gacaccuccugaugaggccguuaggccgaaagcuugac

SEQ ID NO: 10465 - RNA, 38 nt, Artificial Sequence
  Description of Artificial Sequence:  Enzymatic Nucleic Acid
ggcgcgggcugaugaggccguuaggccgaaacaccucu

SEQ ID NO: 10466 - RNA, 38 nt, Artificial Sequence
  Description of Artificial Sequence:  Enzymatic Nucleic Acid
agugaucucugaugaggccguuaggccgaaaggcgcgg

SEQ ID NO: 10467 - RNA, 38 nt, Artificial Sequence
  Description of Artificial Sequence:  Enzymatic Nucleic Acid
uuugaacccugaugaggccguuaggccgaaagugaucu

SEQ ID NO: 10468 - RNA, 38 nt, Artificial Sequence
  Description of Artificial Sequence:  Enzymatic Nucleic Acid
uguuuuugcugaugaggccguuaggccgaaaccaagug

SEQ ID NO: 10469 - RNA, 38 nt, Artificial Sequence
  Description of Artificial Sequence:  Enzymatic Nucleic Acid
ccuaaaaucugaugaggccguuaggccgaaauucccgg

SEQ ID NO: 10470 - RNA, 38 nt, Artificial Sequence
  Description of Artificial Sequence:  Enzymatic Nucleic Acid
uccuaaaacugaugaggccguuaggccgaaaauucccg

SEQ ID NO: 10471 - RNA, 38 nt, Artificial Sequence
  Description of Artificial Sequence:  Enzymatic Nucleic Acid
uccucugucugaugaggccguuaggccgaaacucuuuc

SEQ ID NO: 10472 - RNA, 38 nt, Artificial Sequence
  Description of Artificial Sequence:  Enzymatic Nucleic Acid
caccuauacugaugaggccguuaggccgaaacacccuc

SEQ ID NO: 10473 - RNA, 38 nt, Artificial Sequence
  Description of Artificial Sequence:  Enzymatic Nucleic Acid
ggcaccuacugaugaggccguuaggccgaaagacaccc

SEQ ID NO: 10474 - RNA, 38 nt, Artificial Sequence
  Description of Artificial Sequence:  Enzymatic Nucleic Acid
ucggcacccugaugaggccguuaggccgaaauagacac

SEQ ID NO: 10475 - RNA, 38 nt, Artificial Sequence
  Description of Artificial Sequence:  Enzymatic Nucleic Acid
cggugaggcugaugaggccguuaggccgaaaggcugcg

SEQ ID NO: 10476 - RNA, 38 nt, Artificial Sequence
  Description of Artificial Sequence:  Enzymatic Nucleic Acid
ugcacggucugaugaggccguuaggccgaaagguaggc

SEQ ID NO: 10477 - RNA, 38 nt, Artificial Sequence
  Description of Artificial Sequence:  Enzymatic Nucleic Acid
acuugucucugaugaggccguuaggccgaaagguuccu

SEQ ID NO: 10478 - RNA, 38 nt, Artificial Sequence
  Description of Artificial Sequence:  Enzymatic Nucleic Acid
ccagguuucugaugaggccguuaggccgaaacuugucu

SEQ ID NO: 10479 - RNA, 38 nt, Artificial Sequence
  Description of Artificial Sequence:  Enzymatic Nucleic Acid
gugagcgucugaugaggccguuaggccgaaaucagcuc

SEQ ID NO: 10480 - RNA, 38 nt, Artificial Sequence
  Description of Artificial Sequence:  Enzymatic Nucleic Acid
gugcacgucugaugaggccguuaggccgaaagcgugau

SEQ ID NO: 10481 - RNA, 38 nt, Artificial Sequence
  Description of Artificial Sequence:  Enzymatic Nucleic Acid
agccaaaacugaugaggccguuaggccgaaagggucgc

SEQ ID NO: 10482 - RNA, 38 nt, Artificial Sequence
  Description of Artificial Sequence:  Enzymatic Nucleic Acid
ggagccaacugaugaggccguuaggccgaaagaggguc

SEQ ID NO: 10483 - RNA, 38 nt, Artificial Sequence
  Description of Artificial Sequence:  Enzymatic Nucleic Acid
aggagccacugaugaggccguuaggccgaaaagagggu

SEQ ID NO: 10484 - RNA, 38 nt, Artificial Sequence
  Description of Artificial Sequence:  Enzymatic Nucleic Acid
aaggagcccugaugaggccguuaggccgaaaaagaggg

SEQ ID NO: 10485 - RNA, 38 nt, Artificial Sequence
  Description of Artificial Sequence:  Enzymatic Nucleic Acid
guuagaagcugaugaggccguuaggccgaaagccaaaa

SEQ ID NO: 10486 - RNA, 38 nt, Artificial Sequence
  Description of Artificial Sequence:  Enzymatic Nucleic Acid
agaguuagcugaugaggccguuaggccgaaaggagcca

SEQ ID NO: 10487 - RNA, 38 nt, Artificial Sequence
  Description of Artificial Sequence:  Enzymatic Nucleic Acid
gagaguuacugaugaggccguuaggccgaaaaggagcc

SEQ ID NO: 10488 - RNA, 38 nt, Artificial Sequence
  Description of Artificial Sequence:  Enzymatic Nucleic Acid
aagagagucugaugaggccguuaggccgaaagaaggag

SEQ ID NO: 10489 - RNA, 38 nt, Artificial Sequence
  Description of Artificial Sequence:  Enzymatic Nucleic Acid
gaugaagacugaugaggccguuaggccgaaaguuagaa

SEQ ID NO: 10490 - RNA, 38 nt, Artificial Sequence
  Description of Artificial Sequence:  Enzymatic Nucleic Acid
cugaugaacugaugaggccguuaggccgaaagaguuag

SEQ ID NO: 10491 - RNA, 38 nt, Artificial Sequence
  Description of Artificial Sequence:  Enzymatic Nucleic Acid
uucugaugcugaugaggccguuaggccgaaagagaguu

SEQ ID NO: 10492 - RNA, 38 nt, Artificial Sequence
  Description of Artificial Sequence:  Enzymatic Nucleic Acid
uuucugaucugaugaggccguuaggccgaaaagagagu

SEQ ID NO: 10493 - RNA, 38 nt, Artificial Sequence
  Description of Artificial Sequence:  Enzymatic Nucleic Acid
aguuuucucugaugaggccguuaggccgaaaugaagag

SEQ ID NO: 10494 - RNA, 38 nt, Artificial Sequence
  Description of Artificial Sequence:  Enzymatic Nucleic Acid
cggaagaacugaugaggccguuaggccgaaaccgcuuc

SEQ ID NO: 10495 - RNA, 38 nt, Artificial Sequence
  Description of Artificial Sequence:  Enzymatic Nucleic Acid
uucggaagcugaugaggccguuaggccgaaagaccgcu

SEQ ID NO: 10496 - RNA, 38 nt, Artificial Sequence
  Description of Artificial Sequence:  Enzymatic Nucleic Acid
cuucggaacugaugaggccguuaggccgaaaagaccgc

SEQ ID NO: 10497 - RNA, 38 nt, Artificial Sequence
  Description of Artificial Sequence:  Enzymatic Nucleic Acid
uacuucggcugaugaggccguuaggccgaaagaagacc

SEQ ID NO: 10498 - RNA, 38 nt, Artificial Sequence
  Description of Artificial Sequence:  Enzymatic Nucleic Acid
uuacuucgcugaugaggccguuaggccgaaaagaagac

SEQ ID NO: 10499 - RNA, 38 nt, Artificial Sequence
  Description of Artificial Sequence:  Enzymatic Nucleic Acid
ucugucuucugaugaggccguuaggccgaaacuucgga

SEQ ID NO: 10500 - RNA, 38 nt, Artificial Sequence
  Description of Artificial Sequence:  Enzymatic Nucleic Acid
uugacaggcugaugaggccguuaggccgaaagucuguc

SEQ ID NO: 10501 - RNA, 38 nt, Artificial Sequence
  Description of Artificial Sequence:  Enzymatic Nucleic Acid
uaaugauucugaugaggccguuaggccgaaacagguag

SEQ ID NO: 10502 - RNA, 38 nt, Artificial Sequence
  Description of Artificial Sequence:  Enzymatic Nucleic Acid
uccauaaucugaugaggccguuaggccgaaauugacag

SEQ ID NO: 10503 - RNA, 38 nt, Artificial Sequence
  Description of Artificial Sequence:  Enzymatic Nucleic Acid
ggguccaucugaugaggccguuaggccgaaaugauuga

SEQ ID NO: 10504 - RNA, 38 nt, Artificial Sequence
  Description of Artificial Sequence:  Enzymatic Nucleic Acid
uggguccacugaugaggccguuaggccgaaaaugauug

SEQ ID NO: 10505 - RNA, 38 nt, Artificial Sequence
  Description of Artificial Sequence:  Enzymatic Nucleic Acid
uccaggggcugaugaggccguuaggccgaaacuucauc

SEQ ID NO: 10506 - RNA, 38 nt, Artificial Sequence
  Description of Artificial Sequence:  Enzymatic Nucleic Acid
auccagggcugaugaggccguuaggccgaaaacuucau

SEQ ID NO: 10507 - RNA, 38 nt, Artificial Sequence
  Description of Artificial Sequence:  Enzymatic Nucleic Acid
uggcaucacugaugaggccguuaggccgaaagggcagc

SEQ ID NO: 10508 - RNA, 38 nt, Artificial Sequence
  Description of Artificial Sequence:  Enzymatic Nucleic Acid
cccgugcacugaugaggccguuaggccgaaacucccac

SEQ ID NO: 10509 - RNA, 38 nt, Artificial Sequence
  Description of Artificial Sequence:  Enzymatic Nucleic Acid
ucccgugccugaugaggccguuaggccgaaaacuccca

SEQ ID NO: 10510 - RNA, 38 nt, Artificial Sequence
  Description of Artificial Sequence:  Enzymatic Nucleic Acid
gauuugcccugaugaggccguuaggccgaaaguuucag

SEQ ID NO: 10511 - RNA, 38 nt, Artificial Sequence
  Description of Artificial Sequence:  Enzymatic Nucleic Acid
uuccgagccugaugaggccguuaggccgaaauuugccu

SEQ ID NO: 10512 - RNA, 38 nt, Artificial Sequence
  Description of Artificial Sequence:  Enzymatic Nucleic Acid
ccucuucccugaugaggccguuaggccgaaagcgauuu

SEQ ID NO: 10513 - RNA, 38 nt, Artificial Sequence
  Description of Artificial Sequence:  Enzymatic Nucleic Acid
uuucccaacugaugaggccguuaggccgaaagccccuc

SEQ ID NO: 10514 - RNA, 38 nt, Artificial Sequence
  Description of Artificial Sequence:  Enzymatic Nucleic Acid
cuuucccacugaugaggccguuaggccgaaaagccccu

SEQ ID NO: 10515 - RNA, 38 nt, Artificial Sequence
  Description of Artificial Sequence:  Enzymatic Nucleic Acid
acuuuccccugaugaggccguuaggccgaaaaagcccc

SEQ ID NO: 10516 - RNA, 38 nt, Artificial Sequence
  Description of Artificial Sequence:  Enzymatic Nucleic Acid
gcuugaaccugaugaggccguuaggccgaaacuuuccc

SEQ ID NO: 10517 - RNA, 38 nt, Artificial Sequence
  Description of Artificial Sequence:  Enzymatic Nucleic Acid
gaggcuugcugaugaggccguuaggccgaaacgacuuu

SEQ ID NO: 10518 - RNA, 38 nt, Artificial Sequence
  Description of Artificial Sequence:  Enzymatic Nucleic Acid
agaggcuucugaugaggccguuaggccgaaaacgacuu

SEQ ID NO: 10519 - RNA, 38 nt, Artificial Sequence
  Description of Artificial Sequence:  Enzymatic Nucleic Acid
caaaugcacugaugaggccguuaggccgaaaggcuuga

SEQ ID NO: 10520 - RNA, 38 nt, Artificial Sequence
  Description of Artificial Sequence:  Enzymatic Nucleic Acid
uaaugccacugaugaggccguuaggccgaaaugcagag

SEQ ID NO: 10521 - RNA, 38 nt, Artificial Sequence
  Description of Artificial Sequence:  Enzymatic Nucleic Acid
uuaaugcccugaugaggccguuaggccgaaaaugcaga

SEQ ID NO: 10522 - RNA, 38 nt, Artificial Sequence
  Description of Artificial Sequence:  Enzymatic Nucleic Acid
aggugggucugaugaggccguuaggccgaaauuucuua

SEQ ID NO: 10523 - RNA, 38 nt, Artificial Sequence
  Description of Artificial Sequence:  Enzymatic Nucleic Acid
ccucuuuccugaugaggccguuaggccgaaacaucuuc

SEQ ID NO: 10524 - RNA, 38 nt, Artificial Sequence
  Description of Artificial Sequence:  Enzymatic Nucleic Acid
gagcuuugcugaugaggccguuaggccgaaacucacug

SEQ ID NO: 10525 - RNA, 38 nt, Artificial Sequence
  Description of Artificial Sequence:  Enzymatic Nucleic Acid
ggucaucacugaugaggccguuaggccgaaagcuuugu

SEQ ID NO: 10526 - RNA, 38 nt, Artificial Sequence
  Description of Artificial Sequence:  Enzymatic Nucleic Acid
aagaucuucugaugaggccguuaggccgaaaguucggu

SEQ ID NO: 10527 - RNA, 38 nt, Artificial Sequence
  Description of Artificial Sequence:  Enzymatic Nucleic Acid
ugggucaacugaugaggccguuaggccgaaaucuugag

SEQ ID NO: 10528 - RNA, 38 nt, Artificial Sequence
  Description of Artificial Sequence:  Enzymatic Nucleic Acid
uguggguccugaugaggccguuaggccgaaagaucuug

SEQ ID NO: 10529 - RNA, 38 nt, Artificial Sequence
  Description of Artificial Sequence:  Enzymatic Nucleic Acid
ugauggcccugaugaggccguuaggccgaaaugugggu

SEQ ID NO: 10530 - RNA, 38 nt, Artificial Sequence
  Description of Artificial Sequence:  Enzymatic Nucleic Acid
auucagaucugaugaggccguuaggccgaaauggccga

SEQ ID NO: 10531 - RNA, 38 nt, Artificial Sequence
  Description of Artificial Sequence:  Enzymatic Nucleic Acid
cacauucacugaugaggccguuaggccgaaaugauggc

SEQ ID NO: 10532 - RNA, 38 nt, Artificial Sequence
  Description of Artificial Sequence:  Enzymatic Nucleic Acid
aggagguucugaugaggccguuaggccgaaaccacauu

SEQ ID NO: 10533 - RNA, 38 nt, Artificial Sequence
  Description of Artificial Sequence:  Enzymatic Nucleic Acid
caggaggucugaugaggccguuaggccgaaaaccacau

SEQ ID NO: 10534 - RNA, 38 nt, Artificial Sequence
  Description of Artificial Sequence:  Enzymatic Nucleic Acid
gcucccagcugaugaggccguuaggccgaaagguuaac

SEQ ID NO: 10535 - RNA, 38 nt, Artificial Sequence
  Description of Artificial Sequence:  Enzymatic Nucleic Acid
uauuccaccugaugaggccguuaggccgaaaucaccau

SEQ ID NO: 10536 - RNA, 38 nt, Artificial Sequence
  Description of Artificial Sequence:  Enzymatic Nucleic Acid
auuugcagcugaugaggccguuaggccgaaauuccacg

SEQ ID NO: 10537 - RNA, 38 nt, Artificial Sequence
  Description of Artificial Sequence:  Enzymatic Nucleic Acid
gguuuccgcugaugaggccguuaggccgaaauuugcag

SEQ ID NO: 10538 - RNA, 38 nt, Artificial Sequence
  Description of Artificial Sequence:  Enzymatic Nucleic Acid
gguaguugcugaugaggccguuaggccgaaacagguuu

SEQ ID NO: 10539 - RNA, 38 nt, Artificial Sequence
  Description of Artificial Sequence:  Enzymatic Nucleic Acid
ucuugaggcugaugaggccguuaggccgaaaguuggac

SEQ ID NO: 10540 - RNA, 38 nt, Artificial Sequence
  Description of Artificial Sequence:  Enzymatic Nucleic Acid
gacagaaucugaugaggccguuaggccgaaagucacgu

SEQ ID NO: 10541 - RNA, 38 nt, Artificial Sequence
  Description of Artificial Sequence:  Enzymatic Nucleic Acid
agacagaacugaugaggccguuaggccgaaaagucacg

SEQ ID NO: 10542 - RNA, 38 nt, Artificial Sequence
  Description of Artificial Sequence:  Enzymatic Nucleic Acid
ugagacagcugaugaggccguuaggccgaaauaaguca

SEQ ID NO: 10543 - RNA, 38 nt, Artificial Sequence
  Description of Artificial Sequence:  Enzymatic Nucleic Acid
uugagacacugaugaggccguuaggccgaaaauaaguc

SEQ ID NO: 10544 - RNA, 38 nt, Artificial Sequence
  Description of Artificial Sequence:  Enzymatic Nucleic Acid
cuuguugacugaugaggccguuaggccgaaacagaaua

SEQ ID NO: 10545 - RNA, 38 nt, Artificial Sequence
  Description of Artificial Sequence:  Enzymatic Nucleic Acid
uccuuguucugaugaggccguuaggccgaaagacagaa

SEQ ID NO: 10546 - RNA, 38 nt, Artificial Sequence
  Description of Artificial Sequence:  Enzymatic Nucleic Acid
ccauaugccugaugaggccguuaggccgaaaggcugcg

SEQ ID NO: 10547 - RNA, 38 nt, Artificial Sequence
  Description of Artificial Sequence:  Enzymatic Nucleic Acid
gagcuccacugaugaggccguuaggccgaaaugcaagg

SEQ ID NO: 10548 - RNA, 38 nt, Artificial Sequence
  Description of Artificial Sequence:  Enzymatic Nucleic Acid
ucuuucuucugaugaggccguuaggccgaaagcuccau

SEQ ID NO: 10549 - RNA, 38 nt, Artificial Sequence
  Description of Artificial Sequence:  Enzymatic Nucleic Acid
acacuguccugaugaggccguuaggccgaaaggcgggg

SEQ ID NO: 10550 - RNA, 38 nt, Artificial Sequence
  Description of Artificial Sequence:  Enzymatic Nucleic Acid
gagcugcucugaugaggccguuaggccgaaacacuguc

SEQ ID NO: 10551 - RNA, 38 nt, Artificial Sequence
  Description of Artificial Sequence:  Enzymatic Nucleic Acid
ugacacuucugaugaggccguuaggccgaaagcugcug

SEQ ID NO: 10552 - RNA, 38 nt, Artificial Sequence
  Description of Artificial Sequence:  Enzymatic Nucleic Acid
gagcuggucugaugaggccguuaggccgaaacacuuga

SEQ ID NO: 10553 - RNA, 38 nt, Artificial Sequence
  Description of Artificial Sequence:  Enzymatic Nucleic Acid
ggaagcugcugaugaggccguuaggccgaaagcuggug

SEQ ID NO: 10554 - RNA, 38 nt, Artificial Sequence
  Description of Artificial Sequence:  Enzymatic Nucleic Acid
cuucagggcugaugaggccguuaggccgaaagcuggag

SEQ ID NO: 10555 - RNA, 38 nt, Artificial Sequence
  Description of Artificial Sequence:  Enzymatic Nucleic Acid
ucuucaggcugaugaggccguuaggccgaaaagcugga

SEQ ID NO: 10556 - RNA, 38 nt, Artificial Sequence
  Description of Artificial Sequence:  Enzymatic Nucleic Acid
cucacugucugaugaggccguuaggccgaaauccucgu

SEQ ID NO: 10557 - RNA, 38 nt, Artificial Sequence
  Description of Artificial Sequence:  Enzymatic Nucleic Acid
ucucacugcugaugaggccguuaggccgaaaauccucg

SEQ ID NO: 10558 - RNA, 38 nt, Artificial Sequence
  Description of Artificial Sequence:  Enzymatic Nucleic Acid
ugcuuggacugaugaggccguuaggccgaaaucucacu

SEQ ID NO: 10559 - RNA, 38 nt, Artificial Sequence
  Description of Artificial Sequence:  Enzymatic Nucleic Acid
gcugcuugcugaugaggccguuaggccgaaagaucuca

SEQ ID NO: 10560 - RNA, 38 nt, Artificial Sequence
  Description of Artificial Sequence:  Enzymatic Nucleic Acid
uccauggucugaugaggccguuaggccgaaaggggcug

SEQ ID NO: 10561 - RNA, 38 nt, Artificial Sequence
  Description of Artificial Sequence:  Enzymatic Nucleic Acid
cuguaggacugaugaggccguuaggccgaaaucagguc

SEQ ID NO: 10562 - RNA, 38 nt, Artificial Sequence
  Description of Artificial Sequence:  Enzymatic Nucleic Acid
acuguaggcugaugaggccguuaggccgaaaaucaggu

SEQ ID NO: 10563 - RNA, 38 nt, Artificial Sequence
  Description of Artificial Sequence:  Enzymatic Nucleic Acid
aacuguagcugaugaggccguuaggccgaaaaaucagg

SEQ ID NO: 10564 - RNA, 38 nt, Artificial Sequence
  Description of Artificial Sequence:  Enzymatic Nucleic Acid
ggaaacugcugaugaggccguuaggccgaaaggaaauc

SEQ ID NO: 10565 - RNA, 38 nt, Artificial Sequence
  Description of Artificial Sequence:  Enzymatic Nucleic Acid
cacuuggacugaugaggccguuaggccgaaacuguagg

SEQ ID NO: 10566 - RNA, 38 nt, Artificial Sequence
  Description of Artificial Sequence:  Enzymatic Nucleic Acid
ccacuuggcugaugaggccguuaggccgaaaacuguag

SEQ ID NO: 10567 - RNA, 38 nt, Artificial Sequence
  Description of Artificial Sequence:  Enzymatic Nucleic Acid
aggacagacugaugaggccguuaggccgaaacuccaug

SEQ ID NO: 10568 - RNA, 38 nt, Artificial Sequence
  Description of Artificial Sequence:  Enzymatic Nucleic Acid
gaggacagcugaugaggccguuaggccgaaaacuccau

SEQ ID NO: 10569 - RNA, 38 nt, Artificial Sequence
  Description of Artificial Sequence:  Enzymatic Nucleic Acid
ggaggacacugaugaggccguuaggccgaaaaacucca

SEQ ID NO: 10570 - RNA, 38 nt, Artificial Sequence
  Description of Artificial Sequence:  Enzymatic Nucleic Acid
uucuggagcugaugaggccguuaggccgaaacagaaac

SEQ ID NO: 10571 - RNA, 38 nt, Artificial Sequence
  Description of Artificial Sequence:  Enzymatic Nucleic Acid
acuuucugcugaugaggccguuaggccgaaaggacaga

SEQ ID NO: 10572 - RNA, 38 nt, Artificial Sequence
  Description of Artificial Sequence:  Enzymatic Nucleic Acid
ucagauaacugaugaggccguuaggccgaaaggauguu

SEQ ID NO: 10573 - RNA, 38 nt, Artificial Sequence
  Description of Artificial Sequence:  Enzymatic Nucleic Acid
cucagauacugaugaggccguuaggccgaaaaggaugu

SEQ ID NO: 10574 - RNA, 38 nt, Artificial Sequence
  Description of Artificial Sequence:  Enzymatic Nucleic Acid
ucucagaucugaugaggccguuaggccgaaaaaggaug

SEQ ID NO: 10575 - RNA, 38 nt, Artificial Sequence
  Description of Artificial Sequence:  Enzymatic Nucleic Acid
uucucagacugaugaggccguuaggccgaaaaaaggau

SEQ ID NO: 10576 - RNA, 38 nt, Artificial Sequence
  Description of Artificial Sequence:  Enzymatic Nucleic Acid
uguucucacugaugaggccguuaggccgaaauaaaagg

SEQ ID NO: 10577 - RNA, 38 nt, Artificial Sequence
  Description of Artificial Sequence:  Enzymatic Nucleic Acid
aagucgcacugaugaggccguuaggccgaaaucuucac

SEQ ID NO: 10578 - RNA, 38 nt, Artificial Sequence
  Description of Artificial Sequence:  Enzymatic Nucleic Acid
aaagucgccugaugaggccguuaggccgaaaaucuuca

SEQ ID NO: 10579 - RNA, 38 nt, Artificial Sequence
  Description of Artificial Sequence:  Enzymatic Nucleic Acid
ccaggccacugaugaggccguuaggccgaaagucgcaa

SEQ ID NO: 10580 - RNA, 38 nt, Artificial Sequence
  Description of Artificial Sequence:  Enzymatic Nucleic Acid
gccaggcccugaugaggccguuaggccgaaaagucgca

SEQ ID NO: 10581 - RNA, 38 nt, Artificial Sequence
  Description of Artificial Sequence:  Enzymatic Nucleic Acid
aggguucucugaugaggccguuaggccgaaauaaauau

SEQ ID NO: 10582 - RNA, 38 nt, Artificial Sequence
  Description of Artificial Sequence:  Enzymatic Nucleic Acid
ccucacaucugaugaggccguuaggccgaaaucagggu

SEQ ID NO: 10583 - RNA, 38 nt, Artificial Sequence
  Description of Artificial Sequence:  Enzymatic Nucleic Acid
uccucacacugaugaggccguuaggccgaaaaucaggg

SEQ ID NO: 10584 - RNA, 38 nt, Artificial Sequence
  Description of Artificial Sequence:  Enzymatic Nucleic Acid
aagucgagcugaugaggccguuaggccgaaaucuccuc

SEQ ID NO: 10585 - RNA, 38 nt, Artificial Sequence
  Description of Artificial Sequence:  Enzymatic Nucleic Acid
gggaaguccugaugaggccguuaggccgaaaguaucuc

SEQ ID NO: 10586 - RNA, 38 nt, Artificial Sequence
  Description of Artificial Sequence:  Enzymatic Nucleic Acid
uuuaggggcugaugaggccguuaggccgaaagucgagu

SEQ ID NO: 10587 - RNA, 38 nt, Artificial Sequence
  Description of Artificial Sequence:  Enzymatic Nucleic Acid
uuuuagggcugaugaggccguuaggccgaaaagucgag

SEQ ID NO: 10588 - RNA, 38 nt, Artificial Sequence
  Description of Artificial Sequence:  Enzymatic Nucleic Acid
auccauuucugaugaggccguuaggccgaaaggggaag

SEQ ID NO: 10589 - RNA, 38 nt, Artificial Sequence
  Description of Artificial Sequence:  Enzymatic Nucleic Acid
ggauucagcugaugaggccguuaggccgaaagccaucc

SEQ ID NO: 10590 - RNA, 38 nt, Artificial Sequence
  Description of Artificial Sequence:  Enzymatic Nucleic Acid
caaagaugcugaugaggccguuaggccgaaauucagga

SEQ ID NO: 10591 - RNA, 38 nt, Artificial Sequence
  Description of Artificial Sequence:  Enzymatic Nucleic Acid
uugucaaacugaugaggccguuaggccgaaauggauuc

SEQ ID NO: 10592 - RNA, 38 nt, Artificial Sequence
  Description of Artificial Sequence:  Enzymatic Nucleic Acid
ccuugucacugaugaggccguuaggccgaaagauggau

SEQ ID NO: 10593 - RNA, 38 nt, Artificial Sequence
  Description of Artificial Sequence:  Enzymatic Nucleic Acid
accuuguccugaugaggccguuaggccgaaaagaugga

SEQ ID NO: 10594 - RNA, 38 nt, Artificial Sequence
  Description of Artificial Sequence:  Enzymatic Nucleic Acid
gugcuguacugaugaggccguuaggccgaaaccuuguc

SEQ ID NO: 10595 - RNA, 38 nt, Artificial Sequence
  Description of Artificial Sequence:  Enzymatic Nucleic Acid
uggugcugcugaugaggccguuaggccgaaagaccuug

SEQ ID NO: 10596 - RNA, 38 nt, Artificial Sequence
  Description of Artificial Sequence:  Enzymatic Nucleic Acid
cgccauagcugaugaggccguuaggccgaaaccacaca

SEQ ID NO: 10597 - RNA, 38 nt, Artificial Sequence
  Description of Artificial Sequence:  Enzymatic Nucleic Acid
acacgccacugaugaggccguuaggccgaaaggaccac

SEQ ID NO: 10598 - RNA, 38 nt, Artificial Sequence
  Description of Artificial Sequence:  Enzymatic Nucleic Acid
cccacagccugaugaggccguuaggccgaaacacgcca

SEQ ID NO: 10599 - RNA, 38 nt, Artificial Sequence
  Description of Artificial Sequence:  Enzymatic Nucleic Acid
aaggagaacugaugaggccguuaggccgaaaucuccca

SEQ ID NO: 10600 - RNA, 38 nt, Artificial Sequence
  Description of Artificial Sequence:  Enzymatic Nucleic Acid
cuaaggagcugaugaggccguuaggccgaaagaucucc

SEQ ID NO: 10601 - RNA, 38 nt, Artificial Sequence
  Description of Artificial Sequence:  Enzymatic Nucleic Acid
ccuaaggacugaugaggccguuaggccgaaaagaucuc

SEQ ID NO: 10602 - RNA, 38 nt, Artificial Sequence
  Description of Artificial Sequence:  Enzymatic Nucleic Acid
ccccuaagcugaugaggccguuaggccgaaagaagauc

SEQ ID NO: 10603 - RNA, 38 nt, Artificial Sequence
  Description of Artificial Sequence:  Enzymatic Nucleic Acid
aacccccucugaugaggccguuaggccgaaaggagaag

SEQ ID NO: 10604 - RNA, 38 nt, Artificial Sequence
  Description of Artificial Sequence:  Enzymatic Nucleic Acid
gaaccccccugaugaggccguuaggccgaaaaggagaa

SEQ ID NO: 10605 - RNA, 38 nt, Artificial Sequence
  Description of Artificial Sequence:  Enzymatic Nucleic Acid
guauggagcugaugaggccguuaggccgaaacccccua

SEQ ID NO: 10606 - RNA, 38 nt, Artificial Sequence
  Description of Artificial Sequence:  Enzymatic Nucleic Acid
gguauggacugaugaggccguuaggccgaaaacccccu

SEQ ID NO: 10607 - RNA, 38 nt, Artificial Sequence
  Description of Artificial Sequence:  Enzymatic Nucleic Acid
uggguaugcugaugaggccguuaggccgaaagaacccc

SEQ ID NO: 10608 - RNA, 38 nt, Artificial Sequence
  Description of Artificial Sequence:  Enzymatic Nucleic Acid
cuccugggcugaugaggccguuaggccgaaauggagaa

SEQ ID NO: 10609 - RNA, 38 nt, Artificial Sequence
  Description of Artificial Sequence:  Enzymatic Nucleic Acid
ggcugcagcugaugaggccguuaggccgaaagucuuca

SEQ ID NO: 10610 - RNA, 38 nt, Artificial Sequence
  Description of Artificial Sequence:  Enzymatic Nucleic Acid
cggcugcacugaugaggccguuaggccgaaaagucuuc

SEQ ID NO: 10611 - RNA, 38 nt, Artificial Sequence
  Description of Artificial Sequence:  Enzymatic Nucleic Acid
guguggcacugaugaggccguuaggccgaaacuccggg

SEQ ID NO: 10612 - RNA, 38 nt, Artificial Sequence
  Description of Artificial Sequence:  Enzymatic Nucleic Acid
auuugguacugaugaggccguuaggccgaaauuucagg

SEQ ID NO: 10613 - RNA, 38 nt, Artificial Sequence
  Description of Artificial Sequence:  Enzymatic Nucleic Acid
ugauuuggcugaugaggccguuaggccgaaagauuuca

SEQ ID NO: 10614 - RNA, 38 nt, Artificial Sequence
  Description of Artificial Sequence:  Enzymatic Nucleic Acid
uccaacaucugaugaggccguuaggccgaaauuuggua

SEQ ID NO: 10615 - RNA, 38 nt, Artificial Sequence
  Description of Artificial Sequence:  Enzymatic Nucleic Acid
agcaaucccugaugaggccguuaggccgaaacaugauu

SEQ ID NO: 10616 - RNA, 38 nt, Artificial Sequence
  Description of Artificial Sequence:  Enzymatic Nucleic Acid
gugccagccugaugaggccguuaggccgaaauccaaca

SEQ ID NO: 10617 - RNA, 38 nt, Artificial Sequence
  Description of Artificial Sequence:  Enzymatic Nucleic Acid
guucagcacugaugaggccguuaggccgaaaccggggc

SEQ ID NO: 10618 - RNA, 38 nt, Artificial Sequence
  Description of Artificial Sequence:  Enzymatic Nucleic Acid
aguucagccugaugaggccguuaggccgaaaaccgggg

SEQ ID NO: 10619 - RNA, 38 nt, Artificial Sequence
  Description of Artificial Sequence:  Enzymatic Nucleic Acid
uucuccaccugaugaggccguuaggccgaaaguucagc

SEQ ID NO: 10620 - RNA, 38 nt, Artificial Sequence
  Description of Artificial Sequence:  Enzymatic Nucleic Acid
aggucacccugaugaggccguuaggccgaaaguuucuc

SEQ ID NO: 10621 - RNA, 38 nt, Artificial Sequence
  Description of Artificial Sequence:  Enzymatic Nucleic Acid
uuggcuugcugaugaggccguuaggccgaaagcagguc

SEQ ID NO: 10622 - RNA, 38 nt, Artificial Sequence
  Description of Artificial Sequence:  Enzymatic Nucleic Acid
guuggcuucugaugaggccguuaggccgaaaagcaggu

SEQ ID NO: 10623 - RNA, 38 nt, Artificial Sequence
  Description of Artificial Sequence:  Enzymatic Nucleic Acid
uccuguugcugaugaggccguuaggccgaaacguuggc

SEQ ID NO: 10624 - RNA, 38 nt, Artificial Sequence
  Description of Artificial Sequence:  Enzymatic Nucleic Acid
ggggaugucugaugaggccguuaggccgaaaucuuucc

SEQ ID NO: 10625 - RNA, 38 nt, Artificial Sequence
  Description of Artificial Sequence:  Enzymatic Nucleic Acid
gggggaugcugaugaggccguuaggccgaaaaucuuuc

SEQ ID NO: 10626 - RNA, 38 nt, Artificial Sequence
  Description of Artificial Sequence:  Enzymatic Nucleic Acid
uugaggggcugaugaggccguuaggccgaaauguaauc

SEQ ID NO: 10627 - RNA, 38 nt, Artificial Sequence
  Description of Artificial Sequence:  Enzymatic Nucleic Acid
auggcauucugaugaggccguuaggccgaaagggggau

SEQ ID NO: 10628 - RNA, 38 nt, Artificial Sequence
  Description of Artificial Sequence:  Enzymatic Nucleic Acid
cuagucagcugaugaggccguuaggccgaaauggcauu

SEQ ID NO: 10629 - RNA, 38 nt, Artificial Sequence
  Description of Artificial Sequence:  Enzymatic Nucleic Acid
acuguuuccugaugaggccguuaggccgaaagucagua

SEQ ID NO: 10630 - RNA, 38 nt, Artificial Sequence
  Description of Artificial Sequence:  Enzymatic Nucleic Acid
ugugaagccugaugaggccguuaggccgaaacuguuuc

SEQ ID NO: 10631 - RNA, 38 nt, Artificial Sequence
  Description of Artificial Sequence:  Enzymatic Nucleic Acid
aguaugugcugaugaggccguuaggccgaaagcuacug

SEQ ID NO: 10632 - RNA, 38 nt, Artificial Sequence
  Description of Artificial Sequence:  Enzymatic Nucleic Acid
gaguaugucugaugaggccguuaggccgaaaagcuacu

SEQ ID NO: 10633 - RNA, 38 nt, Artificial Sequence
  Description of Artificial Sequence:  Enzymatic Nucleic Acid
gggucgagcugaugaggccguuaggccgaaaugugaag

SEQ ID NO: 10634 - RNA, 38 nt, Artificial Sequence
  Description of Artificial Sequence:  Enzymatic Nucleic Acid
uggggguccugaugaggccguuaggccgaaaguaugug

SEQ ID NO: 10635 - RNA, 38 nt, Artificial Sequence
  Description of Artificial Sequence:  Enzymatic Nucleic Acid
ccucagagcugaugaggccguuaggccgaaaggugggg

SEQ ID NO: 10636 - RNA, 38 nt, Artificial Sequence
  Description of Artificial Sequence:  Enzymatic Nucleic Acid
uccucagacugaugaggccguuaggccgaaaagguggg

SEQ ID NO: 10637 - RNA, 38 nt, Artificial Sequence
  Description of Artificial Sequence:  Enzymatic Nucleic Acid
gguccucacugaugaggccguuaggccgaaagaaggug

SEQ ID NO: 10638 - RNA, 38 nt, Artificial Sequence
  Description of Artificial Sequence:  Enzymatic Nucleic Acid
uccuugaacugaugaggccguuaggccgaaagguccuc

SEQ ID NO: 10639 - RNA, 38 nt, Artificial Sequence
  Description of Artificial Sequence:  Enzymatic Nucleic Acid
guccuugacugaugaggccguuaggccgaaaagguccu

SEQ ID NO: 10640 - RNA, 38 nt, Artificial Sequence
  Description of Artificial Sequence:  Enzymatic Nucleic Acid
cguccuugcugaugaggccguuaggccgaaaaaggucc

SEQ ID NO: 10641 - RNA, 38 nt, Artificial Sequence
  Description of Artificial Sequence:  Enzymatic Nucleic Acid
ccguccuucugaugaggccguuaggccgaaaaaagguc

SEQ ID NO: 10642 - RNA, 38 nt, Artificial Sequence
  Description of Artificial Sequence:  Enzymatic Nucleic Acid
gaucugcacugaugaggccguuaggccgaaagccgucc

SEQ ID NO: 10643 - RNA, 38 nt, Artificial Sequence
  Description of Artificial Sequence:  Enzymatic Nucleic Acid
ggaucugccugaugaggccguuaggccgaaaagccguc

SEQ ID NO: 10644 - RNA, 38 nt, Artificial Sequence
  Description of Artificial Sequence:  Enzymatic Nucleic Acid
aaaaugugcugaugaggccguuaggccgaaaucugcaa

SEQ ID NO: 10645 - RNA, 38 nt, Artificial Sequence
  Description of Artificial Sequence:  Enzymatic Nucleic Acid
ggaaugaacugaugaggccguuaggccgaaauguggau

SEQ ID NO: 10646 - RNA, 38 nt, Artificial Sequence
  Description of Artificial Sequence:  Enzymatic Nucleic Acid
cggaaugacugaugaggccguuaggccgaaaaugugga

SEQ ID NO: 10647 - RNA, 38 nt, Artificial Sequence
  Description of Artificial Sequence:  Enzymatic Nucleic Acid
ccggaaugcugaugaggccguuaggccgaaaaaugugg

SEQ ID NO: 10648 - RNA, 38 nt, Artificial Sequence
  Description of Artificial Sequence:  Enzymatic Nucleic Acid
uccggaaucugaugaggccguuaggccgaaaaaaugug

SEQ ID NO: 10649 - RNA, 38 nt, Artificial Sequence
  Description of Artificial Sequence:  Enzymatic Nucleic Acid
gcuuccggcugaugaggccguuaggccgaaaugaaaau

SEQ ID NO: 10650 - RNA, 38 nt, Artificial Sequence
  Description of Artificial Sequence:  Enzymatic Nucleic Acid
agcuuccgcugaugaggccguuaggccgaaaaugaaaa

SEQ ID NO: 10651 - RNA, 38 nt, Artificial Sequence
  Description of Artificial Sequence:  Enzymatic Nucleic Acid
caucaucacugaugaggccguuaggccgaaagcuuccg

SEQ ID NO: 10652 - RNA, 38 nt, Artificial Sequence
  Description of Artificial Sequence:  Enzymatic Nucleic Acid
cguuuacacugaugaggccguuaggccgaaaucucaca

SEQ ID NO: 10653 - RNA, 38 nt, Artificial Sequence
  Description of Artificial Sequence:  Enzymatic Nucleic Acid
aaagcguucugaugaggccguuaggccgaaacauaucu

SEQ ID NO: 10654 - RNA, 38 nt, Artificial Sequence
  Description of Artificial Sequence:  Enzymatic Nucleic Acid
gaauuugacugaugaggccguuaggccgaaagcguuua

SEQ ID NO: 10655 - RNA, 38 nt, Artificial Sequence
  Description of Artificial Sequence:  Enzymatic Nucleic Acid
ugaauuugcugaugaggccguuaggccgaaaagcguuu

SEQ ID NO: 10656 - RNA, 38 nt, Artificial Sequence
  Description of Artificial Sequence:  Enzymatic Nucleic Acid
augaauuucugaugaggccguuaggccgaaaaagcguu

SEQ ID NO: 10657 - RNA, 38 nt, Artificial Sequence
  Description of Artificial Sequence:  Enzymatic Nucleic Acid
ggcucaugcugaugaggccguuaggccgaaauuugaaa

SEQ ID NO: 10658 - RNA, 38 nt, Artificial Sequence
  Description of Artificial Sequence:  Enzymatic Nucleic Acid
aggcucaucugaugaggccguuaggccgaaaauuugaa

SEQ ID NO: 10659 - RNA, 38 nt, Artificial Sequence
  Description of Artificial Sequence:  Enzymatic Nucleic Acid
gcuccucacugaugaggccguuaggccgaaagguuuug

SEQ ID NO: 10660 - RNA, 38 nt, Artificial Sequence
  Description of Artificial Sequence:  Enzymatic Nucleic Acid
agcuccuccugaugaggccguuaggccgaaaagguuuu

SEQ ID NO: 10661 - RNA, 38 nt, Artificial Sequence
  Description of Artificial Sequence:  Enzymatic Nucleic Acid
uucggugacugaugaggccguuaggccgaaagcuccuc

SEQ ID NO: 10662 - RNA, 38 nt, Artificial Sequence
  Description of Artificial Sequence:  Enzymatic Nucleic Acid
guucggugcugaugaggccguuaggccgaaaagcuccu

SEQ ID NO: 10663 - RNA, 38 nt, Artificial Sequence
  Description of Artificial Sequence:  Enzymatic Nucleic Acid
aguucggucugaugaggccguuaggccgaaaaagcucc

SEQ ID NO: 10664 - RNA, 38 nt, Artificial Sequence
  Description of Artificial Sequence:  Enzymatic Nucleic Acid
uggaggugcugaugaggccguuaggccgaaaguucggu

SEQ ID NO: 10665 - RNA, 38 nt, Artificial Sequence
  Description of Artificial Sequence:  Enzymatic Nucleic Acid
caaacaugcugaugaggccguuaggccgaaagguggag

SEQ ID NO: 10666 - RNA, 38 nt, Artificial Sequence
  Description of Artificial Sequence:  Enzymatic Nucleic Acid
aguccucacugaugaggccguuaggccgaaacauggag

SEQ ID NO: 10667 - RNA, 38 nt, Artificial Sequence
  Description of Artificial Sequence:  Enzymatic Nucleic Acid
uaguccuccugaugaggccguuaggccgaaaacaugga

SEQ ID NO: 10668 - RNA, 38 nt, Artificial Sequence
  Description of Artificial Sequence:  Enzymatic Nucleic Acid
ccagcugacugaugaggccguuaggccgaaaguccuca

SEQ ID NO: 10669 - RNA, 38 nt, Artificial Sequence
  Description of Artificial Sequence:  Enzymatic Nucleic Acid
guccagcucugaugaggccguuaggccgaaauaguccu

SEQ ID NO: 10670 - RNA, 38 nt, Artificial Sequence
  Description of Artificial Sequence:  Enzymatic Nucleic Acid
cagagugccugaugaggccguuaggccgaaagugucca

SEQ ID NO: 10671 - RNA, 38 nt, Artificial Sequence
  Description of Artificial Sequence:  Enzymatic Nucleic Acid
gcccagcacugaugaggccguuaggccgaaagugcuag

SEQ ID NO: 10672 - RNA, 38 nt, Artificial Sequence
  Description of Artificial Sequence:  Enzymatic Nucleic Acid
gcaaggggcugaugaggccguuaggccgaaagcccagc

SEQ ID NO: 10673 - RNA, 38 nt, Artificial Sequence
  Description of Artificial Sequence:  Enzymatic Nucleic Acid
gcuucagccugaugaggccguuaggccgaaagggggag

SEQ ID NO: 10674 - RNA, 38 nt, Artificial Sequence
  Description of Artificial Sequence:  Enzymatic Nucleic Acid
uccaggugcugaugaggccguuaggccgaaaccgcuuc

SEQ ID NO: 10675 - RNA, 38 nt, Artificial Sequence
  Description of Artificial Sequence:  Enzymatic Nucleic Acid
guccaggucugaugaggccguuaggccgaaaaccgcuu

SEQ ID NO: 10676 - RNA, 38 nt, Artificial Sequence
  Description of Artificial Sequence:  Enzymatic Nucleic Acid
ucuucaugcugaugaggccguuaggccgaaaggccuug

SEQ ID NO: 10677 - RNA, 38 nt, Artificial Sequence
  Description of Artificial Sequence:  Enzymatic Nucleic Acid
cucaaguccugaugaggccguuaggccgaaaucuucau

SEQ ID NO: 10678 - RNA, 38 nt, Artificial Sequence
  Description of Artificial Sequence:  Enzymatic Nucleic Acid
cuauucuccugaugaggccguuaggccgaaagucuauc

SEQ ID NO: 10679 - RNA, 38 nt, Artificial Sequence
  Description of Artificial Sequence:  Enzymatic Nucleic Acid
uuacucgccugaugaggccguuaggccgaaauucucaa

SEQ ID NO: 10680 - RNA, 38 nt, Artificial Sequence
  Description of Artificial Sequence:  Enzymatic Nucleic Acid
cuugcuuucugaugaggccguuaggccgaaacucgcua

SEQ ID NO: 10681 - RNA, 38 nt, Artificial Sequence
  Description of Artificial Sequence:  Enzymatic Nucleic Acid
agaucggacugaugaggccguuaggccgaaagucccgc

SEQ ID NO: 10682 - RNA, 38 nt, Artificial Sequence
  Description of Artificial Sequence:  Enzymatic Nucleic Acid
cagaucggcugaugaggccguuaggccgaaaagucccg

SEQ ID NO: 10683 - RNA, 38 nt, Artificial Sequence
  Description of Artificial Sequence:  Enzymatic Nucleic Acid
gcagaucgcugaugaggccguuaggccgaaaaaguccc

SEQ ID NO: 10684 - RNA, 38 nt, Artificial Sequence
  Description of Artificial Sequence:  Enzymatic Nucleic Acid
ccucggcacugaugaggccguuaggccgaaaucggaaa

SEQ ID NO: 10685 - RNA, 38 nt, Artificial Sequence
  Description of Artificial Sequence:  Enzymatic Nucleic Acid
agaagcagcugaugaggccguuaggccgaaagcugggc

SEQ ID NO: 10686 - RNA, 38 nt, Artificial Sequence
  Description of Artificial Sequence:  Enzymatic Nucleic Acid
gagaagcacugaugaggccguuaggccgaaaagcuggg

SEQ ID NO: 10687 - RNA, 38 nt, Artificial Sequence
  Description of Artificial Sequence:  Enzymatic Nucleic Acid
agcuggagcugaugaggccguuaggccgaaagcagaag

SEQ ID NO: 10688 - RNA, 38 nt, Artificial Sequence
  Description of Artificial Sequence:  Enzymatic Nucleic Acid
cagcuggacugaugaggccguuaggccgaaaagcagaa

SEQ ID NO: 10689 - RNA, 38 nt, Artificial Sequence
  Description of Artificial Sequence:  Enzymatic Nucleic Acid
cacagcugcugaugaggccguuaggccgaaagaagcag

SEQ ID NO: 10690 - RNA, 38 nt, Artificial Sequence
  Description of Artificial Sequence:  Enzymatic Nucleic Acid
acgggccucugaugaggccguuaggccgaaauguggcc

SEQ ID NO: 10691 - RNA, 38 nt, Artificial Sequence
  Description of Artificial Sequence:  Enzymatic Nucleic Acid
ccagcucacugaugaggccguuaggccgaaauucaucg

SEQ ID NO: 10692 - RNA, 38 nt, Artificial Sequence
  Description of Artificial Sequence:  Enzymatic Nucleic Acid
aacagcagcugaugaggccguuaggccgaaacuccuuu

SEQ ID NO: 10693 - RNA, 38 nt, Artificial Sequence
  Description of Artificial Sequence:  Enzymatic Nucleic Acid
ggguggagcugaugaggccguuaggccgaaacagcagg

SEQ ID NO: 10694 - RNA, 38 nt, Artificial Sequence
  Description of Artificial Sequence:  Enzymatic Nucleic Acid
gggguggacugaugaggccguuaggccgaaaacagcag

SEQ ID NO: 10695 - RNA, 38 nt, Artificial Sequence
  Description of Artificial Sequence:  Enzymatic Nucleic Acid
ugggggugcugaugaggccguuaggccgaaagaacagc

SEQ ID NO: 10696 - RNA, 38 nt, Artificial Sequence
  Description of Artificial Sequence:  Enzymatic Nucleic Acid
cggaguugcugaugaggccguuaggccgaaagucuggg

SEQ ID NO: 10697 - RNA, 38 nt, Artificial Sequence
  Description of Artificial Sequence:  Enzymatic Nucleic Acid
acaccacgcugaugaggccguuaggccgaaaguuguag

SEQ ID NO: 10698 - RNA, 38 nt, Artificial Sequence
  Description of Artificial Sequence:  Enzymatic Nucleic Acid
aggaguaccugaugaggccguuaggccgaaacaccacg

SEQ ID NO: 10699 - RNA, 38 nt, Artificial Sequence
  Description of Artificial Sequence:  Enzymatic Nucleic Acid
gggaggagcugaugaggccguuaggccgaaacaacacc

SEQ ID NO: 10700 - RNA, 38 nt, Artificial Sequence
  Description of Artificial Sequence:  Enzymatic Nucleic Acid
gcggggagcugaugaggccguuaggccgaaaguacaac

SEQ ID NO: 10701 - RNA, 38 nt, Artificial Sequence
  Description of Artificial Sequence:  Enzymatic Nucleic Acid
cgggcgggcugaugaggccguuaggccgaaaggaguac

SEQ ID NO: 10702 - RNA, 38 nt, Artificial Sequence
  Description of Artificial Sequence:  Enzymatic Nucleic Acid
agaagcuucugaugaggccguuaggccgaaaggcgggc

SEQ ID NO: 10703 - RNA, 38 nt, Artificial Sequence
  Description of Artificial Sequence:  Enzymatic Nucleic Acid
cuggugagcugaugaggccguuaggccgaaagcuuuag

SEQ ID NO: 10704 - RNA, 38 nt, Artificial Sequence
  Description of Artificial Sequence:  Enzymatic Nucleic Acid
gcuggugacugaugaggccguuaggccgaaaagcuuua

SEQ ID NO: 10705 - RNA, 38 nt, Artificial Sequence
  Description of Artificial Sequence:  Enzymatic Nucleic Acid
gggcuggucugaugaggccguuaggccgaaagaagcuu

SEQ ID NO: 10706 - RNA, 38 nt, Artificial Sequence
  Description of Artificial Sequence:  Enzymatic Nucleic Acid
auguauaacugaugaggccguuaggccgaaacugucag

SEQ ID NO: 10707 - RNA, 38 nt, Artificial Sequence
  Description of Artificial Sequence:  Enzymatic Nucleic Acid
agauguaucugaugaggccguuaggccgaaauacuguc

SEQ ID NO: 10708 - RNA, 38 nt, Artificial Sequence
  Description of Artificial Sequence:  Enzymatic Nucleic Acid
uagauguacugaugaggccguuaggccgaaaauacugu

SEQ ID NO: 10709 - RNA, 38 nt, Artificial Sequence
  Description of Artificial Sequence:  Enzymatic Nucleic Acid
cauagaugcugaugaggccguuaggccgaaauaauacu

SEQ ID NO: 10710 - RNA, 38 nt, Artificial Sequence
  Description of Artificial Sequence:  Enzymatic Nucleic Acid
aacucauacugaugaggccguuaggccgaaauguauaa

SEQ ID NO: 10711 - RNA, 38 nt, Artificial Sequence
  Description of Artificial Sequence:  Enzymatic Nucleic Acid
uaaacucacugaugaggccguuaggccgaaagauguau

SEQ ID NO: 10712 - RNA, 38 nt, Artificial Sequence
  Description of Artificial Sequence:  Enzymatic Nucleic Acid
uagguguacugaugaggccguuaggccgaaacucauag

SEQ ID NO: 10713 - RNA, 38 nt, Artificial Sequence
  Description of Artificial Sequence:  Enzymatic Nucleic Acid
auaggugucugaugaggccguuaggccgaaaacucaua

SEQ ID NO: 10714 - RNA, 38 nt, Artificial Sequence
  Description of Artificial Sequence:  Enzymatic Nucleic Acid
aauaggugcugaugaggccguuaggccgaaaaacucau

SEQ ID NO: 10715 - RNA, 38 nt, Artificial Sequence
  Description of Artificial Sequence:  Enzymatic Nucleic Acid
gagcggaacugaugaggccguuaggccgaaagguguaa

SEQ ID NO: 10716 - RNA, 38 nt, Artificial Sequence
  Description of Artificial Sequence:  Enzymatic Nucleic Acid
uggagcggcugaugaggccguuaggccgaaauaggugu

SEQ ID NO: 10717 - RNA, 38 nt, Artificial Sequence
  Description of Artificial Sequence:  Enzymatic Nucleic Acid
guggagcgcugaugaggccguuaggccgaaaauaggug

SEQ ID NO: 10718 - RNA, 38 nt, Artificial Sequence
  Description of Artificial Sequence:  Enzymatic Nucleic Acid
cuccugugcugaugaggccguuaggccgaaagcggaau

SEQ ID NO: 10719 - RNA, 38 nt, Artificial Sequence
  Description of Artificial Sequence:  Enzymatic Nucleic Acid
gucacgaacugaugaggccguuaggccgaaagcagcug

SEQ ID NO: 10720 - RNA, 38 nt, Artificial Sequence
  Description of Artificial Sequence:  Enzymatic Nucleic Acid
ggucacgacugaugaggccguuaggccgaaaagcagcu

SEQ ID NO: 10721 - RNA, 38 nt, Artificial Sequence
  Description of Artificial Sequence:  Enzymatic Nucleic Acid
aggucacgcugaugaggccguuaggccgaaaaagcagc

SEQ ID NO: 10722 - RNA, 38 nt, Artificial Sequence
  Description of Artificial Sequence:  Enzymatic Nucleic Acid
aaggucaccugaugaggccguuaggccgaaaaaagcag

SEQ ID NO: 10723 - RNA, 38 nt, Artificial Sequence
  Description of Artificial Sequence:  Enzymatic Nucleic Acid
cacgauuacugaugaggccguuaggccgaaaggucacg

SEQ ID NO: 10724 - RNA, 38 nt, Artificial Sequence
  Description of Artificial Sequence:  Enzymatic Nucleic Acid
gcacgauucugaugaggccguuaggccgaaaaggucac

SEQ ID NO: 10725 - RNA, 38 nt, Artificial Sequence
  Description of Artificial Sequence:  Enzymatic Nucleic Acid
agcacgaucugaugaggccguuaggccgaaaaagguca

SEQ ID NO: 10726 - RNA, 38 nt, Artificial Sequence
  Description of Artificial Sequence:  Enzymatic Nucleic Acid
aaaagcaccugaugaggccguuaggccgaaauuaaagg

SEQ ID NO: 10727 - RNA, 38 nt, Artificial Sequence
  Description of Artificial Sequence:  Enzymatic Nucleic Acid
aaacaaaacugaugaggccguuaggccgaaagcacgau

SEQ ID NO: 10728 - RNA, 38 nt, Artificial Sequence
  Description of Artificial Sequence:  Enzymatic Nucleic Acid
aaaacaaacugaugaggccguuaggccgaaaagcacga

SEQ ID NO: 10729 - RNA, 38 nt, Artificial Sequence
  Description of Artificial Sequence:  Enzymatic Nucleic Acid
aaaaacaacugaugaggccguuaggccgaaaaagcacg

SEQ ID NO: 10730 - RNA, 38 nt, Artificial Sequence
  Description of Artificial Sequence:  Enzymatic Nucleic Acid
aaaaaacacugaugaggccguuaggccgaaaaaagcac

SEQ ID NO: 10731 - RNA, 38 nt, Artificial Sequence
  Description of Artificial Sequence:  Enzymatic Nucleic Acid
caaaaaaccugaugaggccguuaggccgaaaaaaagca

SEQ ID NO: 10732 - RNA, 38 nt, Artificial Sequence
  Description of Artificial Sequence:  Enzymatic Nucleic Acid
aaacaaaacugaugaggccguuaggccgaaacaaaaaa

SEQ ID NO: 10733 - RNA, 38 nt, Artificial Sequence
  Description of Artificial Sequence:  Enzymatic Nucleic Acid
aaaacaaacugaugaggccguuaggccgaaaacaaaaa

SEQ ID NO: 10734 - RNA, 38 nt, Artificial Sequence
  Description of Artificial Sequence:  Enzymatic Nucleic Acid
caaaacaacugaugaggccguuaggccgaaaaacaaaa

SEQ ID NO: 10735 - RNA, 38 nt, Artificial Sequence
  Description of Artificial Sequence:  Enzymatic Nucleic Acid
acaaaacacugaugaggccguuaggccgaaaaaacaaa

SEQ ID NO: 10736 - RNA, 38 nt, Artificial Sequence
  Description of Artificial Sequence:  Enzymatic Nucleic Acid
aacaaaaccugaugaggccguuaggccgaaaaaaacaa

SEQ ID NO: 10737 - RNA, 38 nt, Artificial Sequence
  Description of Artificial Sequence:  Enzymatic Nucleic Acid
acaaacaacugaugaggccguuaggccgaaacaaaaaa

SEQ ID NO: 10738 - RNA, 38 nt, Artificial Sequence
  Description of Artificial Sequence:  Enzymatic Nucleic Acid
aacaaacacugaugaggccguuaggccgaaaacaaaaa

SEQ ID NO: 10739 - RNA, 38 nt, Artificial Sequence
  Description of Artificial Sequence:  Enzymatic Nucleic Acid
caacaaaccugaugaggccguuaggccgaaaaacaaaa

SEQ ID NO: 10740 - RNA, 38 nt, Artificial Sequence
  Description of Artificial Sequence:  Enzymatic Nucleic Acid
caacaacacugaugaggccguuaggccgaaacaaaaca

SEQ ID NO: 10741 - RNA, 38 nt, Artificial Sequence
  Description of Artificial Sequence:  Enzymatic Nucleic Acid
gcaacaaccugaugaggccguuaggccgaaaacaaaac

SEQ ID NO: 10742 - RNA, 38 nt, Artificial Sequence
  Description of Artificial Sequence:  Enzymatic Nucleic Acid
acagcaaccugaugaggccguuaggccgaaacaaacaa

SEQ ID NO: 10743 - RNA, 38 nt, Artificial Sequence
  Description of Artificial Sequence:  Enzymatic Nucleic Acid
aaaacagccugaugaggccguuaggccgaaacaacaaa

SEQ ID NO: 10744 - RNA, 38 nt, Artificial Sequence
  Description of Artificial Sequence:  Enzymatic Nucleic Acid
uuagucaacugaugaggccguuaggccgaaacagcaac

SEQ ID NO: 10745 - RNA, 38 nt, Artificial Sequence
  Description of Artificial Sequence:  Enzymatic Nucleic Acid
guuagucacugaugaggccguuaggccgaaaacagcaa

SEQ ID NO: 10746 - RNA, 38 nt, Artificial Sequence
  Description of Artificial Sequence:  Enzymatic Nucleic Acid
uguuaguccugaugaggccguuaggccgaaaaacagca

SEQ ID NO: 10747 - RNA, 38 nt, Artificial Sequence
  Description of Artificial Sequence:  Enzymatic Nucleic Acid
acuggggucugaugaggccguuaggccgaaacauucuu

SEQ ID NO: 10748 - RNA, 38 nt, Artificial Sequence
  Description of Artificial Sequence:  Enzymatic Nucleic Acid
acgucacucugaugaggccguuaggccgaaacuggggu

SEQ ID NO: 10749 - RNA, 38 nt, Artificial Sequence
  Description of Artificial Sequence:  Enzymatic Nucleic Acid
cacgucaccugaugaggccguuaggccgaaaacugggg

SEQ ID NO: 10750 - RNA, 38 nt, Artificial Sequence
  Description of Artificial Sequence:  Enzymatic Nucleic Acid
aacaauagcugaugaggccguuaggccgaaauucuuca

SEQ ID NO: 10751 - RNA, 38 nt, Artificial Sequence
  Description of Artificial Sequence:  Enzymatic Nucleic Acid
ucuaacaacugaugaggccguuaggccgaaaguauucu

SEQ ID NO: 10752 - RNA, 38 nt, Artificial Sequence
  Description of Artificial Sequence:  Enzymatic Nucleic Acid
ucucuaaccugaugaggccguuaggccgaaauaguauu

SEQ ID NO: 10753 - RNA, 38 nt, Artificial Sequence
  Description of Artificial Sequence:  Enzymatic Nucleic Acid
auuucucucugaugaggccguuaggccgaaacaauagu

SEQ ID NO: 10754 - RNA, 38 nt, Artificial Sequence
  Description of Artificial Sequence:  Enzymatic Nucleic Acid
gauuucuccugaugaggccguuaggccgaaaacaauag

SEQ ID NO: 10755 - RNA, 38 nt, Artificial Sequence
  Description of Artificial Sequence:  Enzymatic Nucleic Acid
gcggggggcugaugaggccguuaggccgaaauuucucu

SEQ ID NO: 10756 - RNA, 38 nt, Artificial Sequence
  Description of Artificial Sequence:  Enzymatic Nucleic Acid
guuacccucugaugaggccguuaggccgaaaggcuuug

SEQ ID NO: 10757 - RNA, 38 nt, Artificial Sequence
  Description of Artificial Sequence:  Enzymatic Nucleic Acid
guccaggucugaugaggccguuaggccgaaacccugag

SEQ ID NO: 10758 - RNA, 38 nt, Artificial Sequence
  Description of Artificial Sequence:  Enzymatic Nucleic Acid
ggucgccacugaugaggccguuaggccgaaaggcaccu

SEQ ID NO: 10759 - RNA, 38 nt, Artificial Sequence
  Description of Artificial Sequence:  Enzymatic Nucleic Acid
gcugcaggcugaugaggccguuaggccgaaaggguggg

SEQ ID NO: 10760 - RNA, 38 nt, Artificial Sequence
  Description of Artificial Sequence:  Enzymatic Nucleic Acid
acugccuccugaugaggccguuaggccgaaagucccac

SEQ ID NO: 10761 - RNA, 38 nt, Artificial Sequence
  Description of Artificial Sequence:  Enzymatic Nucleic Acid
aaugggcucugaugaggccguuaggccgaaacugccuc

SEQ ID NO: 10762 - RNA, 38 nt, Artificial Sequence
  Description of Artificial Sequence:  Enzymatic Nucleic Acid
caugagcucugaugaggccguuaggccgaaaugggcuu

SEQ ID NO: 10763 - RNA, 38 nt, Artificial Sequence
  Description of Artificial Sequence:  Enzymatic Nucleic Acid
ccaugagccugaugaggccguuaggccgaaaaugggcu

SEQ ID NO: 10764 - RNA, 38 nt, Artificial Sequence
  Description of Artificial Sequence:  Enzymatic Nucleic Acid
gcagccaucugaugaggccguuaggccgaaagcuaaug

SEQ ID NO: 10765 - RNA, 38 nt, Artificial Sequence
  Description of Artificial Sequence:  Enzymatic Nucleic Acid
gagagacacugaugaggccguuaggccgaaagcagguc

SEQ ID NO: 10766 - RNA, 38 nt, Artificial Sequence
  Description of Artificial Sequence:  Enzymatic Nucleic Acid
auaagagacugaugaggccguuaggccgaaacagagca

SEQ ID NO: 10767 - RNA, 38 nt, Artificial Sequence
  Description of Artificial Sequence:  Enzymatic Nucleic Acid
ccauaagacugaugaggccguuaggccgaaagacagag

SEQ ID NO: 10768 - RNA, 38 nt, Artificial Sequence
  Description of Artificial Sequence:  Enzymatic Nucleic Acid
cuccauaacugaugaggccguuaggccgaaagagacag

SEQ ID NO: 10769 - RNA, 38 nt, Artificial Sequence
  Description of Artificial Sequence:  Enzymatic Nucleic Acid
uccuccaucugaugaggccguuaggccgaaagagagac

SEQ ID NO: 10770 - RNA, 38 nt, Artificial Sequence
  Description of Artificial Sequence:  Enzymatic Nucleic Acid
uuccuccacugaugaggccguuaggccgaaaagagaga

SEQ ID NO: 10771 - RNA, 38 nt, Artificial Sequence
  Description of Artificial Sequence:  Enzymatic Nucleic Acid
gcaucccacugaugaggccguuaggccgaaagccuuuu

SEQ ID NO: 10772 - RNA, 38 nt, Artificial Sequence
  Description of Artificial Sequence:  Enzymatic Nucleic Acid
cgcauccccugaugaggccguuaggccgaaaagccuuu

SEQ ID NO: 10773 - RNA, 38 nt, Artificial Sequence
  Description of Artificial Sequence:  Enzymatic Nucleic Acid
acaggacgcugaugaggccguuaggccgaaacgcaucc

SEQ ID NO: 10774 - RNA, 38 nt, Artificial Sequence
  Description of Artificial Sequence:  Enzymatic Nucleic Acid
cuccacagcugaugaggccguuaggccgaaacggacgc

SEQ ID NO: 10775 - RNA, 38 nt, Artificial Sequence
  Description of Artificial Sequence:  Enzymatic Nucleic Acid
gcauagcgcugaugaggccguuaggccgaaagcccccu

SEQ ID NO: 10776 - RNA, 38 nt, Artificial Sequence
  Description of Artificial Sequence:  Enzymatic Nucleic Acid
aaguggcacugaugaggccguuaggccgaaagcggagc

SEQ ID NO: 10777 - RNA, 38 nt, Artificial Sequence
  Description of Artificial Sequence:  Enzymatic Nucleic Acid
agucacugcugaugaggccguuaggccgaaaguggcau

SEQ ID NO: 10778 - RNA, 38 nt, Artificial Sequence
  Description of Artificial Sequence:  Enzymatic Nucleic Acid
aagucacucugaugaggccguuaggccgaaaaguggca

SEQ ID NO: 10779 - RNA, 38 nt, Artificial Sequence
  Description of Artificial Sequence:  Enzymatic Nucleic Acid
ggagugagcugaugaggccguuaggccgaaagucacug

SEQ ID NO: 10780 - RNA, 38 nt, Artificial Sequence
  Description of Artificial Sequence:  Enzymatic Nucleic Acid
aggagugacugaugaggccguuaggccgaaaagucacu

SEQ ID NO: 10781 - RNA, 38 nt, Artificial Sequence
  Description of Artificial Sequence:  Enzymatic Nucleic Acid
ccaggagucugaugaggccguuaggccgaaagaaguca

SEQ ID NO: 10782 - RNA, 38 nt, Artificial Sequence
  Description of Artificial Sequence:  Enzymatic Nucleic Acid
gaggccagcugaugaggccguuaggccgaaagugagaa

SEQ ID NO: 10783 - RNA, 38 nt, Artificial Sequence
  Description of Artificial Sequence:  Enzymatic Nucleic Acid
aaacagcgcugaugaggccguuaggccgaaaggccagg

SEQ ID NO: 10784 - RNA, 38 nt, Artificial Sequence
  Description of Artificial Sequence:  Enzymatic Nucleic Acid
gggcccgacugaugaggccguuaggccgaaacagcgga

SEQ ID NO: 10785 - RNA, 38 nt, Artificial Sequence
  Description of Artificial Sequence:  Enzymatic Nucleic Acid
ggggcccgcugaugaggccguuaggccgaaaacagcgg

SEQ ID NO: 10786 - RNA, 38 nt, Artificial Sequence
  Description of Artificial Sequence:  Enzymatic Nucleic Acid
gggggccccugaugaggccguuaggccgaaaaacagcg

SEQ ID NO: 10787 - RNA, 38 nt, Artificial Sequence
  Description of Artificial Sequence:  Enzymatic Nucleic Acid
ccucuuggcugaugaggccguuaggccgaaagggggcc

SEQ ID NO: 10788 - RNA, 38 nt, Artificial Sequence
  Description of Artificial Sequence:  Enzymatic Nucleic Acid
accucuugcugaugaggccguuaggccgaaaagggggc

SEQ ID NO: 10789 - RNA, 38 nt, Artificial Sequence
  Description of Artificial Sequence:  Enzymatic Nucleic Acid
ugcucugacugaugaggccguuaggccgaaaccucuug

SEQ ID NO: 10790 - RNA, 38 nt, Artificial Sequence
  Description of Artificial Sequence:  Enzymatic Nucleic Acid
ucugcucucugaugaggccguuaggccgaaauaccucu

SEQ ID NO: 10791 - RNA, 38 nt, Artificial Sequence
  Description of Artificial Sequence:  Enzymatic Nucleic Acid
gucuaggacugaugaggccguuaggccgaaacgucccu

SEQ ID NO: 10792 - RNA, 38 nt, Artificial Sequence
  Description of Artificial Sequence:  Enzymatic Nucleic Acid
ggucuaggcugaugaggccguuaggccgaaaacguccc

SEQ ID NO: 10793 - RNA, 38 nt, Artificial Sequence
  Description of Artificial Sequence:  Enzymatic Nucleic Acid
uggucuagcugaugaggccguuaggccgaaaaacgucc

SEQ ID NO: 10794 - RNA, 38 nt, Artificial Sequence
  Description of Artificial Sequence:  Enzymatic Nucleic Acid
cccugguccugaugaggccguuaggccgaaaggaaacg

SEQ ID NO: 10795 - RNA, 38 nt, Artificial Sequence
  Description of Artificial Sequence:  Enzymatic Nucleic Acid
uucccgagcugaugaggccguuaggccgaaacaugugc

SEQ ID NO: 10796 - RNA, 38 nt, Artificial Sequence
  Description of Artificial Sequence:  Enzymatic Nucleic Acid
guucccgacugaugaggccguuaggccgaaaacaugug

SEQ ID NO: 10797 - RNA, 38 nt, Artificial Sequence
  Description of Artificial Sequence:  Enzymatic Nucleic Acid
ugguuccccugaugaggccguuaggccgaaagaacaug

SEQ ID NO: 10798 - RNA, 38 nt, Artificial Sequence
  Description of Artificial Sequence:  Enzymatic Nucleic Acid
uuaagauucugaugaggccguuaggccgaaacuguggu

SEQ ID NO: 10799 - RNA, 38 nt, Artificial Sequence
  Description of Artificial Sequence:  Enzymatic Nucleic Acid
uuuaagaucugaugaggccguuaggccgaaaacugugg

SEQ ID NO: 10800 - RNA, 38 nt, Artificial Sequence
  Description of Artificial Sequence:  Enzymatic Nucleic Acid
agauuuaacugaugaggccguuaggccgaaauuaacug

SEQ ID NO: 10801 - RNA, 38 nt, Artificial Sequence
  Description of Artificial Sequence:  Enzymatic Nucleic Acid
aaagauuucugaugaggccguuaggccgaaagauuaac

SEQ ID NO: 10802 - RNA, 38 nt, Artificial Sequence
  Description of Artificial Sequence:  Enzymatic Nucleic Acid
aaaagauucugaugaggccguuaggccgaaaagauuaa

SEQ ID NO: 10803 - RNA, 38 nt, Artificial Sequence
  Description of Artificial Sequence:  Enzymatic Nucleic Acid
cgggaaaacugaugaggccguuaggccgaaauuuaaga

SEQ ID NO: 10804 - RNA, 38 nt, Artificial Sequence
  Description of Artificial Sequence:  Enzymatic Nucleic Acid
cccgggaacugaugaggccguuaggccgaaagauuuaa

SEQ ID NO: 10805 - RNA, 38 nt, Artificial Sequence
  Description of Artificial Sequence:  Enzymatic Nucleic Acid
ucccgggacugaugaggccguuaggccgaaaagauuua

SEQ ID NO: 10806 - RNA, 38 nt, Artificial Sequence
  Description of Artificial Sequence:  Enzymatic Nucleic Acid
cucccgggcugaugaggccguuaggccgaaaaagauuu

SEQ ID NO: 10807 - RNA, 38 nt, Artificial Sequence
  Description of Artificial Sequence:  Enzymatic Nucleic Acid
acucccggcugaugaggccguuaggccgaaaaaagauu

SEQ ID NO: 10808 - RNA, 38 nt, Artificial Sequence
  Description of Artificial Sequence:  Enzymatic Nucleic Acid
caacagaacugaugaggccguuaggccgaaacucccgg

SEQ ID NO: 10809 - RNA, 38 nt, Artificial Sequence
  Description of Artificial Sequence:  Enzymatic Nucleic Acid
gacaacagcugaugaggccguuaggccgaaagacuccc

SEQ ID NO: 10810 - RNA, 38 nt, Artificial Sequence
  Description of Artificial Sequence:  Enzymatic Nucleic Acid
agacaacacugaugaggccguuaggccgaaaagacucc

SEQ ID NO: 10811 - RNA, 38 nt, Artificial Sequence
  Description of Artificial Sequence:  Enzymatic Nucleic Acid
aaacagaccugaugaggccguuaggccgaaacagaaga

SEQ ID NO: 10812 - RNA, 38 nt, Artificial Sequence
  Description of Artificial Sequence:  Enzymatic Nucleic Acid
gguaaacacugaugaggccguuaggccgaaacaacaga

SEQ ID NO: 10813 - RNA, 38 nt, Artificial Sequence
  Description of Artificial Sequence:  Enzymatic Nucleic Acid
ggaugguacugaugaggccguuaggccgaaacagacaa

SEQ ID NO: 10814 - RNA, 38 nt, Artificial Sequence
  Description of Artificial Sequence:  Enzymatic Nucleic Acid
uggauggucugaugaggccguuaggccgaaaacagaca

SEQ ID NO: 10815 - RNA, 38 nt, Artificial Sequence
  Description of Artificial Sequence:  Enzymatic Nucleic Acid
uuggauggcugaugaggccguuaggccgaaaaacagac

SEQ ID NO: 10816 - RNA, 38 nt, Artificial Sequence
  Description of Artificial Sequence:  Enzymatic Nucleic Acid
augcuuugcugaugaggccguuaggccgaaaugguaaa

SEQ ID NO: 10817 - RNA, 38 nt, Artificial Sequence
  Description of Artificial Sequence:  Enzymatic Nucleic Acid
auguuaaacugaugaggccguuaggccgaaaugcuuug

SEQ ID NO: 10818 - RNA, 38 nt, Artificial Sequence
  Description of Artificial Sequence:  Enzymatic Nucleic Acid
acauguuacugaugaggccguuaggccgaaauaugcuu

SEQ ID NO: 10819 - RNA, 38 nt, Artificial Sequence
  Description of Artificial Sequence:  Enzymatic Nucleic Acid
cacauguucugaugaggccguuaggccgaaaauaugcu

SEQ ID NO: 10820 - RNA, 38 nt, Artificial Sequence
  Description of Artificial Sequence:  Enzymatic Nucleic Acid
acacaugucugaugaggccguuaggccgaaaaauaugc

SEQ ID NO: 10821 - RNA, 38 nt, Artificial Sequence
  Description of Artificial Sequence:  Enzymatic Nucleic Acid
cccccacucugaugaggccguuaggccgaaacacaugu

SEQ ID NO: 10822 - RNA, 38 nt, Artificial Sequence
  Description of Artificial Sequence:  Enzymatic Nucleic Acid
cagaagcccugaugaggccguuaggccgaaagcgccac

SEQ ID NO: 10823 - RNA, 38 nt, Artificial Sequence
  Description of Artificial Sequence:  Enzymatic Nucleic Acid
ggccucagcugaugaggccguuaggccgaaagccaagc

SEQ ID NO: 10824 - RNA, 38 nt, Artificial Sequence
  Description of Artificial Sequence:  Enzymatic Nucleic Acid
uggccucacugaugaggccguuaggccgaaaagccaag

SEQ ID NO: 10825 - RNA, 38 nt, Artificial Sequence
  Description of Artificial Sequence:  Enzymatic Nucleic Acid
gaacugaucugaugaggccguuaggccgaaauggcucu

SEQ ID NO: 10826 - RNA, 38 nt, Artificial Sequence
  Description of Artificial Sequence:  Enzymatic Nucleic Acid
gaggaacucugaugaggccguuaggccgaaaugauggc

SEQ ID NO: 10827 - RNA, 38 nt, Artificial Sequence
  Description of Artificial Sequence:  Enzymatic Nucleic Acid
acuagaggcugaugaggccguuaggccgaaacugauga

SEQ ID NO: 10828 - RNA, 38 nt, Artificial Sequence
  Description of Artificial Sequence:  Enzymatic Nucleic Acid
cacuagagcugaugaggccguuaggccgaaaacugaug

SEQ ID NO: 10829 - RNA, 38 nt, Artificial Sequence
  Description of Artificial Sequence:  Enzymatic Nucleic Acid
ucucacuacugaugaggccguuaggccgaaaggaacug

SEQ ID NO: 10830 - RNA, 38 nt, Artificial Sequence
  Description of Artificial Sequence:  Enzymatic Nucleic Acid
caucucaccugaugaggccguuaggccgaaagaggaac

SEQ ID NO: 10831 - RNA, 38 nt, Artificial Sequence
  Description of Artificial Sequence:  Enzymatic Nucleic Acid
augaccuccugaugaggccguuaggccgaaaugcaucu

SEQ ID NO: 10832 - RNA, 38 nt, Artificial Sequence
  Description of Artificial Sequence:  Enzymatic Nucleic Acid
uuggguaucugaugaggccguuaggccgaaaccucaau

SEQ ID NO: 10833 - RNA, 38 nt, Artificial Sequence
  Description of Artificial Sequence:  Enzymatic Nucleic Acid
agcuugggcugaugaggccguuaggccgaaaugaccuc

SEQ ID NO: 10834 - RNA, 38 nt, Artificial Sequence
  Description of Artificial Sequence:  Enzymatic Nucleic Acid
aggccugccugaugaggccguuaggccgaaagcuuggg

SEQ ID NO: 10835 - RNA, 38 nt, Artificial Sequence
  Description of Artificial Sequence:  Enzymatic Nucleic Acid
aguaugcgcugaugaggccguuaggccgaaaggucagg

SEQ ID NO: 10836 - RNA, 38 nt, Artificial Sequence
  Description of Artificial Sequence:  Enzymatic Nucleic Acid
caguaugccugaugaggccguuaggccgaaaaggucag

SEQ ID NO: 10837 - RNA, 38 nt, Artificial Sequence
  Description of Artificial Sequence:  Enzymatic Nucleic Acid
gugagcagcugaugaggccguuaggccgaaaugcgaag

SEQ ID NO: 10838 - RNA, 38 nt, Artificial Sequence
  Description of Artificial Sequence:  Enzymatic Nucleic Acid
cuccccgucugaugaggccguuaggccgaaagcaguau

SEQ ID NO: 10839 - RNA, 38 nt, Artificial Sequence
  Description of Artificial Sequence:  Enzymatic Nucleic Acid
gaccacuucugaugaggccguuaggccgaaacuccccg

SEQ ID NO: 10840 - RNA, 38 nt, Artificial Sequence
  Description of Artificial Sequence:  Enzymatic Nucleic Acid
ggaccacucugaugaggccguuaggccgaaaacucccc

SEQ ID NO: 10841 - RNA, 38 nt, Artificial Sequence
  Description of Artificial Sequence:  Enzymatic Nucleic Acid
ccaaacugcugaugaggccguuaggccgaaaccacuua

SEQ ID NO: 10842 - RNA, 38 nt, Artificial Sequence
  Description of Artificial Sequence:  Enzymatic Nucleic Acid
cuaggccacugaugaggccguuaggccgaaacuggacc

SEQ ID NO: 10843 - RNA, 38 nt, Artificial Sequence
  Description of Artificial Sequence:  Enzymatic Nucleic Acid
acuaggcccugaugaggccguuaggccgaaaacuggac

SEQ ID NO: 10844 - RNA, 38 nt, Artificial Sequence
  Description of Artificial Sequence:  Enzymatic Nucleic Acid
aaccuuaccugaugaggccguuaggccgaaaggccaaa

SEQ ID NO: 10845 - RNA, 38 nt, Artificial Sequence
  Description of Artificial Sequence:  Enzymatic Nucleic Acid
ggcaaccucugaugaggccguuaggccgaaacuaggcc

SEQ ID NO: 10846 - RNA, 38 nt, Artificial Sequence
  Description of Artificial Sequence:  Enzymatic Nucleic Acid
caguaggccugaugaggccguuaggccgaaaccuuacu

SEQ ID NO: 10847 - RNA, 38 nt, Artificial Sequence
  Description of Artificial Sequence:  Enzymatic Nucleic Acid
cccaucagcugaugaggccguuaggccgaaaggcaacc

SEQ ID NO: 10848 - RNA, 38 nt, Artificial Sequence
  Description of Artificial Sequence:  Enzymatic Nucleic Acid
uggcuuuucugaugaggccguuaggccgaaagcccauc

SEQ ID NO: 10849 - RNA, 38 nt, Artificial Sequence
  Description of Artificial Sequence:  Enzymatic Nucleic Acid
cuguuuaacugaugaggccguuaggccgaaauguggcu

SEQ ID NO: 10850 - RNA, 38 nt, Artificial Sequence
  Description of Artificial Sequence:  Enzymatic Nucleic Acid
ccuguuuacugaugaggccguuaggccgaaaauguggc

SEQ ID NO: 10851 - RNA, 38 nt, Artificial Sequence
  Description of Artificial Sequence:  Enzymatic Nucleic Acid
accuguuucugaugaggccguuaggccgaaaaaugugg

SEQ ID NO: 10852 - RNA, 38 nt, Artificial Sequence
  Description of Artificial Sequence:  Enzymatic Nucleic Acid
aaccuguucugaugaggccguuaggccgaaaaaaugug

SEQ ID NO: 10853 - RNA, 38 nt, Artificial Sequence
  Description of Artificial Sequence:  Enzymatic Nucleic Acid
ugagauaacugaugaggccguuaggccgaaaccuguuu

SEQ ID NO: 10854 - RNA, 38 nt, Artificial Sequence
  Description of Artificial Sequence:  Enzymatic Nucleic Acid
uugagauacugaugaggccguuaggccgaaaaccuguu

SEQ ID NO: 10855 - RNA, 38 nt, Artificial Sequence
  Description of Artificial Sequence:  Enzymatic Nucleic Acid
cuugagaucugaugaggccguuaggccgaaaaaccugu

SEQ ID NO: 10856 - RNA, 38 nt, Artificial Sequence
  Description of Artificial Sequence:  Enzymatic Nucleic Acid
acuugagacugaugaggccguuaggccgaaaaaaccug

SEQ ID NO: 10857 - RNA, 38 nt, Artificial Sequence
  Description of Artificial Sequence:  Enzymatic Nucleic Acid
auacuugacugaugaggccguuaggccgaaauaaaacc

SEQ ID NO: 10858 - RNA, 38 nt, Artificial Sequence
  Description of Artificial Sequence:  Enzymatic Nucleic Acid
uaauacuucugaugaggccguuaggccgaaagauaaaa

SEQ ID NO: 10859 - RNA, 38 nt, Artificial Sequence
  Description of Artificial Sequence:  Enzymatic Nucleic Acid
uauauuaacugaugaggccguuaggccgaaacuugaga

SEQ ID NO: 10860 - RNA, 38 nt, Artificial Sequence
  Description of Artificial Sequence:  Enzymatic Nucleic Acid
uauauauucugaugaggccguuaggccgaaauacuuga

SEQ ID NO: 10861 - RNA, 38 nt, Artificial Sequence
  Description of Artificial Sequence:  Enzymatic Nucleic Acid
cuauauaucugaugaggccguuaggccgaaaauacuug

SEQ ID NO: 10862 - RNA, 38 nt, Artificial Sequence
  Description of Artificial Sequence:  Enzymatic Nucleic Acid
ugucuauacugaugaggccguuaggccgaaauuaauac

SEQ ID NO: 10863 - RNA, 38 nt, Artificial Sequence
  Description of Artificial Sequence:  Enzymatic Nucleic Acid
cuugucuacugaugaggccguuaggccgaaauauuaau

SEQ ID NO: 10864 - RNA, 38 nt, Artificial Sequence
  Description of Artificial Sequence:  Enzymatic Nucleic Acid
gucuuguccugaugaggccguuaggccgaaauauauua

SEQ ID NO: 10865 - RNA, 38 nt, Artificial Sequence
  Description of Artificial Sequence:  Enzymatic Nucleic Acid
uaaugcaucugaugaggccguuaggccgaaagugucuu

SEQ ID NO: 10866 - RNA, 38 nt, Artificial Sequence
  Description of Artificial Sequence:  Enzymatic Nucleic Acid
auaaugcacugaugaggccguuaggccgaaaagugucu

SEQ ID NO: 10867 - RNA, 38 nt, Artificial Sequence
  Description of Artificial Sequence:  Enzymatic Nucleic Acid
aacaggaucugaugaggccguuaggccgaaaugcauaa

SEQ ID NO: 10868 - RNA, 38 nt, Artificial Sequence
  Description of Artificial Sequence:  Enzymatic Nucleic Acid
aaacaggacugaugaggccguuaggccgaaaaugcaua

SEQ ID NO: 10869 - RNA, 38 nt, Artificial Sequence
  Description of Artificial Sequence:  Enzymatic Nucleic Acid
uaaaacagcugaugaggccguuaggccgaaauaaugca

SEQ ID NO: 10870 - RNA, 38 nt, Artificial Sequence
  Description of Artificial Sequence:  Enzymatic Nucleic Acid
auauauaacugaugaggccguuaggccgaaacaggaua

SEQ ID NO: 10871 - RNA, 38 nt, Artificial Sequence
  Description of Artificial Sequence:  Enzymatic Nucleic Acid
gauauauacugaugaggccguuaggccgaaaacaggau

SEQ ID NO: 10872 - RNA, 38 nt, Artificial Sequence
  Description of Artificial Sequence:  Enzymatic Nucleic Acid
ggauauaucugaugaggccguuaggccgaaaaacagga

SEQ ID NO: 10873 - RNA, 38 nt, Artificial Sequence
  Description of Artificial Sequence:  Enzymatic Nucleic Acid
uggauauacugaugaggccguuaggccgaaaaaacagg

SEQ ID NO: 10874 - RNA, 38 nt, Artificial Sequence
  Description of Artificial Sequence:  Enzymatic Nucleic Acid
auuggauacugaugaggccguuaggccgaaauaaaaca

SEQ ID NO: 10875 - RNA, 38 nt, Artificial Sequence
  Description of Artificial Sequence:  Enzymatic Nucleic Acid
ucauuggacugaugaggccguuaggccgaaauauaaaa

SEQ ID NO: 10876 - RNA, 38 nt, Artificial Sequence
  Description of Artificial Sequence:  Enzymatic Nucleic Acid
auucauugcugaugaggccguuaggccgaaauauauaa

SEQ ID NO: 10877 - RNA, 38 nt, Artificial Sequence
  Description of Artificial Sequence:  Enzymatic Nucleic Acid
cccaguuacugaugaggccguuaggccgaaauucauug

SEQ ID NO: 10878 - RNA, 38 nt, Artificial Sequence
  Description of Artificial Sequence:  Enzymatic Nucleic Acid
gccccagucugaugaggccguuaggccgaaauauucau

SEQ ID NO: 10879 - RNA, 38 nt, Artificial Sequence
  Description of Artificial Sequence:  Enzymatic Nucleic Acid
ugacucuucugaugaggccguuaggccgaaacucgccc

SEQ ID NO: 10880 - RNA, 38 nt, Artificial Sequence
  Description of Artificial Sequence:  Enzymatic Nucleic Acid
augacucucugaugaggccguuaggccgaaaacucgcc

SEQ ID NO: 10881 - RNA, 38 nt, Artificial Sequence
  Description of Artificial Sequence:  Enzymatic Nucleic Acid
uagaccaucugaugaggccguuaggccgaaacucuuaa

SEQ ID NO: 10882 - RNA, 38 nt, Artificial Sequence
  Description of Artificial Sequence:  Enzymatic Nucleic Acid
cuuuucuacugaugaggccguuaggccgaaaccaugac

SEQ ID NO: 10883 - RNA, 38 nt, Artificial Sequence
  Description of Artificial Sequence:  Enzymatic Nucleic Acid
cccuuuuccugaugaggccguuaggccgaaagaccaug

SEQ ID NO: 10884 - RNA, 38 nt, Artificial Sequence
  Description of Artificial Sequence:  Enzymatic Nucleic Acid
uacagagacugaugaggccguuaggccgaaaccccuuu

SEQ ID NO: 10885 - RNA, 38 nt, Artificial Sequence
  Description of Artificial Sequence:  Enzymatic Nucleic Acid
guacagagcugaugaggccguuaggccgaaaaccccuu

SEQ ID NO: 10886 - RNA, 38 nt, Artificial Sequence
  Description of Artificial Sequence:  Enzymatic Nucleic Acid
gguacagacugaugaggccguuaggccgaaaaaccccu

SEQ ID NO: 10887 - RNA, 38 nt, Artificial Sequence
  Description of Artificial Sequence:  Enzymatic Nucleic Acid
uggguacacugaugaggccguuaggccgaaagaaaccc

SEQ ID NO: 10888 - RNA, 38 nt, Artificial Sequence
  Description of Artificial Sequence:  Enzymatic Nucleic Acid
gauuugggcugaugaggccguuaggccgaaacagagaa

SEQ ID NO: 10889 - RNA, 38 nt, Artificial Sequence
  Description of Artificial Sequence:  Enzymatic Nucleic Acid
accagccccugaugaggccguuaggccgaaauuugggu

SEQ ID NO: 10890 - RNA, 38 nt, Artificial Sequence
  Description of Artificial Sequence:  Enzymatic Nucleic Acid
cuuggucccugaugaggccguuaggccgaaaccagccc

SEQ ID NO: 10891 - RNA, 38 nt, Artificial Sequence
  Description of Artificial Sequence:  Enzymatic Nucleic Acid
gcugggaccugaugaggccguuaggccgaaaccacucu

SEQ ID NO: 10892 - RNA, 38 nt, Artificial Sequence
  Description of Artificial Sequence:  Enzymatic Nucleic Acid
auagcuggcugaugaggccguuaggccgaaacaaccac

SEQ ID NO: 10893 - RNA, 38 nt, Artificial Sequence
  Description of Artificial Sequence:  Enzymatic Nucleic Acid
aguaacuacugaugaggccguuaggccgaaagcuggga

SEQ ID NO: 10894 - RNA, 38 nt, Artificial Sequence
  Description of Artificial Sequence:  Enzymatic Nucleic Acid
uuaguaaccugaugaggccguuaggccgaaauagcugg

SEQ ID NO: 10895 - RNA, 38 nt, Artificial Sequence
  Description of Artificial Sequence:  Enzymatic Nucleic Acid
aguuuagucugaugaggccguuaggccgaaacuauagc

SEQ ID NO: 10896 - RNA, 38 nt, Artificial Sequence
  Description of Artificial Sequence:  Enzymatic Nucleic Acid
uaguuuagcugaugaggccguuaggccgaaaacuauag

SEQ ID NO: 10897 - RNA, 38 nt, Artificial Sequence
  Description of Artificial Sequence:  Enzymatic Nucleic Acid
gaguaguucugaugaggccguuaggccgaaaguaacua

SEQ ID NO: 10898 - RNA, 38 nt, Artificial Sequence
  Description of Artificial Sequence:  Enzymatic Nucleic Acid
ugggugagcugaugaggccguuaggccgaaaguuuagu

SEQ ID NO: 10899 - RNA, 38 nt, Artificial Sequence
  Description of Artificial Sequence:  Enzymatic Nucleic Acid
cuuugggucugaugaggccguuaggccgaaaguaguuu

SEQ ID NO: 10900 - RNA, 38 nt, Artificial Sequence
  Description of Artificial Sequence:  Enzymatic Nucleic Acid
gagguccccugaugaggccguuaggccgaaacuuuggg

SEQ ID NO: 10901 - RNA, 38 nt, Artificial Sequence
  Description of Artificial Sequence:  Enzymatic Nucleic Acid
aagccagucugaugaggccguuaggccgaaagguccca

SEQ ID NO: 10902 - RNA, 38 nt, Artificial Sequence
  Description of Artificial Sequence:  Enzymatic Nucleic Acid
guaaagagcugaugaggccguuaggccgaaagccagug

SEQ ID NO: 10903 - RNA, 38 nt, Artificial Sequence
  Description of Artificial Sequence:  Enzymatic Nucleic Acid
aguaaagacugaugaggccguuaggccgaaaagccagu

SEQ ID NO: 10904 - RNA, 38 nt, Artificial Sequence
  Description of Artificial Sequence:  Enzymatic Nucleic Acid
gaaguaaacugaugaggccguuaggccgaaagaagcca

SEQ ID NO: 10905 - RNA, 38 nt, Artificial Sequence
  Description of Artificial Sequence:  Enzymatic Nucleic Acid
augaaguacugaugaggccguuaggccgaaagagaagc

SEQ ID NO: 10906 - RNA, 38 nt, Artificial Sequence
  Description of Artificial Sequence:  Enzymatic Nucleic Acid
gaugaagucugaugaggccguuaggccgaaaagagaag

SEQ ID NO: 10907 - RNA, 38 nt, Artificial Sequence
  Description of Artificial Sequence:  Enzymatic Nucleic Acid
ugaugaagcugaugaggccguuaggccgaaaaagagaa

SEQ ID NO: 10908 - RNA, 38 nt, Artificial Sequence
  Description of Artificial Sequence:  Enzymatic Nucleic Acid
ccaugaugcugaugaggccguuaggccgaaaguaaaga

SEQ ID NO: 10909 - RNA, 38 nt, Artificial Sequence
  Description of Artificial Sequence:  Enzymatic Nucleic Acid
uccaugaucugaugaggccguuaggccgaaaaguaaag

SEQ ID NO: 10910 - RNA, 38 nt, Artificial Sequence
  Description of Artificial Sequence:  Enzymatic Nucleic Acid
aaauccaucugaugaggccguuaggccgaaaugaagua

SEQ ID NO: 10911 - RNA, 38 nt, Artificial Sequence
  Description of Artificial Sequence:  Enzymatic Nucleic Acid
gauggugacugaugaggccguuaggccgaaauccauga

SEQ ID NO: 10912 - RNA, 38 nt, Artificial Sequence
  Description of Artificial Sequence:  Enzymatic Nucleic Acid
ggauggugcugaugaggccguuaggccgaaaauccaug

SEQ ID NO: 10913 - RNA, 38 nt, Artificial Sequence
  Description of Artificial Sequence:  Enzymatic Nucleic Acid
gggauggucugaugaggccguuaggccgaaaaauccau

SEQ ID NO: 10914 - RNA, 38 nt, Artificial Sequence
  Description of Artificial Sequence:  Enzymatic Nucleic Acid
ugccuuggcugaugaggccguuaggccgaaauggugaa

SEQ ID NO: 10915 - RNA, 38 nt, Artificial Sequence
  Description of Artificial Sequence:  Enzymatic Nucleic Acid
uccucucacugaugaggccguuaggccgaaacugccuu

SEQ ID NO: 10916 - RNA, 38 nt, Artificial Sequence
  Description of Artificial Sequence:  Enzymatic Nucleic Acid
auacucuucugaugaggccguuaggccgaaagcuccuc

SEQ ID NO: 10917 - RNA, 38 nt, Artificial Sequence
  Description of Artificial Sequence:  Enzymatic Nucleic Acid
ugggcugacugaugaggccguuaggccgaaacucuuua

SEQ ID NO: 10918 - RNA, 38 nt, Artificial Sequence
  Description of Artificial Sequence:  Enzymatic Nucleic Acid
uaugggcucugaugaggccguuaggccgaaauacucuu

SEQ ID NO: 10919 - RNA, 38 nt, Artificial Sequence
  Description of Artificial Sequence:  Enzymatic Nucleic Acid
uuaauaaacugaugaggccguuaggccgaaaugggcug

SEQ ID NO: 10920 - RNA, 38 nt, Artificial Sequence
  Description of Artificial Sequence:  Enzymatic Nucleic Acid
gcuuaauacugaugaggccguuaggccgaaauaugggc

SEQ ID NO: 10921 - RNA, 38 nt, Artificial Sequence
  Description of Artificial Sequence:  Enzymatic Nucleic Acid
ugcuuaaucugaugaggccguuaggccgaaaauauggg

SEQ ID NO: 10922 - RNA, 38 nt, Artificial Sequence
  Description of Artificial Sequence:  Enzymatic Nucleic Acid
gugcuuaacugaugaggccguuaggccgaaaaauaugg

SEQ ID NO: 10923 - RNA, 38 nt, Artificial Sequence
  Description of Artificial Sequence:  Enzymatic Nucleic Acid
aagugcuucugaugaggccguuaggccgaaauaaauau

SEQ ID NO: 10924 - RNA, 38 nt, Artificial Sequence
  Description of Artificial Sequence:  Enzymatic Nucleic Acid
aaagugcucugaugaggccguuaggccgaaaauaaaua

SEQ ID NO: 10925 - RNA, 38 nt, Artificial Sequence
  Description of Artificial Sequence:  Enzymatic Nucleic Acid
ggagcauacugaugaggccguuaggccgaaagugcuua

SEQ ID NO: 10926 - RNA, 38 nt, Artificial Sequence
  Description of Artificial Sequence:  Enzymatic Nucleic Acid
aggagcaucugaugaggccguuaggccgaaaagugcuu

SEQ ID NO: 10927 - RNA, 38 nt, Artificial Sequence
  Description of Artificial Sequence:  Enzymatic Nucleic Acid
aaggagcacugaugaggccguuaggccgaaaaagugcu

SEQ ID NO: 10928 - RNA, 38 nt, Artificial Sequence
  Description of Artificial Sequence:  Enzymatic Nucleic Acid
gugccaagcugaugaggccguuaggccgaaagcauaaa

SEQ ID NO: 10929 - RNA, 38 nt, Artificial Sequence
  Description of Artificial Sequence:  Enzymatic Nucleic Acid
gcugugcccugaugaggccguuaggccgaaaggagcau

SEQ ID NO: 10930 - RNA, 38 nt, Artificial Sequence
  Description of Artificial Sequence:  Enzymatic Nucleic Acid
gcauaaaucugaugaggccguuaggccgaaacacauca

SEQ ID NO: 10931 - RNA, 38 nt, Artificial Sequence
  Description of Artificial Sequence:  Enzymatic Nucleic Acid
cuugcauacugaugaggccguuaggccgaaauuacaca

SEQ ID NO: 10932 - RNA, 38 nt, Artificial Sequence
  Description of Artificial Sequence:  Enzymatic Nucleic Acid
gcuugcaucugaugaggccguuaggccgaaaauuacac

SEQ ID NO: 10933 - RNA, 38 nt, Artificial Sequence
  Description of Artificial Sequence:  Enzymatic Nucleic Acid
agcuugcacugaugaggccguuaggccgaaaaauuaca

SEQ ID NO: 10934 - RNA, 38 nt, Artificial Sequence
  Description of Artificial Sequence:  Enzymatic Nucleic Acid
uggagaggcugaugaggccguuaggccgaaagcuugca

SEQ ID NO: 10935 - RNA, 38 nt, Artificial Sequence
  Description of Artificial Sequence:  Enzymatic Nucleic Acid
uagcuggacugaugaggccguuaggccgaaagggagcu

SEQ ID NO: 10936 - RNA, 38 nt, Artificial Sequence
  Description of Artificial Sequence:  Enzymatic Nucleic Acid
ccuagcugcugaugaggccguuaggccgaaagagggag

SEQ ID NO: 10937 - RNA, 38 nt, Artificial Sequence
  Description of Artificial Sequence:  Enzymatic Nucleic Acid
cugagucccugaugaggccguuaggccgaaagcuggag

SEQ ID NO: 10938 - RNA, 38 nt, Artificial Sequence
  Description of Artificial Sequence:  Enzymatic Nucleic Acid
aauauccucugaugaggccguuaggccgaaaguccuag

SEQ ID NO: 10939 - RNA, 38 nt, Artificial Sequence
  Description of Artificial Sequence:  Enzymatic Nucleic Acid
uugacuaacugaugaggccguuaggccgaaauccugag

SEQ ID NO: 10940 - RNA, 38 nt, Artificial Sequence
  Description of Artificial Sequence:  Enzymatic Nucleic Acid
cauugacucugaugaggccguuaggccgaaauauccug

SEQ ID NO: 10941 - RNA, 38 nt, Artificial Sequence
  Description of Artificial Sequence:  Enzymatic Nucleic Acid
ucauugaccugaugaggccguuaggccgaaaauauccu

SEQ ID NO: 10942 - RNA, 38 nt, Artificial Sequence
  Description of Artificial Sequence:  Enzymatic Nucleic Acid
uuccuuuucugaugaggccguuaggccgaaauggcuca

SEQ ID NO: 10943 - RNA, 38 nt, Artificial Sequence
  Description of Artificial Sequence:  Enzymatic Nucleic Acid
aaauaagacugaugaggccguuaggccgaaagguuuuu

SEQ ID NO: 10944 - RNA, 38 nt, Artificial Sequence
  Description of Artificial Sequence:  Enzymatic Nucleic Acid
gaaaauaacugaugaggccguuaggccgaaauagguuu

SEQ ID NO: 10945 - RNA, 38 nt, Artificial Sequence
  Description of Artificial Sequence:  Enzymatic Nucleic Acid
augaaaaucugaugaggccguuaggccgaaagauaggu

SEQ ID NO: 10946 - RNA, 38 nt, Artificial Sequence
  Description of Artificial Sequence:  Enzymatic Nucleic Acid
gaugaaaacugaugaggccguuaggccgaaaagauagg

SEQ ID NO: 10947 - RNA, 38 nt, Artificial Sequence
  Description of Artificial Sequence:  Enzymatic Nucleic Acid
cagaugaacugaugaggccguuaggccgaaauaagaua

SEQ ID NO: 10948 - RNA, 38 nt, Artificial Sequence
  Description of Artificial Sequence:  Enzymatic Nucleic Acid
acagaugacugaugaggccguuaggccgaaaauaagau

SEQ ID NO: 10949 - RNA, 38 nt, Artificial Sequence
  Description of Artificial Sequence:  Enzymatic Nucleic Acid
aacagaugcugaugaggccguuaggccgaaaaauaaga

SEQ ID NO: 10950 - RNA, 38 nt, Artificial Sequence
  Description of Artificial Sequence:  Enzymatic Nucleic Acid
aaacagaucugaugaggccguuaggccgaaaaaauaag

SEQ ID NO: 10951 - RNA, 38 nt, Artificial Sequence
  Description of Artificial Sequence:  Enzymatic Nucleic Acid
augaaacacugaugaggccguuaggccgaaaugaaaau

SEQ ID NO: 10952 - RNA, 38 nt, Artificial Sequence
  Description of Artificial Sequence:  Enzymatic Nucleic Acid
agguaugacugaugaggccguuaggccgaaacagauga

SEQ ID NO: 10953 - RNA, 38 nt, Artificial Sequence
  Description of Artificial Sequence:  Enzymatic Nucleic Acid
aagguaugcugaugaggccguuaggccgaaaacagaug

SEQ ID NO: 10954 - RNA, 38 nt, Artificial Sequence
  Description of Artificial Sequence:  Enzymatic Nucleic Acid
caagguaucugaugaggccguuaggccgaaaaacagau

SEQ ID NO: 10955 - RNA, 38 nt, Artificial Sequence
  Description of Artificial Sequence:  Enzymatic Nucleic Acid
agacaaggcugaugaggccguuaggccgaaaugaaaca

SEQ ID NO: 10956 - RNA, 38 nt, Artificial Sequence
  Description of Artificial Sequence:  Enzymatic Nucleic Acid
ccccagaccugaugaggccguuaggccgaaagguauga

SEQ ID NO: 10957 - RNA, 38 nt, Artificial Sequence
  Description of Artificial Sequence:  Enzymatic Nucleic Acid
agaccccacugaugaggccguuaggccgaaacaaggua

SEQ ID NO: 10958 - RNA, 38 nt, Artificial Sequence
  Description of Artificial Sequence:  Enzymatic Nucleic Acid
cgucauuacugaugaggccguuaggccgaaaccccaga

SEQ ID NO: 10959 - RNA, 38 nt, Artificial Sequence
  Description of Artificial Sequence:  Enzymatic Nucleic Acid
aucgucaucugaugaggccguuaggccgaaagacccca

SEQ ID NO: 10960 - RNA, 38 nt, Artificial Sequence
  Description of Artificial Sequence:  Enzymatic Nucleic Acid
cccauguccugaugaggccguuaggccgaaacccuguu

SEQ ID NO: 10961 - RNA, 38 nt, Artificial Sequence
  Description of Artificial Sequence:  Enzymatic Nucleic Acid
cccuuuuccugaugaggccguuaggccgaaacccuguc

SEQ ID NO: 10962 - RNA, 38 nt, Artificial Sequence
  Description of Artificial Sequence:  Enzymatic Nucleic Acid
accccaaacugaugaggccguuaggccgaaagcgggca

SEQ ID NO: 10963 - RNA, 38 nt, Artificial Sequence
  Description of Artificial Sequence:  Enzymatic Nucleic Acid
agaccccacugaugaggccguuaggccgaaagagcggg

SEQ ID NO: 10964 - RNA, 38 nt, Artificial Sequence
  Description of Artificial Sequence:  Enzymatic Nucleic Acid
uagacccccugaugaggccguuaggccgaaaagagcgg

SEQ ID NO: 10965 - RNA, 38 nt, Artificial Sequence
  Description of Artificial Sequence:  Enzymatic Nucleic Acid
caucucuacugaugaggccguuaggccgaaaccccaaa

SEQ ID NO: 10966 - RNA, 38 nt, Artificial Sequence
  Description of Artificial Sequence:  Enzymatic Nucleic Acid
cucaucuccugaugaggccguuaggccgaaagacccca

SEQ ID NO: 10967 - RNA, 38 nt, Artificial Sequence
  Description of Artificial Sequence:  Enzymatic Nucleic Acid
auuuuagacugaugaggccguuaggccgaaacccaggg

SEQ ID NO: 10968 - RNA, 38 nt, Artificial Sequence
  Description of Artificial Sequence:  Enzymatic Nucleic Acid
ccauuuuacugaugaggccguuaggccgaaagacccag

SEQ ID NO: 10969 - RNA, 38 nt, Artificial Sequence
  Description of Artificial Sequence:  Enzymatic Nucleic Acid
agccauuucugaugaggccguuaggccgaaagagaccc

SEQ ID NO: 10970 - RNA, 38 nt, Artificial Sequence
  Description of Artificial Sequence:  Enzymatic Nucleic Acid
uucuaagacugaugaggccguuaggccgaaagccauuu

SEQ ID NO: 10971 - RNA, 38 nt, Artificial Sequence
  Description of Artificial Sequence:  Enzymatic Nucleic Acid
acuucuaacugaugaggccguuaggccgaaagagccau

SEQ ID NO: 10972 - RNA, 38 nt, Artificial Sequence
  Description of Artificial Sequence:  Enzymatic Nucleic Acid
caacuucucugaugaggccguuaggccgaaagagagcc

SEQ ID NO: 10973 - RNA, 38 nt, Artificial Sequence
  Description of Artificial Sequence:  Enzymatic Nucleic Acid
acaacuuccugaugaggccguuaggccgaaaagagagc

SEQ ID NO: 10974 - RNA, 38 nt, Artificial Sequence
  Description of Artificial Sequence:  Enzymatic Nucleic Acid
gcacauaccugaugaggccguuaggccgaaacuucuaa

SEQ ID NO: 10975 - RNA, 38 nt, Artificial Sequence
  Description of Artificial Sequence:  Enzymatic Nucleic Acid
uuugcacacugaugaggccguuaggccgaaacaacuuc

SEQ ID NO: 10976 - RNA, 38 nt, Artificial Sequence
  Description of Artificial Sequence:  Enzymatic Nucleic Acid
cagaccaucugaugaggccguuaggccgaaauuugcac

SEQ ID NO: 10977 - RNA, 38 nt, Artificial Sequence
  Description of Artificial Sequence:  Enzymatic Nucleic Acid
acagaccacugaugaggccguuaggccgaaaauuugca

SEQ ID NO: 10978 - RNA, 38 nt, Artificial Sequence
  Description of Artificial Sequence:  Enzymatic Nucleic Acid
agcacacacugaugaggccguuaggccgaaaccauaau

SEQ ID NO: 10979 - RNA, 38 nt, Artificial Sequence
  Description of Artificial Sequence:  Enzymatic Nucleic Acid
cacgaccucugaugaggccguuaggccgaaagcacaca

SEQ ID NO: 10980 - RNA, 38 nt, Artificial Sequence
  Description of Artificial Sequence:  Enzymatic Nucleic Acid
gcacgacccugaugaggccguuaggccgaaaagcacac

SEQ ID NO: 10981 - RNA, 38 nt, Artificial Sequence
  Description of Artificial Sequence:  Enzymatic Nucleic Acid
gugugcaccugaugaggccguuaggccgaaaccuaagc

SEQ ID NO: 10982 - RNA, 38 nt, Artificial Sequence
  Description of Artificial Sequence:  Enzymatic Nucleic Acid
ccagcugucugaugaggccguuaggccgaaaccggcuc

SEQ ID NO: 10983 - RNA, 38 nt, Artificial Sequence
  Description of Artificial Sequence:  Enzymatic Nucleic Acid
aaagcagccugaugaggccguuaggccgaaauucaucg

SEQ ID NO: 10984 - RNA, 38 nt, Artificial Sequence
  Description of Artificial Sequence:  Enzymatic Nucleic Acid
cucucccacugaugaggccguuaggccgaaagcagcua

SEQ ID NO: 10985 - RNA, 38 nt, Artificial Sequence
  Description of Artificial Sequence:  Enzymatic Nucleic Acid
gcucuccccugaugaggccguuaggccgaaaagcagcu

SEQ ID NO: 10986 - RNA, 38 nt, Artificial Sequence
  Description of Artificial Sequence:  Enzymatic Nucleic Acid
uaaguggccugaugaggccguuaggccgaaagcaugcu

SEQ ID NO: 10987 - RNA, 38 nt, Artificial Sequence
  Description of Artificial Sequence:  Enzymatic Nucleic Acid
agagaauucugaugaggccguuaggccgaaaguggcua

SEQ ID NO: 10988 - RNA, 38 nt, Artificial Sequence
  Description of Artificial Sequence:  Enzymatic Nucleic Acid
cagagaaucugaugaggccguuaggccgaaaaguggcu

SEQ ID NO: 10989 - RNA, 38 nt, Artificial Sequence
  Description of Artificial Sequence:  Enzymatic Nucleic Acid
ggucagagcugaugaggccguuaggccgaaauuaagug

SEQ ID NO: 10990 - RNA, 38 nt, Artificial Sequence
  Description of Artificial Sequence:  Enzymatic Nucleic Acid
cggucagacugaugaggccguuaggccgaaaauuaagu

SEQ ID NO: 10991 - RNA, 38 nt, Artificial Sequence
  Description of Artificial Sequence:  Enzymatic Nucleic Acid
cccggucacugaugaggccguuaggccgaaagaauuaa

SEQ ID NO: 10992 - RNA, 38 nt, Artificial Sequence
  Description of Artificial Sequence:  Enzymatic Nucleic Acid
guacccaucugaugaggccguuaggccgaaaugcuggc

SEQ ID NO: 10993 - RNA, 38 nt, Artificial Sequence
  Description of Artificial Sequence:  Enzymatic Nucleic Acid
ggagcaggcugaugaggccguuaggccgaaacccauga

SEQ ID NO: 10994 - RNA, 38 nt, Artificial Sequence
  Description of Artificial Sequence:  Enzymatic Nucleic Acid
acacagggcugaugaggccguuaggccgaaagcaggua

SEQ ID NO: 10995 - RNA, 38 nt, Artificial Sequence
  Description of Artificial Sequence:  Enzymatic Nucleic Acid
ggauggggcugaugaggccguuaggccgaaacacaggg

SEQ ID NO: 10996 - RNA, 38 nt, Artificial Sequence
  Description of Artificial Sequence:  Enzymatic Nucleic Acid
accuuaagcugaugaggccguuaggccgaaauggggua

SEQ ID NO: 10997 - RNA, 38 nt, Artificial Sequence
  Description of Artificial Sequence:  Enzymatic Nucleic Acid
aaaaccuucugaugaggccguuaggccgaaaggauggg

SEQ ID NO: 10998 - RNA, 38 nt, Artificial Sequence
  Description of Artificial Sequence:  Enzymatic Nucleic Acid
gaaaaccucugaugaggccguuaggccgaaaaggaugg

SEQ ID NO: 10999 - RNA, 38 nt, Artificial Sequence
  Description of Artificial Sequence:  Enzymatic Nucleic Acid
agacagaacugaugaggccguuaggccgaaaccuuaag

SEQ ID NO: 11000 - RNA, 38 nt, Artificial Sequence
  Description of Artificial Sequence:  Enzymatic Nucleic Acid
cagacagacugaugaggccguuaggccgaaaaccuuaa

SEQ ID NO: 11001 - RNA, 38 nt, Artificial Sequence
  Description of Artificial Sequence:  Enzymatic Nucleic Acid
ucagacagcugaugaggccguuaggccgaaaaaccuua

SEQ ID NO: 11002 - RNA, 38 nt, Artificial Sequence
  Description of Artificial Sequence:  Enzymatic Nucleic Acid
aucagacacugaugaggccguuaggccgaaaaaaccuu

SEQ ID NO: 11003 - RNA, 38 nt, Artificial Sequence
  Description of Artificial Sequence:  Enzymatic Nucleic Acid
ucucaucacugaugaggccguuaggccgaaacagaaaa

SEQ ID NO: 11004 - RNA, 38 nt, Artificial Sequence
  Description of Artificial Sequence:  Enzymatic Nucleic Acid
ucagugggcugaugaggccguuaggccgaaauugcacu

SEQ ID NO: 11005 - RNA, 38 nt, Artificial Sequence
  Description of Artificial Sequence:  Enzymatic Nucleic Acid
ugcaccaacugaugaggccguuaggccgaaagccacag

SEQ ID NO: 11006 - RNA, 38 nt, Artificial Sequence
  Description of Artificial Sequence:  Enzymatic Nucleic Acid
agugcacccugaugaggccguuaggccgaaagagccac

SEQ ID NO: 11007 - RNA, 38 nt, Artificial Sequence
  Description of Artificial Sequence:  Enzymatic Nucleic Acid
uggcuggucugaugaggccguuaggccgaaagugcacc

SEQ ID NO: 11008 - RNA, 38 nt, Artificial Sequence
  Description of Artificial Sequence:  Enzymatic Nucleic Acid
uacuuguccugaugaggccguuaggccgaaaguccugg

SEQ ID NO: 11009 - RNA, 38 nt, Artificial Sequence
  Description of Artificial Sequence:  Enzymatic Nucleic Acid
cccuuucccugaugaggccguuaggccgaaacuugucu

SEQ ID NO: 11010 - RNA, 38 nt, Artificial Sequence
  Description of Artificial Sequence:  Enzymatic Nucleic Acid
guggcuagcugaugaggccguuaggccgaaagcccuuu

SEQ ID NO: 11011 - RNA, 38 nt, Artificial Sequence
  Description of Artificial Sequence:  Enzymatic Nucleic Acid
uguggcuacugaugaggccguuaggccgaaaagcccuu

SEQ ID NO: 11012 - RNA, 38 nt, Artificial Sequence
  Description of Artificial Sequence:  Enzymatic Nucleic Acid
aguguggccugaugaggccguuaggccgaaagaagccc

SEQ ID NO: 11013 - RNA, 38 nt, Artificial Sequence
  Description of Artificial Sequence:  Enzymatic Nucleic Acid
cccuaccucugaugaggccguuaggccgaaauuuucuu

SEQ ID NO: 11014 - RNA, 38 nt, Artificial Sequence
  Description of Artificial Sequence:  Enzymatic Nucleic Acid
gccagccccugaugaggccguuaggccgaaaccugauu

SEQ ID NO: 11015 - RNA, 38 nt, Artificial Sequence
  Description of Artificial Sequence:  Enzymatic Nucleic Acid
uggacaaacugaugaggccguuaggccgaaaugucuuu

SEQ ID NO: 11016 - RNA, 38 nt, Artificial Sequence
  Description of Artificial Sequence:  Enzymatic Nucleic Acid
aauggacacugaugaggccguuaggccgaaagaugucu

SEQ ID NO: 11017 - RNA, 38 nt, Artificial Sequence
  Description of Artificial Sequence:  Enzymatic Nucleic Acid
gaauggaccugaugaggccguuaggccgaaaagauguc

SEQ ID NO: 11018 - RNA, 38 nt, Artificial Sequence
  Description of Artificial Sequence:  Enzymatic Nucleic Acid
ugcgaaugcugaugaggccguuaggccgaaacaaagau

SEQ ID NO: 11019 - RNA, 38 nt, Artificial Sequence
  Description of Artificial Sequence:  Enzymatic Nucleic Acid
cuuuugcgcugaugaggccguuaggccgaaauggacaa

SEQ ID NO: 11020 - RNA, 38 nt, Artificial Sequence
  Description of Artificial Sequence:  Enzymatic Nucleic Acid
gcuuuugccugaugaggccguuaggccgaaaauggaca

SEQ ID NO: 11021 - RNA, 38 nt, Artificial Sequence
  Description of Artificial Sequence:  Enzymatic Nucleic Acid
gccgacaacugaugaggccguuaggccgaaagcuuuug

SEQ ID NO: 11022 - RNA, 38 nt, Artificial Sequence
  Description of Artificial Sequence:  Enzymatic Nucleic Acid
cagccgaccugaugaggccguuaggccgaaagagcuuu

SEQ ID NO: 11023 - RNA, 38 nt, Artificial Sequence
  Description of Artificial Sequence:  Enzymatic Nucleic Acid
cugcagcccugaugaggccguuaggccgaaacaagagc

SEQ ID NO: 11024 - RNA, 38 nt, Artificial Sequence
  Description of Artificial Sequence:  Enzymatic Nucleic Acid
gccugacucugaugaggccguuaggccgaaacacacug

SEQ ID NO: 11025 - RNA, 38 nt, Artificial Sequence
  Description of Artificial Sequence:  Enzymatic Nucleic Acid
caucgccucugaugaggccguuaggccgaaacuuacac

SEQ ID NO: 11026 - RNA, 38 nt, Artificial Sequence
  Description of Artificial Sequence:  Enzymatic Nucleic Acid
uucucuggcugaugaggccguuaggccgaaagccucug

SEQ ID NO: 11027 - RNA, 38 nt, Artificial Sequence
  Description of Artificial Sequence:  Enzymatic Nucleic Acid
ggaugagacugaugaggccguuaggccgaaaccucagg

SEQ ID NO: 11028 - RNA, 38 nt, Artificial Sequence
  Description of Artificial Sequence:  Enzymatic Nucleic Acid
uggaugagcugaugaggccguuaggccgaaaaccucag

SEQ ID NO: 11029 - RNA, 38 nt, Artificial Sequence
  Description of Artificial Sequence:  Enzymatic Nucleic Acid
cuggaugacugaugaggccguuaggccgaaaaaccuca

SEQ ID NO: 11030 - RNA, 38 nt, Artificial Sequence
  Description of Artificial Sequence:  Enzymatic Nucleic Acid
aucuggaucugaugaggccguuaggccgaaagaaaccu

SEQ ID NO: 11031 - RNA, 38 nt, Artificial Sequence
  Description of Artificial Sequence:  Enzymatic Nucleic Acid
gauaucugcugaugaggccguuaggccgaaaugagaaa

SEQ ID NO: 11032 - RNA, 38 nt, Artificial Sequence
  Description of Artificial Sequence:  Enzymatic Nucleic Acid
uugcuggacugaugaggccguuaggccgaaaucuggau

SEQ ID NO: 11033 - RNA, 38 nt, Artificial Sequence
  Description of Artificial Sequence:  Enzymatic Nucleic Acid
aauugcugcugaugaggccguuaggccgaaauaucugg

SEQ ID NO: 11034 - RNA, 38 nt, Artificial Sequence
  Description of Artificial Sequence:  Enzymatic Nucleic Acid
cacccccccugaugaggccguuaggccgaaauugcugg

SEQ ID NO: 11035 - RNA, 38 nt, Artificial Sequence
  Description of Artificial Sequence:  Enzymatic Nucleic Acid
ggaccauccugaugaggccguuaggccgaaauggucuu

SEQ ID NO: 11036 - RNA, 38 nt, Artificial Sequence
  Description of Artificial Sequence:  Enzymatic Nucleic Acid
uaauacagcugaugaggccguuaggccgaaaccaucua

SEQ ID NO: 11037 - RNA, 38 nt, Artificial Sequence
  Description of Artificial Sequence:  Enzymatic Nucleic Acid
cggaauaacugaugaggccguuaggccgaaacaggacc

SEQ ID NO: 11038 - RNA, 38 nt, Artificial Sequence
  Description of Artificial Sequence:  Enzymatic Nucleic Acid
aucggaaucugaugaggccguuaggccgaaauacagga

SEQ ID NO: 11039 - RNA, 38 nt, Artificial Sequence
  Description of Artificial Sequence:  Enzymatic Nucleic Acid
aaucggaacugaugaggccguuaggccgaaaauacagg

SEQ ID NO: 11040 - RNA, 38 nt, Artificial Sequence
  Description of Artificial Sequence:  Enzymatic Nucleic Acid
aaaaucggcugaugaggccguuaggccgaaauaauaca

SEQ ID NO: 11041 - RNA, 38 nt, Artificial Sequence
  Description of Artificial Sequence:  Enzymatic Nucleic Acid
uaaaaucgcugaugaggccguuaggccgaaaauaauac

SEQ ID NO: 11042 - RNA, 38 nt, Artificial Sequence
  Description of Artificial Sequence:  Enzymatic Nucleic Acid
auuauuaacugaugaggccguuaggccgaaaucggaau

SEQ ID NO: 11043 - RNA, 38 nt, Artificial Sequence
  Description of Artificial Sequence:  Enzymatic Nucleic Acid
gauuauuacugaugaggccguuaggccgaaaaucggaa

SEQ ID NO: 11044 - RNA, 38 nt, Artificial Sequence
  Description of Artificial Sequence:  Enzymatic Nucleic Acid
agauuauucugaugaggccguuaggccgaaaaaucgga

SEQ ID NO: 11045 - RNA, 38 nt, Artificial Sequence
  Description of Artificial Sequence:  Enzymatic Nucleic Acid
uagauuaucugaugaggccguuaggccgaaaaaaucgg

SEQ ID NO: 11046 - RNA, 38 nt, Artificial Sequence
  Description of Artificial Sequence:  Enzymatic Nucleic Acid
aauuagaucugaugaggccguuaggccgaaauuaaaau

SEQ ID NO: 11047 - RNA, 38 nt, Artificial Sequence
  Description of Artificial Sequence:  Enzymatic Nucleic Acid
acgaauuacugaugaggccguuaggccgaaauuauuaa

SEQ ID NO: 11048 - RNA, 38 nt, Artificial Sequence
  Description of Artificial Sequence:  Enzymatic Nucleic Acid
ucacgaaucugaugaggccguuaggccgaaagauuauu

SEQ ID NO: 11049 - RNA, 38 nt, Artificial Sequence
  Description of Artificial Sequence:  Enzymatic Nucleic Acid
ugaucacgcugaugaggccguuaggccgaaauuagauu

SEQ ID NO: 11050 - RNA, 38 nt, Artificial Sequence
  Description of Artificial Sequence:  Enzymatic Nucleic Acid
augaucaccugaugaggccguuaggccgaaaauuagau

SEQ ID NO: 11051 - RNA, 38 nt, Artificial Sequence
  Description of Artificial Sequence:  Enzymatic Nucleic Acid
cucuuaaucugaugaggccguuaggccgaaaucacgaa

SEQ ID NO: 11052 - RNA, 38 nt, Artificial Sequence
  Description of Artificial Sequence:  Enzymatic Nucleic Acid
agucucuucugaugaggccguuaggccgaaaugaucac

SEQ ID NO: 11053 - RNA, 38 nt, Artificial Sequence
  Description of Artificial Sequence:  Enzymatic Nucleic Acid
aagucucucugaugaggccguuaggccgaaaaugauca

SEQ ID NO: 11054 - RNA, 38 nt, Artificial Sequence
  Description of Artificial Sequence:  Enzymatic Nucleic Acid
auuuacuacugaugaggccguuaggccgaaagucucuu

SEQ ID NO: 11055 - RNA, 38 nt, Artificial Sequence
  Description of Artificial Sequence:  Enzymatic Nucleic Acid
cauuuacucugaugaggccguuaggccgaaaagucucu

SEQ ID NO: 11056 - RNA, 38 nt, Artificial Sequence
  Description of Artificial Sequence:  Enzymatic Nucleic Acid
acauuuaccugaugaggccguuaggccgaaaaagucuc

SEQ ID NO: 11057 - RNA, 38 nt, Artificial Sequence
  Description of Artificial Sequence:  Enzymatic Nucleic Acid
gggacauucugaugaggccguuaggccgaaacuaaagu

SEQ ID NO: 11058 - RNA, 38 nt, Artificial Sequence
  Description of Artificial Sequence:  Enzymatic Nucleic Acid
ggaaaaggcugaugaggccguuaggccgaaacauuuac

SEQ ID NO: 11059 - RNA, 38 nt, Artificial Sequence
  Description of Artificial Sequence:  Enzymatic Nucleic Acid
ugugggaacugaugaggccguuaggccgaaagggacau

SEQ ID NO: 11060 - RNA, 38 nt, Artificial Sequence
  Description of Artificial Sequence:  Enzymatic Nucleic Acid
uugugggacugaugaggccguuaggccgaaaagggaca

SEQ ID NO: 11061 - RNA, 38 nt, Artificial Sequence
  Description of Artificial Sequence:  Enzymatic Nucleic Acid
uuugugggcugaugaggccguuaggccgaaaaagggac

SEQ ID NO: 11062 - RNA, 38 nt, Artificial Sequence
  Description of Artificial Sequence:  Enzymatic Nucleic Acid
uuuuguggcugaugaggccguuaggccgaaaaaaggga

SEQ ID NO: 11063 - RNA, 38 nt, Artificial Sequence
  Description of Artificial Sequence:  Enzymatic Nucleic Acid
cuuuucuucugaugaggccguuaggccgaaacuuuugu

SEQ ID NO: 11064 - RNA, 38 nt, Artificial Sequence
  Description of Artificial Sequence:  Enzymatic Nucleic Acid
aaucccgacugaugaggccguuaggccgaaagcuuuuc

SEQ ID NO: 11065 - RNA, 38 nt, Artificial Sequence
  Description of Artificial Sequence:  Enzymatic Nucleic Acid
agaauccccugaugaggccguuaggccgaaauagcuuu

SEQ ID NO: 11066 - RNA, 38 nt, Artificial Sequence
  Description of Artificial Sequence:  Enzymatic Nucleic Acid
aaccagagcugaugaggccguuaggccgaaaucccgau

SEQ ID NO: 11067 - RNA, 38 nt, Artificial Sequence
  Description of Artificial Sequence:  Enzymatic Nucleic Acid
gaaccagacugaugaggccguuaggccgaaaaucccga

SEQ ID NO: 11068 - RNA, 38 nt, Artificial Sequence
  Description of Artificial Sequence:  Enzymatic Nucleic Acid
cagaaccacugaugaggccguuaggccgaaagaauccc

SEQ ID NO: 11069 - RNA, 38 nt, Artificial Sequence
  Description of Artificial Sequence:  Enzymatic Nucleic Acid
uuaagcagcugaugaggccguuaggccgaaaccagaga

SEQ ID NO: 11070 - RNA, 38 nt, Artificial Sequence
  Description of Artificial Sequence:  Enzymatic Nucleic Acid
uuuaagcacugaugaggccguuaggccgaaaaccagag

SEQ ID NO: 11071 - RNA, 38 nt, Artificial Sequence
  Description of Artificial Sequence:  Enzymatic Nucleic Acid
aagucuuucugaugaggccguuaggccgaaagcagaac

SEQ ID NO: 11072 - RNA, 38 nt, Artificial Sequence
  Description of Artificial Sequence:  Enzymatic Nucleic Acid
uaagucuucugaugaggccguuaggccgaaaagcagaa

SEQ ID NO: 11073 - RNA, 38 nt, Artificial Sequence
  Description of Artificial Sequence:  Enzymatic Nucleic Acid
ccaaagcucugaugaggccguuaggccgaaagucuuua

SEQ ID NO: 11074 - RNA, 38 nt, Artificial Sequence
  Description of Artificial Sequence:  Enzymatic Nucleic Acid
uccaaagccugaugaggccguuaggccgaaaagucuuu

SEQ ID NO: 11075 - RNA, 38 nt, Artificial Sequence
  Description of Artificial Sequence:  Enzymatic Nucleic Acid
aggcuccacugaugaggccguuaggccgaaagcuaagu

SEQ ID NO: 11076 - RNA, 38 nt, Artificial Sequence
  Description of Artificial Sequence:  Enzymatic Nucleic Acid
uaggcucccugaugaggccguuaggccgaaaagcuaag

SEQ ID NO: 11077 - RNA, 38 nt, Artificial Sequence
  Description of Artificial Sequence:  Enzymatic Nucleic Acid
aacuuucacugaugaggccguuaggccgaaaggcucca

SEQ ID NO: 11078 - RNA, 38 nt, Artificial Sequence
  Description of Artificial Sequence:  Enzymatic Nucleic Acid
ggcugauccugaugaggccguuaggccgaaacuuucau

SEQ ID NO: 11079 - RNA, 54 nt, Artificial Sequence
  Description of Artificial Sequence:  Enzymatic Nucleic Acid
gucccagcagaagaccauaccagagaaacacacguugugguacauuaccuggua

SEQ ID NO: 11080 - RNA, 54 nt, Artificial Sequence
  Description of Artificial Sequence:  Enzymatic Nucleic Acid
ggugucccagaagcugacaccagagaaacacacguugugguacauuaccuggua

SEQ ID NO: 11081 - RNA, 54 nt, Artificial Sequence
  Description of Artificial Sequence:  Enzymatic Nucleic Acid
uaaggcaaagaagcggugaccagagaaacacacguugugguacauuaccuggua

SEQ ID NO: 11082 - RNA, 54 nt, Artificial Sequence
  Description of Artificial Sequence:  Enzymatic Nucleic Acid
gacacccgagaagcgcguaccagagaaacacacguugugguacauuaccuggua

SEQ ID NO: 11083 - RNA, 54 nt, Artificial Sequence
  Description of Artificial Sequence:  Enzymatic Nucleic Acid
cugugagaagaagacaccaccagagaaacacacguugugguacauuaccuggua

SEQ ID NO: 11084 - RNA, 54 nt, Artificial Sequence
  Description of Artificial Sequence:  Enzymatic Nucleic Acid
gaaagagaagaaggccugaccagagaaacacacguugugguacauuaccuggua

SEQ ID NO: 11085 - RNA, 54 nt, Artificial Sequence
  Description of Artificial Sequence:  Enzymatic Nucleic Acid
caugagugagaagccuccaccagagaaacacacguugugguacauuaccuggua

SEQ ID NO: 11086 - RNA, 54 nt, Artificial Sequence
  Description of Artificial Sequence:  Enzymatic Nucleic Acid
cggucgugagaagagaccaccagagaaacacacguugugguacauuaccuggua

SEQ ID NO: 11087 - RNA, 54 nt, Artificial Sequence
  Description of Artificial Sequence:  Enzymatic Nucleic Acid
cucccacaagaagaugggaccagagaaacacacguugugguacauuaccuggua

SEQ ID NO: 11088 - RNA, 54 nt, Artificial Sequence
  Description of Artificial Sequence:  Enzymatic Nucleic Acid
ggaugaugagaagucuucaccagagaaacacacguugugguacauuaccuggua

SEQ ID NO: 11089 - RNA, 54 nt, Artificial Sequence
  Description of Artificial Sequence:  Enzymatic Nucleic Acid
cgucacccagaaggggauaccagagaaacacacguugugguacauuaccuggua

SEQ ID NO: 11090 - RNA, 54 nt, Artificial Sequence
  Description of Artificial Sequence:  Enzymatic Nucleic Acid
cuuugcccagaagggguaaccagagaaacacacguugugguacauuaccuggua

SEQ ID NO: 11091 - RNA, 54 nt, Artificial Sequence
  Description of Artificial Sequence:  Enzymatic Nucleic Acid
cgcaguucagaaguccuaaccagagaaacacacguugugguacauuaccuggua

SEQ ID NO: 11092 - RNA, 54 nt, Artificial Sequence
  Description of Artificial Sequence:  Enzymatic Nucleic Acid
gccgauggagaagauaguaccagagaaacacacguugugguacauuaccuggua

SEQ ID NO: 11093 - RNA, 54 nt, Artificial Sequence
  Description of Artificial Sequence:  Enzymatic Nucleic Acid
uuguauugagaagccgauaccagagaaacacacguugugguacauuaccuggua

SEQ ID NO: 11094 - RNA, 54 nt, Artificial Sequence
  Description of Artificial Sequence:  Enzymatic Nucleic Acid
cugggcucagaaggcguaaccagagaaacacacguugugguacauuaccuggua

SEQ ID NO: 11095 - RNA, 54 nt, Artificial Sequence
  Description of Artificial Sequence:  Enzymatic Nucleic Acid
gcccguggagaagucucaaccagagaaacacacguugugguacauuaccuggua

SEQ ID NO: 11096 - RNA, 54 nt, Artificial Sequence
  Description of Artificial Sequence:  Enzymatic Nucleic Acid
ggacaagaagaagcccguaccagagaaacacacguugugguacauuaccuggua

SEQ ID NO: 11097 - RNA, 54 nt, Artificial Sequence
  Description of Artificial Sequence:  Enzymatic Nucleic Acid
uccggucaagaagcugccaccagagaaacacacguugugguacauuaccuggua

SEQ ID NO: 11098 - RNA, 54 nt, Artificial Sequence
  Description of Artificial Sequence:  Enzymatic Nucleic Acid
cuucacgcagaagguguaaccagagaaacacacguugugguacauuaccuggua

SEQ ID NO: 11099 - RNA, 54 nt, Artificial Sequence
  Description of Artificial Sequence:  Enzymatic Nucleic Acid
uguugaaaagaaggaacgaccagagaaacacacguugugguacauuaccuggua

SEQ ID NO: 11100 - RNA, 54 nt, Artificial Sequence
  Description of Artificial Sequence:  Enzymatic Nucleic Acid
ccugcaccagaagcuuccaccagagaaacacacguugugguacauuaccuggua

SEQ ID NO: 11101 - RNA, 54 nt, Artificial Sequence
  Description of Artificial Sequence:  Enzymatic Nucleic Acid
gccgauagagaagucuucaccagagaaacacacguugugguacauuaccuggua

SEQ ID NO: 11102 - RNA, 54 nt, Artificial Sequence
  Description of Artificial Sequence:  Enzymatic Nucleic Acid
ucauggacagaagauaggaccagagaaacacacguugugguacauuaccuggua

SEQ ID NO: 11103 - RNA, 54 nt, Artificial Sequence
  Description of Artificial Sequence:  Enzymatic Nucleic Acid
cuuucaugagaagccgauaccagagaaacacacguugugguacauuaccuggua

SEQ ID NO: 11104 - RNA, 54 nt, Artificial Sequence
  Description of Artificial Sequence:  Enzymatic Nucleic Acid
aaauagcgagaagacuucaccagagaaacacacguugugguacauuaccuggua

SEQ ID NO: 11105 - RNA, 54 nt, Artificial Sequence
  Description of Artificial Sequence:  Enzymatic Nucleic Acid
uuucguagagaagagguuaccagagaaacacacguugugguacauuaccuggua

SEQ ID NO: 11106 - RNA, 54 nt, Artificial Sequence
  Description of Artificial Sequence:  Enzymatic Nucleic Acid
ugcugcccagaagauagaaccagagaaacacacguugugguacauuaccuggua

SEQ ID NO: 11107 - RNA, 54 nt, Artificial Sequence
  Description of Artificial Sequence:  Enzymatic Nucleic Acid
gucugagaagaagccaccaccagagaaacacacguugugguacauuaccuggua

SEQ ID NO: 11108 - RNA, 54 nt, Artificial Sequence
  Description of Artificial Sequence:  Enzymatic Nucleic Acid
uuccagggagaagagaguaccagagaaacacacguugugguacauuaccuggua

SEQ ID NO: 11109 - RNA, 54 nt, Artificial Sequence
  Description of Artificial Sequence:  Enzymatic Nucleic Acid
ggcccggcagaaguagauaccagagaaacacacguugugguacauuaccuggua

SEQ ID NO: 11110 - RNA, 54 nt, Artificial Sequence
  Description of Artificial Sequence:  Enzymatic Nucleic Acid
gaaggcccagaagcuguaaccagagaaacacacguugugguacauuaccuggua

SEQ ID NO: 11111 - RNA, 54 nt, Artificial Sequence
  Description of Artificial Sequence:  Enzymatic Nucleic Acid
uucggcacagaagugacaaccagagaaacacacguugugguacauuaccuggua

SEQ ID NO: 11112 - RNA, 54 nt, Artificial Sequence
  Description of Artificial Sequence:  Enzymatic Nucleic Acid
ucuccuucagaaggcaucaccagagaaacacacguugugguacauuaccuggua

SEQ ID NO: 11113 - RNA, 54 nt, Artificial Sequence
  Description of Artificial Sequence:  Enzymatic Nucleic Acid
ccacacagagaaguuucaaccagagaaacacacguugugguacauuaccuggua

SEQ ID NO: 11114 - RNA, 54 nt, Artificial Sequence
  Description of Artificial Sequence:  Enzymatic Nucleic Acid
gguuuugaagaaggugugaccagagaaacacacguugugguacauuaccuggua

SEQ ID NO: 11115 - RNA, 54 nt, Artificial Sequence
  Description of Artificial Sequence:  Enzymatic Nucleic Acid
accaagugagaagaggcgaccagagaaacacacguugugguacauuaccuggua

SEQ ID NO: 11116 - RNA, 54 nt, Artificial Sequence
  Description of Artificial Sequence:  Enzymatic Nucleic Acid
gugagguaagaagcgcuuaccagagaaacacacguugugguacauuaccuggua

SEQ ID NO: 11117 - RNA, 54 nt, Artificial Sequence
  Description of Artificial Sequence:  Enzymatic Nucleic Acid
ugagcgugagaagcuccaaccagagaaacacacguugugguacauuaccuggua

SEQ ID NO: 11118 - RNA, 54 nt, Artificial Sequence
  Description of Artificial Sequence:  Enzymatic Nucleic Acid
cggaagaaagaagcuucaaccagagaaacacacguugugguacauuaccuggua

SEQ ID NO: 11119 - RNA, 54 nt, Artificial Sequence
  Description of Artificial Sequence:  Enzymatic Nucleic Acid
gacagguaagaagucuuuaccagagaaacacacguugugguacauuaccuggua

SEQ ID NO: 11120 - RNA, 54 nt, Artificial Sequence
  Description of Artificial Sequence:  Enzymatic Nucleic Acid
cauagggcagaaguucacaccagagaaacacacguugugguacauuaccuggua

SEQ ID NO: 11121 - RNA, 54 nt, Artificial Sequence
  Description of Artificial Sequence:  Enzymatic Nucleic Acid
caucauagagaagccguuaccagagaaacacacguugugguacauuaccuggua

SEQ ID NO: 11122 - RNA, 54 nt, Artificial Sequence
  Description of Artificial Sequence:  Enzymatic Nucleic Acid
cacaguccagaaggugggaccagagaaacacacguugugguacauuaccuggua

SEQ ID NO: 11123 - RNA, 54 nt, Artificial Sequence
  Description of Artificial Sequence:  Enzymatic Nucleic Acid
cagccacaagaaggcaggaccagagaaacacacguugugguacauuaccuggua

SEQ ID NO: 11124 - RNA, 54 nt, Artificial Sequence
  Description of Artificial Sequence:  Enzymatic Nucleic Acid
guucggucagaagagcuuaccagagaaacacacguugugguacauuaccuggua

SEQ ID NO: 11125 - RNA, 54 nt, Artificial Sequence
  Description of Artificial Sequence:  Enzymatic Nucleic Acid
cgaucaccagaagaggccaccagagaaacacacguugugguacauuaccuggua

SEQ ID NO: 11126 - RNA, 54 nt, Artificial Sequence
  Description of Artificial Sequence:  Enzymatic Nucleic Acid
gguaguugagaagguuucaccagagaaacacacguugugguacauuaccuggua

SEQ ID NO: 11127 - RNA, 54 nt, Artificial Sequence
  Description of Artificial Sequence:  Enzymatic Nucleic Acid
cuuguugaagaagaauaaaccagagaaacacacguugugguacauuaccuggua

SEQ ID NO: 11128 - RNA, 54 nt, Artificial Sequence
  Description of Artificial Sequence:  Enzymatic Nucleic Acid
auaugcaaagaagcguccaccagagaaacacacguugugguacauuaccuggua

SEQ ID NO: 11129 - RNA, 54 nt, Artificial Sequence
  Description of Artificial Sequence:  Enzymatic Nucleic Acid
acugucuaagaagggcuuaccagagaaacacacguugugguacauuaccuggua

SEQ ID NO: 11130 - RNA, 54 nt, Artificial Sequence
  Description of Artificial Sequence:  Enzymatic Nucleic Acid
gacacuugagaagcugacaccagagaaacacacguugugguacauuaccuggua

SEQ ID NO: 11131 - RNA, 54 nt, Artificial Sequence
  Description of Artificial Sequence:  Enzymatic Nucleic Acid
gaagcuggagaaggugacaccagagaaacacacguugugguacauuaccuggua

SEQ ID NO: 11132 - RNA, 54 nt, Artificial Sequence
  Description of Artificial Sequence:  Enzymatic Nucleic Acid
uucagggaagaaggagcuaccagagaaacacacguugugguacauuaccuggua

SEQ ID NO: 11133 - RNA, 54 nt, Artificial Sequence
  Description of Artificial Sequence:  Enzymatic Nucleic Acid
uggugaggagaagcuuggaccagagaaacacacguugugguacauuaccuggua

SEQ ID NO: 11134 - RNA, 54 nt, Artificial Sequence
  Description of Artificial Sequence:  Enzymatic Nucleic Acid
uguaggaaagaaggucuuaccagagaaacacacguugugguacauuaccuggua

SEQ ID NO: 11135 - RNA, 54 nt, Artificial Sequence
  Description of Artificial Sequence:  Enzymatic Nucleic Acid
cacuuggaagaaguaggaaccagagaaacacacguugugguacauuaccuggua

SEQ ID NO: 11136 - RNA, 54 nt, Artificial Sequence
  Description of Artificial Sequence:  Enzymatic Nucleic Acid
uucuggagagaagaaacuaccagagaaacacacguugugguacauuaccuggua

SEQ ID NO: 11137 - RNA, 54 nt, Artificial Sequence
  Description of Artificial Sequence:  Enzymatic Nucleic Acid
cuucaggcagaagcagaaaccagagaaacacacguugugguacauuaccuggua

SEQ ID NO: 11138 - RNA, 54 nt, Artificial Sequence
  Description of Artificial Sequence:  Enzymatic Nucleic Acid
uuccuucaagaagcugcaaccagagaaacacacguugugguacauuaccuggua

SEQ ID NO: 11139 - RNA, 54 nt, Artificial Sequence
  Description of Artificial Sequence:  Enzymatic Nucleic Acid
ggguucucagaagcaugcaccagagaaacacacguugugguacauuaccuggua

SEQ ID NO: 11140 - RNA, 54 nt, Artificial Sequence
  Description of Artificial Sequence:  Enzymatic Nucleic Acid
guucagcaagaaggggccaccagagaaacacacguugugguacauuaccuggua

SEQ ID NO: 11141 - RNA, 54 nt, Artificial Sequence
  Description of Artificial Sequence:  Enzymatic Nucleic Acid
uggcuugaagaaggucacaccagagaaacacacguugugguacauuaccuggua

SEQ ID NO: 11142 - RNA, 54 nt, Artificial Sequence
  Description of Artificial Sequence:  Enzymatic Nucleic Acid
uguuucuaagaaguauggaccagagaaacacacguugugguacauuaccuggua

SEQ ID NO: 11143 - RNA, 54 nt, Artificial Sequence
  Description of Artificial Sequence:  Enzymatic Nucleic Acid
aucugcaaagaaguccuuaccagagaaacacacguugugguacauuaccuggua

SEQ ID NO: 11144 - RNA, 54 nt, Artificial Sequence
  Description of Artificial Sequence:  Enzymatic Nucleic Acid
aaauguggagaagcaaagaccagagaaacacacguugugguacauuaccuggua

SEQ ID NO: 11145 - RNA, 54 nt, Artificial Sequence
  Description of Artificial Sequence:  Enzymatic Nucleic Acid
cucacaucagaagagcuuaccagagaaacacacguugugguacauuaccuggua

SEQ ID NO: 11146 - RNA, 54 nt, Artificial Sequence
  Description of Artificial Sequence:  Enzymatic Nucleic Acid
uaguguccagaagauaguaccagagaaacacacguugugguacauuaccuggua

SEQ ID NO: 11147 - RNA, 54 nt, Artificial Sequence
  Description of Artificial Sequence:  Enzymatic Nucleic Acid
gggagcccagaagagugcaccagagaaacacacguugugguacauuaccuggua

SEQ ID NO: 11148 - RNA, 54 nt, Artificial Sequence
  Description of Artificial Sequence:  Enzymatic Nucleic Acid
uccaggugagaagcuucaaccagagaaacacacguugugguacauuaccuggua

SEQ ID NO: 11149 - RNA, 54 nt, Artificial Sequence
  Description of Artificial Sequence:  Enzymatic Nucleic Acid
cucggcagagaagaaaguaccagagaaacacacguugugguacauuaccuggua

SEQ ID NO: 11150 - RNA, 54 nt, Artificial Sequence
  Description of Artificial Sequence:  Enzymatic Nucleic Acid
ugggccucagaagaucggaccagagaaacacacguugugguacauuaccuggua

SEQ ID NO: 11151 - RNA, 54 nt, Artificial Sequence
  Description of Artificial Sequence:  Enzymatic Nucleic Acid
gaagcagaagaagggccuaccagagaaacacacguugugguacauuaccuggua

SEQ ID NO: 11152 - RNA, 54 nt, Artificial Sequence
  Description of Artificial Sequence:  Enzymatic Nucleic Acid
gcuggagaagaagaagcuaccagagaaacacacguugugguacauuaccuggua

SEQ ID NO: 11153 - RNA, 54 nt, Artificial Sequence
  Description of Artificial Sequence:  Enzymatic Nucleic Acid
guggccacagaaggagaaaccagagaaacacacguugugguacauuaccuggua

SEQ ID NO: 11154 - RNA, 54 nt, Artificial Sequence
  Description of Artificial Sequence:  Enzymatic Nucleic Acid
uggagaacagaaggacucaccagagaaacacacguugugguacauuaccuggua

SEQ ID NO: 11155 - RNA, 54 nt, Artificial Sequence
  Description of Artificial Sequence:  Enzymatic Nucleic Acid
ggguggagagaagcaggaaccagagaaacacacguugugguacauuaccuggua

SEQ ID NO: 11156 - RNA, 54 nt, Artificial Sequence
  Description of Artificial Sequence:  Enzymatic Nucleic Acid
gaguuguaagaaggggguaccagagaaacacacguugugguacauuaccuggua

SEQ ID NO: 11157 - RNA, 54 nt, Artificial Sequence
  Description of Artificial Sequence:  Enzymatic Nucleic Acid
uuuaggcgagaagggaggaccagagaaacacacguugugguacauuaccuggua

SEQ ID NO: 11158 - RNA, 54 nt, Artificial Sequence
  Description of Artificial Sequence:  Enzymatic Nucleic Acid
aagcuuuaagaaggcgggaccagagaaacacacguugugguacauuaccuggua

SEQ ID NO: 11159 - RNA, 54 nt, Artificial Sequence
  Description of Artificial Sequence:  Enzymatic Nucleic Acid
guugucggagaaggugagaccagagaaacacacguugugguacauuaccuggua

SEQ ID NO: 11160 - RNA, 54 nt, Artificial Sequence
  Description of Artificial Sequence:  Enzymatic Nucleic Acid
cugucaggagaagguuguaccagagaaacacacguugugguacauuaccuggua

SEQ ID NO: 11161 - RNA, 54 nt, Artificial Sequence
  Description of Artificial Sequence:  Enzymatic Nucleic Acid
uccuguggagaagaauagaccagagaaacacacguugugguacauuaccuggua

SEQ ID NO: 11162 - RNA, 54 nt, Artificial Sequence
  Description of Artificial Sequence:  Enzymatic Nucleic Acid
cgaaaagcagaaggcuccaccagagaaacacacguugugguacauuaccuggua

SEQ ID NO: 11163 - RNA, 54 nt, Artificial Sequence
  Description of Artificial Sequence:  Enzymatic Nucleic Acid
ucacgaaaagaagcuggcaccagagaaacacacguugugguacauuaccuggua

SEQ ID NO: 11164 - RNA, 54 nt, Artificial Sequence
  Description of Artificial Sequence:  Enzymatic Nucleic Acid
uuagucaaagaagcaacaaccagagaaacacacguugugguacauuaccuggua

SEQ ID NO: 11165 - RNA, 54 nt, Artificial Sequence
  Description of Artificial Sequence:  Enzymatic Nucleic Acid
ggugggcgagaagucgccaccagagaaacacacguugugguacauuaccuggua

SEQ ID NO: 11166 - RNA, 54 nt, Artificial Sequence
  Description of Artificial Sequence:  Enzymatic Nucleic Acid
ggccggugagaaggcgguaccagagaaacacacguugugguacauuaccuggua

SEQ ID NO: 11167 - RNA, 54 nt, Artificial Sequence
  Description of Artificial Sequence:  Enzymatic Nucleic Acid
agucccacagaagcagggaccagagaaacacacguugugguacauuaccuggua

SEQ ID NO: 11168 - RNA, 54 nt, Artificial Sequence
  Description of Artificial Sequence:  Enzymatic Nucleic Acid
cagagcagagaagugcauaccagagaaacacacguugugguacauuaccuggua

SEQ ID NO: 11169 - RNA, 54 nt, Artificial Sequence
  Description of Artificial Sequence:  Enzymatic Nucleic Acid
agagacagagaaggucagaccagagaaacacacguugugguacauuaccuggua

SEQ ID NO: 11170 - RNA, 54 nt, Artificial Sequence
  Description of Artificial Sequence:  Enzymatic Nucleic Acid
auaagagaagaagagcagaccagagaaacacacguugugguacauuaccuggua

SEQ ID NO: 11171 - RNA, 54 nt, Artificial Sequence
  Description of Artificial Sequence:  Enzymatic Nucleic Acid
cuccacagagaagacgcaaccagagaaacacacguugugguacauuaccuggua

SEQ ID NO: 11172 - RNA, 54 nt, Artificial Sequence
  Description of Artificial Sequence:  Enzymatic Nucleic Acid
cccgaaacagaagaggccaccagagaaacacacguugugguacauuaccuggua

SEQ ID NO: 11173 - RNA, 54 nt, Artificial Sequence
  Description of Artificial Sequence:  Enzymatic Nucleic Acid
gggcccgaagaagcggagaccagagaaacacacguugugguacauuaccuggua

SEQ ID NO: 11174 - RNA, 54 nt, Artificial Sequence
  Description of Artificial Sequence:  Enzymatic Nucleic Acid
aaacagacagaagaagacaccagagaaacacacguugugguacauuaccuggua

SEQ ID NO: 11175 - RNA, 54 nt, Artificial Sequence
  Description of Artificial Sequence:  Enzymatic Nucleic Acid
ggaugguaagaagacaacaccagagaaacacacguugugguacauuaccuggua

SEQ ID NO: 11176 - RNA, 54 nt, Artificial Sequence
  Description of Artificial Sequence:  Enzymatic Nucleic Acid
acuagaggagaagaugauaccagagaaacacacguugugguacauuaccuggua

SEQ ID NO: 11177 - RNA, 54 nt, Artificial Sequence
  Description of Artificial Sequence:  Enzymatic Nucleic Acid
augcgaagagaaggccugaccagagaaacacacguugugguacauuaccuggua

SEQ ID NO: 11178 - RNA, 54 nt, Artificial Sequence
  Description of Artificial Sequence:  Enzymatic Nucleic Acid
uccccgugagaaguaugcaccagagaaacacacguugugguacauuaccuggua

SEQ ID NO: 11179 - RNA, 54 nt, Artificial Sequence
  Description of Artificial Sequence:  Enzymatic Nucleic Acid
cuaggccaagaaggaccaaccagagaaacacacguugugguacauuaccuggua

SEQ ID NO: 11180 - RNA, 54 nt, Artificial Sequence
  Description of Artificial Sequence:  Enzymatic Nucleic Acid
uugagcccagaaguaggcaccagagaaacacacguugugguacauuaccuggua

SEQ ID NO: 11181 - RNA, 54 nt, Artificial Sequence
  Description of Artificial Sequence:  Enzymatic Nucleic Acid
auauauaaagaaggauaaaccagagaaacacacguugugguacauuaccuggua

SEQ ID NO: 11182 - RNA, 54 nt, Artificial Sequence
  Description of Artificial Sequence:  Enzymatic Nucleic Acid
uccucucaagaagccuugaccagagaaacacacguugugguacauuaccuggua

SEQ ID NO: 11183 - RNA, 54 nt, Artificial Sequence
  Description of Artificial Sequence:  Enzymatic Nucleic Acid
uaaauaugagaagauacuaccagagaaacacacguugugguacauuaccuggua

SEQ ID NO: 11184 - RNA, 54 nt, Artificial Sequence
  Description of Artificial Sequence:  Enzymatic Nucleic Acid
agguaugaagaagaugaaaccagagaaacacacguugugguacauuaccuggua

SEQ ID NO: 11185 - RNA, 54 nt, Artificial Sequence
  Description of Artificial Sequence:  Enzymatic Nucleic Acid
ccccaaagagaaggcaccaccagagaaacacacguugugguacauuaccuggua

SEQ ID NO: 11186 - RNA, 54 nt, Artificial Sequence
  Description of Artificial Sequence:  Enzymatic Nucleic Acid
ccggcuccagaaggugugaccagagaaacacacguugugguacauuaccuggua

SEQ ID NO: 11187 - RNA, 54 nt, Artificial Sequence
  Description of Artificial Sequence:  Enzymatic Nucleic Acid
gucugcccagaagugaccaccagagaaacacacguugugguacauuaccuggua

SEQ ID NO: 11188 - RNA, 54 nt, Artificial Sequence
  Description of Artificial Sequence:  Enzymatic Nucleic Acid
uauucaucagaagcccagaccagagaaacacacguugugguacauuaccuggua

SEQ ID NO: 11189 - RNA, 54 nt, Artificial Sequence
  Description of Artificial Sequence:  Enzymatic Nucleic Acid
ucucccaaagaagcuauuaccagagaaacacacguugugguacauuaccuggua

SEQ ID NO: 11190 - RNA, 54 nt, Artificial Sequence
  Description of Artificial Sequence:  Enzymatic Nucleic Acid
cuggcccgagaagagaauaccagagaaacacacguugugguacauuaccuggua

SEQ ID NO: 11191 - RNA, 54 nt, Artificial Sequence
  Description of Artificial Sequence:  Enzymatic Nucleic Acid
cacaggggagaagguaccaccagagaaacacacguugugguacauuaccuggua

SEQ ID NO: 11192 - RNA, 54 nt, Artificial Sequence
  Description of Artificial Sequence:  Enzymatic Nucleic Acid
ucucaucaagaagaaaacaccagagaaacacacguugugguacauuaccuggua

SEQ ID NO: 11193 - RNA, 54 nt, Artificial Sequence
  Description of Artificial Sequence:  Enzymatic Nucleic Acid
ccagucucagaagacagaaccagagaaacacacguugugguacauuaccuggua

SEQ ID NO: 11194 - RNA, 54 nt, Artificial Sequence
  Description of Artificial Sequence:  Enzymatic Nucleic Acid
gggcugcaagaagucucaaccagagaaacacacguugugguacauuaccuggua

SEQ ID NO: 11195 - RNA, 54 nt, Artificial Sequence
  Description of Artificial Sequence:  Enzymatic Nucleic Acid
ccacagugagaagcaggcaccagagaaacacacguugugguacauuaccuggua

SEQ ID NO: 11196 - RNA, 54 nt, Artificial Sequence
  Description of Artificial Sequence:  Enzymatic Nucleic Acid
cacacugcagaagacaagaccagagaaacacacguugugguacauuaccuggua

SEQ ID NO: 11197 - RNA, 54 nt, Artificial Sequence
  Description of Artificial Sequence:  Enzymatic Nucleic Acid
cuguucucagaaguuucuaccagagaaacacacguugugguacauuaccuggua

SEQ ID NO: 11198 - RNA, 54 nt, Artificial Sequence
  Description of Artificial Sequence:  Enzymatic Nucleic Acid
aaaccucaagaagcuguuaccagagaaacacacguugugguacauuaccuggua

SEQ ID NO: 11199 - RNA, 54 nt, Artificial Sequence
  Description of Artificial Sequence:  Enzymatic Nucleic Acid
uuauuaaaagaagaauaaaccagagaaacacacguugugguacauuaccuggua

SEQ ID NO: 11200 - RNA, 54 nt, Artificial Sequence
  Description of Artificial Sequence:  Enzymatic Nucleic Acid
agucuuuaagaagaaccaaccagagaaacacacguugugguacauuaccuggua

SEQ ID NO: 11201 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
aucuuuucugaugaggcgaaagccgaaaccauacn

SEQ ID NO: 11202 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
aucuuuucuuaugaggcgaaagccgauaccauacn

SEQ ID NO: 11203 - RNA, 35 nt, Artificial Sequence; identical to SEQ ID NO: 11201
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 11204 - RNA, 35 nt, Artificial Sequence; identical to SEQ ID NO: 11202
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 11205 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
gaguugcugaugaggcgaaagccgaaagucugn

SEQ ID NO: 11206 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
gaguugcuuaugaggcgaaagccgauagucugn

SEQ ID NO: 11207 - RNA, 33 nt, Artificial Sequence; identical to SEQ ID NO: 11205
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 11208 - RNA, 33 nt, Artificial Sequence; identical to SEQ ID NO: 11206
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 11209 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
uacaauucugaugaggcgaaagccgaaaagacaan

SEQ ID NO: 11210 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
  misc_feature (35)..(35): n stands for inverted deoxyabasic derivative
uacaauucuuaugaggcgaaagccgauaagacaan

SEQ ID NO: 11211 - RNA, 35 nt, Artificial Sequence; identical to SEQ ID NO: 11209
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 11212 - RNA, 35 nt, Artificial Sequence; identical to SEQ ID NO: 11210
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (10)..(10): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'- C-Allyl
  misc_feature (35)..(35): n stands for inverted deoxyabasic derivative

SEQ ID NO: 11213 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
cuggagcugaugaggcgaaagccgaaacacggn

SEQ ID NO: 11214 - RNA, 33 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
  misc_feature (33)..(33): n stands for inverted deoxyabasic derivative
cuggagcuuaugaggcgaaagccgauacacggn

SEQ ID NO: 11215 - RNA, 33 nt, Artificial Sequence; identical to SEQ ID NO: 11213
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 11216 - RNA, 33 nt, Artificial Sequence; identical to SEQ ID NO: 11214
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (9)..(9): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'- C-Allyl
  misc_feature (33)..(33): n stands for inverted deoxyabasic derivative

SEQ ID NO: 11217 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (35)..(35): n stands for inverted deoxyabasic derivative
gaguugcugaugaggccgaaaggccgaaagucugn

SEQ ID NO: 11218 - RNA, 35 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (35)..(35): n stands for inverted deoxyabasic derivative
gaguugcuagagaggccgaaaggccgauagucugn

SEQ ID NO: 11219 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(33): 2'-O-Methyl
  misc_feature (8)..(8): 2'-deoxy-2'-amino
  misc_feature (34)..(34): n stands for inverted deoxyabasic derivative
gaaggucuagugaggccgaaaggccgauaugucn

SEQ ID NO: 11220 - RNA, 38 nt, Artificial Sequence
  Description of Artificial Sequence:  Enzymatic Nucleic Acid
  misc_feature (31)..(31): n stands for inosine
ccgagaggcugaugaggccguuaggccgaanuguccgc

SEQ ID NO: 11221 - RNA, 38 nt, Artificial Sequence
  Description of Artificial Sequence:  Enzymatic Nucleic Acid
  misc_feature (31)..(31): n stands for inosine
agccgagacugaugaggccguuaggccgaanagugucc

SEQ ID NO: 11222 - RNA, 38 nt, Artificial Sequence
  Description of Artificial Sequence:  Enzymatic Nucleic Acid
  misc_feature (31)..(31): n stands for inosine
gagccgagcugaugaggccguuaggccgaangaguguc

SEQ ID NO: 11223 - RNA, 38 nt, Artificial Sequence
  Description of Artificial Sequence:  Enzymatic Nucleic Acid
  misc_feature (31)..(31): n stands for inosine
aggagccgcugaugaggccguuaggccgaanaggagug

SEQ ID NO: 11224 - RNA, 38 nt, Artificial Sequence
  Description of Artificial Sequence:  Enzymatic Nucleic Acid
  misc_feature (31)..(31): n stands for inosine
cggggaggcugaugaggccguuaggccgaanccgagag

SEQ ID NO: 11225 - RNA, 38 nt, Artificial Sequence
  Description of Artificial Sequence:  Enzymatic Nucleic Acid
  misc_feature (31)..(31): n stands for inosine
gccggggacugaugaggccguuaggccgaanagccgag

SEQ ID NO: 11226 - RNA, 38 nt, Artificial Sequence
  Description of Artificial Sequence:  Enzymatic Nucleic Acid
  misc_feature (31)..(31): n stands for inosine
ugccggggcugaugaggccguuaggccgaangagccga

SEQ ID NO: 11227 - RNA, 38 nt, Artificial Sequence
  Description of Artificial Sequence:  Enzymatic Nucleic Acid
  misc_feature (31)..(31): n stands for inosine
gcugccggcugaugaggccguuaggccgaanaggagcc

SEQ ID NO: 11228 - RNA, 38 nt, Artificial Sequence
  Description of Artificial Sequence:  Enzymatic Nucleic Acid
  misc_feature (31)..(31): n stands for inosine
cgcugccgcugaugaggccguuaggccgaangaggagc

SEQ ID NO: 11229 - RNA, 38 nt, Artificial Sequence
  Description of Artificial Sequence:  Enzymatic Nucleic Acid
  misc_feature (31)..(31): n stands for inosine
ccgcugcccugaugaggccguuaggccgaanggaggag

SEQ ID NO: 11230 - RNA, 38 nt, Artificial Sequence
  Description of Artificial Sequence:  Enzymatic Nucleic Acid
  misc_feature (31)..(31): n stands for inosine
gccgccgccugaugaggccguuaggccgaanccgggga

SEQ ID NO: 11231 - RNA, 38 nt, Artificial Sequence
  Description of Artificial Sequence:  Enzymatic Nucleic Acid
  misc_feature (31)..(31): n stands for inosine
ccgcuccgcugaugaggccguuaggccgaanccgccgc

SEQ ID NO: 11232 - RNA, 38 nt, Artificial Sequence
  Description of Artificial Sequence:  Enzymatic Nucleic Acid
  misc_feature (31)..(31): n stands for inosine
agccccggcugaugaggccguuaggccgaancccgcuc

SEQ ID NO: 11233 - RNA, 38 nt, Artificial Sequence
  Description of Artificial Sequence:  Enzymatic Nucleic Acid
  misc_feature (31)..(31): n stands for inosine
cgagcccccugaugaggccguuaggccgaanagcccgc

SEQ ID NO: 11234 - RNA, 38 nt, Artificial Sequence
  Description of Artificial Sequence:  Enzymatic Nucleic Acid
  misc_feature (31)..(31): n stands for inosine
ugcacccgcugaugaggccguuaggccgaanccccgga

SEQ ID NO: 11235 - RNA, 38 nt, Artificial Sequence
  Description of Artificial Sequence:  Enzymatic Nucleic Acid
  misc_feature (31)..(31): n stands for inosine
cuggccgccugaugaggccguuaggccgaancacccga

SEQ ID NO: 11236 - RNA, 38 nt, Artificial Sequence
  Description of Artificial Sequence:  Enzymatic Nucleic Acid
  misc_feature (31)..(31): n stands for inosine
ggcccgcucugaugaggccguuaggccgaanccgcugc

SEQ ID NO: 11237 - RNA, 38 nt, Artificial Sequence
  Description of Artificial Sequence:  Enzymatic Nucleic Acid
  misc_feature (31)..(31): n stands for inosine
aggcccgccugaugaggccguuaggccgaangccgcug

SEQ ID NO: 11238 - RNA, 38 nt, Artificial Sequence
  Description of Artificial Sequence:  Enzymatic Nucleic Acid
  misc_feature (31)..(31): n stands for inosine
cgccgccacugaugaggccguuaggccgaancccgcug

SEQ ID NO: 11239 - RNA, 38 nt, Artificial Sequence
  Description of Artificial Sequence:  Enzymatic Nucleic Acid
  misc_feature (31)..(31): n stands for inosine
ucgccgcccugaugaggccguuaggccgaangcccgcu

SEQ ID NO: 11240 - RNA, 38 nt, Artificial Sequence
  Description of Artificial Sequence:  Enzymatic Nucleic Acid
  misc_feature (31)..(31): n stands for inosine
cuuccccgcugaugaggccguuaggccgaanuaauccu

SEQ ID NO: 11241 - RNA, 38 nt, Artificial Sequence
  Description of Artificial Sequence:  Enzymatic Nucleic Acid
  misc_feature (31)..(31): n stands for inosine
acuucccccugaugaggccguuaggccgaanguaaucc

SEQ ID NO: 11242 - RNA, 38 nt, Artificial Sequence
  Description of Artificial Sequence:  Enzymatic Nucleic Acid
  misc_feature (31)..(31): n stands for inosine
cagccaggcugaugaggccguuaggccgaanacaacca

SEQ ID NO: 11243 - RNA, 38 nt, Artificial Sequence
  Description of Artificial Sequence:  Enzymatic Nucleic Acid
  misc_feature (31)..(31): n stands for inosine
uccagccacugaugaggccguuaggccgaanagacaac

SEQ ID NO: 11244 - RNA, 38 nt, Artificial Sequence
  Description of Artificial Sequence:  Enzymatic Nucleic Acid
  misc_feature (31)..(31): n stands for inosine
cuccagcccugaugaggccguuaggccgaangagacaa

SEQ ID NO: 11245 - RNA, 38 nt, Artificial Sequence
  Description of Artificial Sequence:  Enzymatic Nucleic Acid
  misc_feature (31)..(31): n stands for inosine
gcggcucccugaugaggccguuaggccgaanccaggag

SEQ ID NO: 11246 - RNA, 38 nt, Artificial Sequence
  Description of Artificial Sequence:  Enzymatic Nucleic Acid
  misc_feature (31)..(31): n stands for inosine
cgucucgccugaugaggccguuaggccgaancuccagc

SEQ ID NO: 11247 - RNA, 38 nt, Artificial Sequence
  Description of Artificial Sequence:  Enzymatic Nucleic Acid
  misc_feature (31)..(31): n stands for inosine
gcgcccugcugaugaggccguuaggccgaancgcccgu

SEQ ID NO: 11248 - RNA, 38 nt, Artificial Sequence
  Description of Artificial Sequence:  Enzymatic Nucleic Acid
  misc_feature (31)..(31): n stands for inosine
ccgcgccccugaugaggccguuaggccgaanagcgccc

SEQ ID NO: 11249 - RNA, 38 nt, Artificial Sequence
  Description of Artificial Sequence:  Enzymatic Nucleic Acid
  misc_feature (31)..(31): n stands for inosine
ccgccgcccugaugaggccguuaggccgaanccccgcg

SEQ ID NO: 11250 - RNA, 38 nt, Artificial Sequence
  Description of Artificial Sequence:  Enzymatic Nucleic Acid
  misc_feature (31)..(31): n stands for inosine
gccgccagcugaugaggccguuaggccgaanuccgucc

SEQ ID NO: 11251 - RNA, 38 nt, Artificial Sequence
  Description of Artificial Sequence:  Enzymatic Nucleic Acid
  misc_feature (31)..(31): n stands for inosine
cggccgcccugaugaggccguuaggccgaanaguccgu

SEQ ID NO: 11252 - RNA, 38 nt, Artificial Sequence
  Description of Artificial Sequence:  Enzymatic Nucleic Acid
  misc_feature (31)..(31): n stands for inosine
aacgaccccugaugaggccguuaggccgaanccgccag

SEQ ID NO: 11253 - RNA, 38 nt, Artificial Sequence
  Description of Artificial Sequence:  Enzymatic Nucleic Acid
  misc_feature (31)..(31): n stands for inosine
gcuccccccugaugaggccguuaggccgaanccaacga

SEQ ID NO: 11254 - RNA, 38 nt, Artificial Sequence
  Description of Artificial Sequence:  Enzymatic Nucleic Acid
  misc_feature (31)..(31): n stands for inosine
ucgcccggcugaugaggccguuaggccgaancccgcgc

SEQ ID NO: 11255 - RNA, 38 nt, Artificial Sequence
  Description of Artificial Sequence:  Enzymatic Nucleic Acid
  misc_feature (31)..(31): n stands for inosine
gcucgccccugaugaggccguuaggccgaanugcccgc

SEQ ID NO: 11256 - RNA, 38 nt, Artificial Sequence
  Description of Artificial Sequence:  Enzymatic Nucleic Acid
  misc_feature (31)..(31): n stands for inosine
acgcggcccugaugaggccguuaggccgaancucgccc

SEQ ID NO: 11257 - RNA, 38 nt, Artificial Sequence
  Description of Artificial Sequence:  Enzymatic Nucleic Acid
  misc_feature (31)..(31): n stands for inosine
cgcgacgccugaugaggccguuaggccgaanccugcuc

SEQ ID NO: 11258 - RNA, 38 nt, Artificial Sequence
  Description of Artificial Sequence:  Enzymatic Nucleic Acid
  misc_feature (31)..(31): n stands for inosine
ccauggugcugaugaggccguuaggccgaancgcgacg

SEQ ID NO: 11259 - RNA, 38 nt, Artificial Sequence
  Description of Artificial Sequence:  Enzymatic Nucleic Acid
  misc_feature (31)..(31): n stands for inosine
gaccauggcugaugaggccguuaggccgaanagcgcga

SEQ ID NO: 11260 - RNA, 38 nt, Artificial Sequence
  Description of Artificial Sequence:  Enzymatic Nucleic Acid
  misc_feature (31)..(31): n stands for inosine
cugaccaucugaugaggccguuaggccgaanugagcgc

SEQ ID NO: 11261 - RNA, 38 nt, Artificial Sequence
  Description of Artificial Sequence:  Enzymatic Nucleic Acid
  misc_feature (31)..(31): n stands for inosine
gcugaccacugaugaggccguuaggccgaangugagcg

SEQ ID NO: 11262 - RNA, 38 nt, Artificial Sequence
  Description of Artificial Sequence:  Enzymatic Nucleic Acid
  misc_feature (31)..(31): n stands for inosine
ccaguagccugaugaggccguuaggccgaanaccaugg

SEQ ID NO: 11263 - RNA, 38 nt, Artificial Sequence
  Description of Artificial Sequence:  Enzymatic Nucleic Acid
  misc_feature (31)..(31): n stands for inosine
gucccagucugaugaggccguuaggccgaancugacca

SEQ ID NO: 11264 - RNA, 38 nt, Artificial Sequence
  Description of Artificial Sequence:  Enzymatic Nucleic Acid
  misc_feature (31)..(31): n stands for inosine
gguguccccugaugaggccguuaggccgaanuagcuga

SEQ ID NO: 11265 - RNA, 38 nt, Artificial Sequence
  Description of Artificial Sequence:  Enzymatic Nucleic Acid
  misc_feature (31)..(31): n stands for inosine
gaccccggcugaugaggccguuaggccgaanucccagu

SEQ ID NO: 11266 - RNA, 38 nt, Artificial Sequence
  Description of Artificial Sequence:  Enzymatic Nucleic Acid
  misc_feature (31)..(31): n stands for inosine
aggacccccugaugaggccguuaggccgaanuguccca

SEQ ID NO: 11267 - RNA, 38 nt, Artificial Sequence
  Description of Artificial Sequence:  Enzymatic Nucleic Acid
  misc_feature (31)..(31): n stands for inosine
gcacagcacugaugaggccguuaggccgaanaccccgg

SEQ ID NO: 11268 - RNA, 38 nt, Artificial Sequence
  Description of Artificial Sequence:  Enzymatic Nucleic Acid
  misc_feature (31)..(31): n stands for inosine
cgcacagccugaugaggccguuaggccgaangaccccg

SEQ ID NO: 11269 - RNA, 38 nt, Artificial Sequence
  Description of Artificial Sequence:  Enzymatic Nucleic Acid
  misc_feature (31)..(31): n stands for inosine
gcgcgcaccugaugaggccguuaggccgaancaggacc

SEQ ID NO: 11270 - RNA, 38 nt, Artificial Sequence
  Description of Artificial Sequence:  Enzymatic Nucleic Acid
  misc_feature (31)..(31): n stands for inosine
agcugagccugaugaggccguuaggccgaancgcgcac

SEQ ID NO: 11271 - RNA, 38 nt, Artificial Sequence
  Description of Artificial Sequence:  Enzymatic Nucleic Acid
  misc_feature (31)..(31): n stands for inosine
gacagcugcugaugaggccguuaggccgaancagcgcg

SEQ ID NO: 11272 - RNA, 38 nt, Artificial Sequence
  Description of Artificial Sequence:  Enzymatic Nucleic Acid
  misc_feature (31)..(31): n stands for inosine
cagacagccugaugaggccguuaggccgaanagcagcg

SEQ ID NO: 11273 - RNA, 38 nt, Artificial Sequence
  Description of Artificial Sequence:  Enzymatic Nucleic Acid
  misc_feature (31)..(31): n stands for inosine
aagcagaccugaugaggccguuaggccgaancugagca

SEQ ID NO: 11274 - RNA, 38 nt, Artificial Sequence
  Description of Artificial Sequence:  Enzymatic Nucleic Acid
  misc_feature (31)..(31): n stands for inosine
ugagaagccugaugaggccguuaggccgaanacagcug

SEQ ID NO: 11275 - RNA, 38 nt, Artificial Sequence
  Description of Artificial Sequence:  Enzymatic Nucleic Acid
  misc_feature (31)..(31): n stands for inosine
cugugagacugaugaggccguuaggccgaancagacag

SEQ ID NO: 11276 - RNA, 38 nt, Artificial Sequence
  Description of Artificial Sequence:  Enzymatic Nucleic Acid
  misc_feature (31)..(31): n stands for inosine
auccugugcugaugaggccguuaggccgaanaagcaga

SEQ ID NO: 11277 - RNA, 38 nt, Artificial Sequence
  Description of Artificial Sequence:  Enzymatic Nucleic Acid
  misc_feature (31)..(31): n stands for inosine
agauccugcugaugaggccguuaggccgaanagaagca

SEQ ID NO: 11278 - RNA, 38 nt, Artificial Sequence
  Description of Artificial Sequence:  Enzymatic Nucleic Acid
  misc_feature (31)..(31): n stands for inosine
cuagaucccugaugaggccguuaggccgaanugagaag

SEQ ID NO: 11279 - RNA, 38 nt, Artificial Sequence
  Description of Artificial Sequence:  Enzymatic Nucleic Acid
  misc_feature (31)..(31): n stands for inosine
ccugaacucugaugaggccguuaggccgaanauccugu

SEQ ID NO: 11280 - RNA, 38 nt, Artificial Sequence
  Description of Artificial Sequence:  Enzymatic Nucleic Acid
  misc_feature (31)..(31): n stands for inosine
uuugaacccugaugaggccguuaggccgaanaacuaga

SEQ ID NO: 11281 - RNA, 38 nt, Artificial Sequence
  Description of Artificial Sequence:  Enzymatic Nucleic Acid
  misc_feature (31)..(31): n stands for inosine
uuuaauuucugaugaggccguuaggccgaanaaccuga

SEQ ID NO: 11282 - RNA, 38 nt, Artificial Sequence
  Description of Artificial Sequence:  Enzymatic Nucleic Acid
  misc_feature (31)..(31): n stands for inosine
ucaguucacugaugaggccguuaggccgaanaucuuuu

SEQ ID NO: 11283 - RNA, 38 nt, Artificial Sequence
  Description of Artificial Sequence:  Enzymatic Nucleic Acid
  misc_feature (31)..(31): n stands for inosine
cucaguuccugaugaggccguuaggccgaangaucuuu

SEQ ID NO: 11284 - RNA, 38 nt, Artificial Sequence
  Description of Artificial Sequence:  Enzymatic Nucleic Acid
  misc_feature (31)..(31): n stands for inosine
uuaaacuccugaugaggccguuaggccgaanuucagga

SEQ ID NO: 11285 - RNA, 38 nt, Artificial Sequence
  Description of Artificial Sequence:  Enzymatic Nucleic Acid
  misc_feature (31)..(31): n stands for inosine
gugcugggcugaugaggccguuaggccgaanccuuuua

SEQ ID NO: 11286 - RNA, 38 nt, Artificial Sequence
  Description of Artificial Sequence:  Enzymatic Nucleic Acid
  misc_feature (31)..(31): n stands for inosine
augugcugcugaugaggccguuaggccgaanugccuuu

SEQ ID NO: 11287 - RNA, 38 nt, Artificial Sequence
  Description of Artificial Sequence:  Enzymatic Nucleic Acid
  misc_feature (31)..(31): n stands for inosine
gaugugcucugaugaggccguuaggccgaangugccuu

SEQ ID NO: 11288 - RNA, 38 nt, Artificial Sequence
  Description of Artificial Sequence:  Enzymatic Nucleic Acid
  misc_feature (31)..(31): n stands for inosine
ugaugugccugaugaggccguuaggccgaanggugccu

SEQ ID NO: 11289 - RNA, 38 nt, Artificial Sequence
  Description of Artificial Sequence:  Enzymatic Nucleic Acid
  misc_feature (31)..(31): n stands for inosine
gcaugaugcugaugaggccguuaggccgaancugggug

SEQ ID NO: 11290 - RNA, 38 nt, Artificial Sequence
  Description of Artificial Sequence:  Enzymatic Nucleic Acid
  misc_feature (31)..(31): n stands for inosine
uugcaugacugaugaggccguuaggccgaanugcuggg

SEQ ID NO: 11291 - RNA, 38 nt, Artificial Sequence
  Description of Artificial Sequence:  Enzymatic Nucleic Acid
  misc_feature (31)..(31): n stands for inosine
ugcuugcacugaugaggccguuaggccgaanaugugcu

SEQ ID NO: 11292 - RNA, 38 nt, Artificial Sequence
  Description of Artificial Sequence:  Enzymatic Nucleic Acid
  misc_feature (31)..(31): n stands for inosine
ggccugcucugaugaggccguuaggccgaancaugaug

SEQ ID NO: 11293 - RNA, 38 nt, Artificial Sequence
  Description of Artificial Sequence:  Enzymatic Nucleic Acid
  misc_feature (31)..(31): n stands for inosine
gucuggcccugaugaggccguuaggccgaancuugcau

SEQ ID NO: 11294 - RNA, 38 nt, Artificial Sequence
  Description of Artificial Sequence:  Enzymatic Nucleic Acid
  misc_feature (31)..(31): n stands for inosine
cagugucucugaugaggccguuaggccgaanccugcuu

SEQ ID NO: 11295 - RNA, 38 nt, Artificial Sequence
  Description of Artificial Sequence:  Enzymatic Nucleic Acid
  misc_feature (31)..(31): n stands for inosine
gcaguguccugaugaggccguuaggccgaangccugcu

SEQ ID NO: 11296 - RNA, 38 nt, Artificial Sequence
  Description of Artificial Sequence:  Enzymatic Nucleic Acid
  misc_feature (31)..(31): n stands for inosine
agaugcagcugaugaggccguuaggccgaanucuggcc

SEQ ID NO: 11297 - RNA, 38 nt, Artificial Sequence
  Description of Artificial Sequence:  Enzymatic Nucleic Acid
  misc_feature (31)..(31): n stands for inosine
ggagaugccugaugaggccguuaggccgaanugucugg

SEQ ID NO: 11298 - RNA, 38 nt, Artificial Sequence
  Description of Artificial Sequence:  Enzymatic Nucleic Acid
  misc_feature (31)..(31): n stands for inosine
auuggagacugaugaggccguuaggccgaancaguguc

SEQ ID NO: 11299 - RNA, 38 nt, Artificial Sequence
  Description of Artificial Sequence:  Enzymatic Nucleic Acid
  misc_feature (31)..(31): n stands for inosine
ugcauuggcugaugaggccguuaggccgaanaugcagu

SEQ ID NO: 11300 - RNA, 38 nt, Artificial Sequence
  Description of Artificial Sequence:  Enzymatic Nucleic Acid
  misc_feature (31)..(31): n stands for inosine
ccugcauucugaugaggccguuaggccgaanagaugca

SEQ ID NO: 11301 - RNA, 38 nt, Artificial Sequence
  Description of Artificial Sequence:  Enzymatic Nucleic Acid
  misc_feature (31)..(31): n stands for inosine
cccugcaucugaugaggccguuaggccgaangagaugc

SEQ ID NO: 11302 - RNA, 38 nt, Artificial Sequence
  Description of Artificial Sequence:  Enzymatic Nucleic Acid
  misc_feature (31)..(31): n stands for inosine
uucccccccugaugaggccguuaggccgaancauugga

SEQ ID NO: 11303 - RNA, 38 nt, Artificial Sequence
  Description of Artificial Sequence:  Enzymatic Nucleic Acid
  misc_feature (31)..(31): n stands for inosine
uuaugggccugaugaggccguuaggccgaancuucccc

SEQ ID NO: 11304 - RNA, 38 nt, Artificial Sequence
  Description of Artificial Sequence:  Enzymatic Nucleic Acid
  misc_feature (31)..(31): n stands for inosine
cauuuaugcugaugaggccguuaggccgaancugcuuc

SEQ ID NO: 11305 - RNA, 38 nt, Artificial Sequence
  Description of Artificial Sequence:  Enzymatic Nucleic Acid
  misc_feature (31)..(31): n stands for inosine
ccauuuaucugaugaggccguuaggccgaangcugcuu

SEQ ID NO: 11306 - RNA, 38 nt, Artificial Sequence
  Description of Artificial Sequence:  Enzymatic Nucleic Acid
  misc_feature (31)..(31): n stands for inosine
accauuuacugaugaggccguuaggccgaanggcugcu

SEQ ID NO: 11307 - RNA, 38 nt, Artificial Sequence
  Description of Artificial Sequence:  Enzymatic Nucleic Acid
  misc_feature (31)..(31): n stands for inosine
ucaggcaacugaugaggccguuaggccgaanaccauuu

SEQ ID NO: 11308 - RNA, 38 nt, Artificial Sequence
  Description of Artificial Sequence:  Enzymatic Nucleic Acid
  misc_feature (31)..(31): n stands for inosine
ccauuucacugaugaggccguuaggccgaancaaagac

SEQ ID NO: 11309 - RNA, 38 nt, Artificial Sequence
  Description of Artificial Sequence:  Enzymatic Nucleic Acid
  misc_feature (31)..(31): n stands for inosine
accauuuccugaugaggccguuaggccgaangcaaaga

SEQ ID NO: 11310 - RNA, 38 nt, Artificial Sequence
  Description of Artificial Sequence:  Enzymatic Nucleic Acid
  misc_feature (31)..(31): n stands for inosine
uuaugcuccugaugaggccguuaggccgaanccuuucg

SEQ ID NO: 11311 - RNA, 38 nt, Artificial Sequence
  Description of Artificial Sequence:  Enzymatic Nucleic Acid
  misc_feature (31)..(31): n stands for inosine
uuuaguuacugaugaggccguuaggccgaancucagcc

SEQ ID NO: 11312 - RNA, 38 nt, Artificial Sequence
  Description of Artificial Sequence:  Enzymatic Nucleic Acid
  misc_feature (31)..(31): n stands for inosine
gcagauuucugaugaggccguuaggccgaanuuaugcu

SEQ ID NO: 11313 - RNA, 38 nt, Artificial Sequence
  Description of Artificial Sequence:  Enzymatic Nucleic Acid
  misc_feature (31)..(31): n stands for inosine
ccacaggccugaugaggccguuaggccgaanauuuagu

SEQ ID NO: 11314 - RNA, 38 nt, Artificial Sequence
  Description of Artificial Sequence:  Enzymatic Nucleic Acid
  misc_feature (31)..(31): n stands for inosine
cuuccacacugaugaggccguuaggccgaancagauuu

SEQ ID NO: 11315 - RNA, 38 nt, Artificial Sequence
  Description of Artificial Sequence:  Enzymatic Nucleic Acid
  misc_feature (31)..(31): n stands for inosine
ucuuccaccugaugaggccguuaggccgaangcagauu

SEQ ID NO: 11316 - RNA, 38 nt, Artificial Sequence
  Description of Artificial Sequence:  Enzymatic Nucleic Acid
  misc_feature (31)..(31): n stands for inosine
gaauuguucugaugaggccguuaggccgaanccauuuc

SEQ ID NO: 11317 - RNA, 38 nt, Artificial Sequence
  Description of Artificial Sequence:  Enzymatic Nucleic Acid
  misc_feature (31)..(31): n stands for inosine
ugcagaaucugaugaggccguuaggccgaanuuugcca

SEQ ID NO: 11318 - RNA, 38 nt, Artificial Sequence
  Description of Artificial Sequence:  Enzymatic Nucleic Acid
  misc_feature (31)..(31): n stands for inosine
aguacugccugaugaggccguuaggccgaanaauuguu

SEQ ID NO: 11319 - RNA, 38 nt, Artificial Sequence
  Description of Artificial Sequence:  Enzymatic Nucleic Acid
  misc_feature (31)..(31): n stands for inosine
uaaaguaccugaugaggccguuaggccgaancagaauu

SEQ ID NO: 11320 - RNA, 38 nt, Artificial Sequence
  Description of Artificial Sequence:  Enzymatic Nucleic Acid
  misc_feature (31)..(31): n stands for inosine
aagguuaacugaugaggccguuaggccgaanuacugca

SEQ ID NO: 11321 - RNA, 38 nt, Artificial Sequence
  Description of Artificial Sequence:  Enzymatic Nucleic Acid
  misc_feature (31)..(31): n stands for inosine
guguucaacugaugaggccguuaggccgaanuuaaagu

SEQ ID NO: 11322 - RNA, 38 nt, Artificial Sequence
  Description of Artificial Sequence:  Enzymatic Nucleic Acid
  misc_feature (31)..(31): n stands for inosine
uguguucacugaugaggccguuaggccgaanguuaaag

SEQ ID NO: 11323 - RNA, 38 nt, Artificial Sequence
  Description of Artificial Sequence:  Enzymatic Nucleic Acid
  misc_feature (31)..(31): n stands for inosine
uugagcugcugaugaggccguuaggccgaanuucaagg

SEQ ID NO: 11324 - RNA, 38 nt, Artificial Sequence
  Description of Artificial Sequence:  Enzymatic Nucleic Acid
  misc_feature (31)..(31): n stands for inosine
gcuugagccugaugaggccguuaggccgaanuguucaa

SEQ ID NO: 11325 - RNA, 38 nt, Artificial Sequence
  Description of Artificial Sequence:  Enzymatic Nucleic Acid
  misc_feature (31)..(31): n stands for inosine
uuugcuugcugaugaggccguuaggccgaancuguguu

SEQ ID NO: 11326 - RNA, 38 nt, Artificial Sequence
  Description of Artificial Sequence:  Enzymatic Nucleic Acid
  misc_feature (31)..(31): n stands for inosine
gguuugcucugaugaggccguuaggccgaanagcugug

SEQ ID NO: 11327 - RNA, 38 nt, Artificial Sequence
  Description of Artificial Sequence:  Enzymatic Nucleic Acid
  misc_feature (31)..(31): n stands for inosine
gugugguucugaugaggccguuaggccgaancuugagc

SEQ ID NO: 11328 - RNA, 38 nt, Artificial Sequence
  Description of Artificial Sequence:  Enzymatic Nucleic Acid
  misc_feature (31)..(31): n stands for inosine
gccagugucugaugaggccguuaggccgaanuuugcuu

SEQ ID NO: 11329 - RNA, 38 nt, Artificial Sequence
  Description of Artificial Sequence:  Enzymatic Nucleic Acid
  misc_feature (31)..(31): n stands for inosine
agccagugcugaugaggccguuaggccgaanguuugcu

SEQ ID NO: 11330 - RNA, 38 nt, Artificial Sequence
  Description of Artificial Sequence:  Enzymatic Nucleic Acid
  misc_feature (31)..(31): n stands for inosine
gaagccagcugaugaggccguuaggccgaanugguuug

SEQ ID NO: 11331 - RNA, 38 nt, Artificial Sequence
  Description of Artificial Sequence:  Enzymatic Nucleic Acid
  misc_feature (31)..(31): n stands for inosine
uagaagcccugaugaggccguuaggccgaanugugguu

SEQ ID NO: 11332 - RNA, 38 nt, Artificial Sequence
  Description of Artificial Sequence:  Enzymatic Nucleic Acid
  misc_feature (31)..(31): n stands for inosine
gcuguagacugaugaggccguuaggccgaanccagugu

SEQ ID NO: 11333 - RNA, 38 nt, Artificial Sequence
  Description of Artificial Sequence:  Enzymatic Nucleic Acid
  misc_feature (31)..(31): n stands for inosine
gcagcugucugaugaggccguuaggccgaanaagccag

SEQ ID NO: 11334 - RNA, 38 nt, Artificial Sequence
  Description of Artificial Sequence:  Enzymatic Nucleic Acid
  misc_feature (31)..(31): n stands for inosine
uuugcagccugaugaggccguuaggccgaanuagaagc

SEQ ID NO: 11335 - RNA, 38 nt, Artificial Sequence
  Description of Artificial Sequence:  Enzymatic Nucleic Acid
  misc_feature (31)..(31): n stands for inosine
auauuugccugaugaggccguuaggccgaancuguaga

SEQ ID NO: 11336 - RNA, 38 nt, Artificial Sequence
  Description of Artificial Sequence:  Enzymatic Nucleic Acid
  misc_feature (31)..(31): n stands for inosine
uagauauucugaugaggccguuaggccgaancagcugu

SEQ ID NO: 11337 - RNA, 38 nt, Artificial Sequence
  Description of Artificial Sequence:  Enzymatic Nucleic Acid
  misc_feature (31)..(31): n stands for inosine
guacagcucugaugaggccguuaggccgaanauauuug

SEQ ID NO: 11338 - RNA, 38 nt, Artificial Sequence
  Description of Artificial Sequence:  Enzymatic Nucleic Acid
  misc_feature (31)..(31): n stands for inosine
guagguaccugaugaggccguuaggccgaancuagaua

SEQ ID NO: 11339 - RNA, 38 nt, Artificial Sequence
  Description of Artificial Sequence:  Enzymatic Nucleic Acid
  misc_feature (31)..(31): n stands for inosine
uugaaguacugaugaggccguuaggccgaanuacagcu

SEQ ID NO: 11340 - RNA, 38 nt, Artificial Sequence
  Description of Artificial Sequence:  Enzymatic Nucleic Acid
  misc_feature (31)..(31): n stands for inosine
uuugaagucugaugaggccguuaggccgaanguacagc

SEQ ID NO: 11341 - RNA, 38 nt, Artificial Sequence
  Description of Artificial Sequence:  Enzymatic Nucleic Acid
  misc_feature (31)..(31): n stands for inosine
uucuuugacugaugaggccguuaggccgaanuagguac

SEQ ID NO: 11342 - RNA, 38 nt, Artificial Sequence
  Description of Artificial Sequence:  Enzymatic Nucleic Acid
  misc_feature (31)..(31): n stands for inosine
uucuucuucugaugaggccguuaggccgaanaaguagg

SEQ ID NO: 11343 - RNA, 38 nt, Artificial Sequence
  Description of Artificial Sequence:  Enzymatic Nucleic Acid
  misc_feature (31)..(31): n stands for inosine
gcagauuccugaugaggccguuaggccgaanuuuccuu

SEQ ID NO: 11344 - RNA, 38 nt, Artificial Sequence
  Description of Artificial Sequence:  Enzymatic Nucleic Acid
  misc_feature (31)..(31): n stands for inosine
uagauugccugaugaggccguuaggccgaanauucugu

SEQ ID NO: 11345 - RNA, 38 nt, Artificial Sequence
  Description of Artificial Sequence:  Enzymatic Nucleic Acid
  misc_feature (31)..(31): n stands for inosine
auauagaucugaugaggccguuaggccgaancagauuc

SEQ ID NO: 11346 - RNA, 38 nt, Artificial Sequence
  Description of Artificial Sequence:  Enzymatic Nucleic Acid
  misc_feature (31)..(31): n stands for inosine
aaauauaucugaugaggccguuaggccgaanauugcag

SEQ ID NO: 11347 - RNA, 38 nt, Artificial Sequence
  Description of Artificial Sequence:  Enzymatic Nucleic Acid
  misc_feature (31)..(31): n stands for inosine
ggucuacccugaugaggccguuaggccgaanuaucacu

SEQ ID NO: 11348 - RNA, 38 nt, Artificial Sequence
  Description of Artificial Sequence:  Enzymatic Nucleic Acid
  misc_feature (31)..(31): n stands for inosine
cuacgaaacugaugaggccguuaggccgaanucuaccu

SEQ ID NO: 11349 - RNA, 38 nt, Artificial Sequence
  Description of Artificial Sequence:  Enzymatic Nucleic Acid
  misc_feature (31)..(31): n stands for inosine
ucuacgaacugaugaggccguuaggccgaangucuacc

SEQ ID NO: 11350 - RNA, 38 nt, Artificial Sequence
  Description of Artificial Sequence:  Enzymatic Nucleic Acid
  misc_feature (31)..(31): n stands for inosine
gauuucaccugaugaggccguuaggccgaanuacaucu

SEQ ID NO: 11351 - RNA, 38 nt, Artificial Sequence
  Description of Artificial Sequence:  Enzymatic Nucleic Acid
  misc_feature (31)..(31): n stands for inosine
aauuucggcugaugaggccguuaggccgaanauuucac

SEQ ID NO: 11352 - RNA, 38 nt, Artificial Sequence
  Description of Artificial Sequence:  Enzymatic Nucleic Acid
  misc_feature (31)..(31): n stands for inosine
uaauuucgcugaugaggccguuaggccgaangauuuca

SEQ ID NO: 11353 - RNA, 38 nt, Artificial Sequence
  Description of Artificial Sequence:  Enzymatic Nucleic Acid
  misc_feature (31)..(31): n stands for inosine
auaauuuccugaugaggccguuaggccgaanggauuuc

SEQ ID NO: 11354 - RNA, 38 nt, Artificial Sequence
  Description of Artificial Sequence:  Enzymatic Nucleic Acid
  misc_feature (31)..(31): n stands for inosine
cagucaugcugaugaggccguuaggccgaanuauaauu

SEQ ID NO: 11355 - RNA, 38 nt, Artificial Sequence
  Description of Artificial Sequence:  Enzymatic Nucleic Acid
  misc_feature (31)..(31): n stands for inosine
uucagucacugaugaggccguuaggccgaanuguauaa

SEQ ID NO: 11356 - RNA, 38 nt, Artificial Sequence
  Description of Artificial Sequence:  Enzymatic Nucleic Acid
  misc_feature (31)..(31): n stands for inosine
cuuccuuccugaugaggccguuaggccgaanucaugug

SEQ ID NO: 11357 - RNA, 38 nt, Artificial Sequence
  Description of Artificial Sequence:  Enzymatic Nucleic Acid
  misc_feature (31)..(31): n stands for inosine
gaaugacgcugaugaggccguuaggccgaancucccuu

SEQ ID NO: 11358 - RNA, 38 nt, Artificial Sequence
  Description of Artificial Sequence:  Enzymatic Nucleic Acid
  misc_feature (31)..(31): n stands for inosine
gcagggaacugaugaggccguuaggccgaanacgagcu

SEQ ID NO: 11359 - RNA, 38 nt, Artificial Sequence
  Description of Artificial Sequence:  Enzymatic Nucleic Acid
  misc_feature (31)..(31): n stands for inosine
cccggcagcugaugaggccguuaggccgaanaaugacg

SEQ ID NO: 11360 - RNA, 38 nt, Artificial Sequence
  Description of Artificial Sequence:  Enzymatic Nucleic Acid
  misc_feature (31)..(31): n stands for inosine
acccggcacugaugaggccguuaggccgaangaaugac

SEQ ID NO: 11361 - RNA, 38 nt, Artificial Sequence
  Description of Artificial Sequence:  Enzymatic Nucleic Acid
  misc_feature (31)..(31): n stands for inosine
aacccggccugaugaggccguuaggccgaanggaauga

SEQ ID NO: 11362 - RNA, 38 nt, Artificial Sequence
  Description of Artificial Sequence:  Enzymatic Nucleic Acid
  misc_feature (31)..(31): n stands for inosine
cguaaccccugaugaggccguuaggccgaancagggaa

SEQ ID NO: 11363 - RNA, 38 nt, Artificial Sequence
  Description of Artificial Sequence:  Enzymatic Nucleic Acid
  misc_feature (31)..(31): n stands for inosine
auguuaggcugaugaggccguuaggccgaanacguaac

SEQ ID NO: 11364 - RNA, 38 nt, Artificial Sequence
  Description of Artificial Sequence:  Enzymatic Nucleic Acid
  misc_feature (31)..(31): n stands for inosine
ugauguuacugaugaggccguuaggccgaanugacgua

SEQ ID NO: 11365 - RNA, 38 nt, Artificial Sequence
  Description of Artificial Sequence:  Enzymatic Nucleic Acid
  misc_feature (31)..(31): n stands for inosine
gugauguucugaugaggccguuaggccgaangugacgu

SEQ ID NO: 11366 - RNA, 38 nt, Artificial Sequence
  Description of Artificial Sequence:  Enzymatic Nucleic Acid
  misc_feature (31)..(31): n stands for inosine
aacagugacugaugaggccguuaggccgaanuuaggug

SEQ ID NO: 11367 - RNA, 38 nt, Artificial Sequence
  Description of Artificial Sequence:  Enzymatic Nucleic Acid
  misc_feature (31)..(31): n stands for inosine
aguaacagcugaugaggccguuaggccgaanauguuag

SEQ ID NO: 11368 - RNA, 38 nt, Artificial Sequence
  Description of Artificial Sequence:  Enzymatic Nucleic Acid
  misc_feature (31)..(31): n stands for inosine
aaaguaaccugaugaggccguuaggccgaanugauguu

SEQ ID NO: 11369 - RNA, 38 nt, Artificial Sequence
  Description of Artificial Sequence:  Enzymatic Nucleic Acid
  misc_feature (31)..(31): n stands for inosine
uuuuuuaacugaugaggccguuaggccgaanuaacagu

SEQ ID NO: 11370 - RNA, 38 nt, Artificial Sequence
  Description of Artificial Sequence:  Enzymatic Nucleic Acid
  misc_feature (31)..(31): n stands for inosine
ugucaagucugaugaggccguuaggccgaanaaacuuu

SEQ ID NO: 11371 - RNA, 38 nt, Artificial Sequence
  Description of Artificial Sequence:  Enzymatic Nucleic Acid
  misc_feature (31)..(31): n stands for inosine
gugucaagcugaugaggccguuaggccgaangaaacuu

SEQ ID NO: 11372 - RNA, 38 nt, Artificial Sequence
  Description of Artificial Sequence:  Enzymatic Nucleic Acid
  misc_feature (31)..(31): n stands for inosine
aagugucacugaugaggccguuaggccgaanuggaaac

SEQ ID NO: 11373 - RNA, 38 nt, Artificial Sequence
  Description of Artificial Sequence:  Enzymatic Nucleic Acid
  misc_feature (31)..(31): n stands for inosine
gaucaaagcugaugaggccguuaggccgaanucaagug

SEQ ID NO: 11374 - RNA, 38 nt, Artificial Sequence
  Description of Artificial Sequence:  Enzymatic Nucleic Acid
  misc_feature (31)..(31): n stands for inosine
gggaucaacugaugaggccguuaggccgaanugucaag

SEQ ID NO: 11375 - RNA, 38 nt, Artificial Sequence
  Description of Artificial Sequence:  Enzymatic Nucleic Acid
  misc_feature (31)..(31): n stands for inosine
uccaucagcugaugaggccguuaggccgaanaucaaag

SEQ ID NO: 11376 - RNA, 38 nt, Artificial Sequence
  Description of Artificial Sequence:  Enzymatic Nucleic Acid
  misc_feature (31)..(31): n stands for inosine
uuccaucacugaugaggccguuaggccgaangaucaaa

SEQ ID NO: 11377 - RNA, 38 nt, Artificial Sequence
  Description of Artificial Sequence:  Enzymatic Nucleic Acid
  misc_feature (31)..(31): n stands for inosine
uuuccauccugaugaggccguuaggccgaanggaucaa

SEQ ID NO: 11378 - RNA, 38 nt, Artificial Sequence
  Description of Artificial Sequence:  Enzymatic Nucleic Acid
  misc_feature (31)..(31): n stands for inosine
ccagauuacugaugaggccguuaggccgaancguuuuc

SEQ ID NO: 11379 - RNA, 38 nt, Artificial Sequence
  Description of Artificial Sequence:  Enzymatic Nucleic Acid
  misc_feature (31)..(31): n stands for inosine
acuguccccugaugaggccguuaggccgaanauuaugc

SEQ ID NO: 11380 - RNA, 38 nt, Artificial Sequence
  Description of Artificial Sequence:  Enzymatic Nucleic Acid
  misc_feature (31)..(31): n stands for inosine
cuuucuaccugaugaggccguuaggccgaanucccaga

SEQ ID NO: 11381 - RNA, 38 nt, Artificial Sequence
  Description of Artificial Sequence:  Enzymatic Nucleic Acid
  misc_feature (31)..(31): n stands for inosine
uaugaugacugaugaggccguuaggccgaancccuuuc

SEQ ID NO: 11382 - RNA, 38 nt, Artificial Sequence
  Description of Artificial Sequence:  Enzymatic Nucleic Acid
  misc_feature (31)..(31): n stands for inosine
ugauaugacugaugaggccguuaggccgaanaagcccu

SEQ ID NO: 11383 - RNA, 38 nt, Artificial Sequence
  Description of Artificial Sequence:  Enzymatic Nucleic Acid
  misc_feature (31)..(31): n stands for inosine
auuugauacugaugaggccguuaggccgaanaugaagc

SEQ ID NO: 11384 - RNA, 38 nt, Artificial Sequence
  Description of Artificial Sequence:  Enzymatic Nucleic Acid
  misc_feature (31)..(31): n stands for inosine
guugcauucugaugaggccguuaggccgaanauaugau

SEQ ID NO: 11385 - RNA, 38 nt, Artificial Sequence
  Description of Artificial Sequence:  Enzymatic Nucleic Acid
  misc_feature (31)..(31): n stands for inosine
uuguacgucugaugaggccguuaggccgaancauuuga

SEQ ID NO: 11386 - RNA, 38 nt, Artificial Sequence
  Description of Artificial Sequence:  Enzymatic Nucleic Acid
  misc_feature (31)..(31): n stands for inosine
uauuucuucugaugaggccguuaggccgaanuacguug

SEQ ID NO: 11387 - RNA, 38 nt, Artificial Sequence
  Description of Artificial Sequence:  Enzymatic Nucleic Acid
  misc_feature (31)..(31): n stands for inosine
aggucagacugaugaggccguuaggccgaancccuauu

SEQ ID NO: 11388 - RNA, 38 nt, Artificial Sequence
  Description of Artificial Sequence:  Enzymatic Nucleic Acid
  misc_feature (31)..(31): n stands for inosine
cacagguccugaugaggccguuaggccgaanaagcccu

SEQ ID NO: 11389 - RNA, 38 nt, Artificial Sequence
  Description of Artificial Sequence:  Enzymatic Nucleic Acid
  misc_feature (31)..(31): n stands for inosine
gcuucacacugaugaggccguuaggccgaanucagaag

SEQ ID NO: 11390 - RNA, 38 nt, Artificial Sequence
  Description of Artificial Sequence:  Enzymatic Nucleic Acid
  misc_feature (31)..(31): n stands for inosine
ugcuucaccugaugaggccguuaggccgaangucagaa

SEQ ID NO: 11391 - RNA, 38 nt, Artificial Sequence
  Description of Artificial Sequence:  Enzymatic Nucleic Acid
  misc_feature (31)..(31): n stands for inosine
uugacugucugaugaggccguuaggccgaancuucaca

SEQ ID NO: 11392 - RNA, 38 nt, Artificial Sequence
  Description of Artificial Sequence:  Enzymatic Nucleic Acid
  misc_feature (31)..(31): n stands for inosine
ccauugaccugaugaggccguuaggccgaanuugcuuc

SEQ ID NO: 11393 - RNA, 38 nt, Artificial Sequence
  Description of Artificial Sequence:  Enzymatic Nucleic Acid
  misc_feature (31)..(31): n stands for inosine
augcccaucugaugaggccguuaggccgaanacuguug

SEQ ID NO: 11394 - RNA, 38 nt, Artificial Sequence
  Description of Artificial Sequence:  Enzymatic Nucleic Acid
  misc_feature (31)..(31): n stands for inosine
uauacaaacugaugaggccguuaggccgaancccauug

SEQ ID NO: 11395 - RNA, 38 nt, Artificial Sequence
  Description of Artificial Sequence:  Enzymatic Nucleic Acid
  misc_feature (31)..(31): n stands for inosine
agauaguucugaugaggccguuaggccgaanucuuaua

SEQ ID NO: 11396 - RNA, 38 nt, Artificial Sequence
  Description of Artificial Sequence:  Enzymatic Nucleic Acid
  misc_feature (31)..(31): n stands for inosine
ugugagaucugaugaggccguuaggccgaanuuugucu

SEQ ID NO: 11397 - RNA, 38 nt, Artificial Sequence
  Description of Artificial Sequence:  Enzymatic Nucleic Acid
  misc_feature (31)..(31): n stands for inosine
gaugugugcugaugaggccguuaggccgaanauaguuu

SEQ ID NO: 11398 - RNA, 38 nt, Artificial Sequence
  Description of Artificial Sequence:  Enzymatic Nucleic Acid
  misc_feature (31)..(31): n stands for inosine
ucgaugugcugaugaggccguuaggccgaanagauagu

SEQ ID NO: 11399 - RNA, 38 nt, Artificial Sequence
  Description of Artificial Sequence:  Enzymatic Nucleic Acid
  misc_feature (31)..(31): n stands for inosine
ugucgaugcugaugaggccguuaggccgaanugagaua

SEQ ID NO: 11400 - RNA, 38 nt, Artificial Sequence
  Description of Artificial Sequence:  Enzymatic Nucleic Acid
  misc_feature (31)..(31): n stands for inosine
uuugucgacugaugaggccguuaggccgaanugugaga

SEQ ID NO: 11401 - RNA, 38 nt, Artificial Sequence
  Description of Artificial Sequence:  Enzymatic Nucleic Acid
  misc_feature (31)..(31): n stands for inosine
uauugguucugaugaggccguuaggccgaanucgaugu

SEQ ID NO: 11402 - RNA, 38 nt, Artificial Sequence
  Description of Artificial Sequence:  Enzymatic Nucleic Acid
  misc_feature (31)..(31): n stands for inosine
auuguauucugaugaggccguuaggccgaanuuugucg

SEQ ID NO: 11403 - RNA, 38 nt, Artificial Sequence
  Description of Artificial Sequence:  Enzymatic Nucleic Acid
  misc_feature (31)..(31): n stands for inosine
gauuguaucugaugaggccguuaggccgaanguuuguc

SEQ ID NO: 11404 - RNA, 38 nt, Artificial Sequence
  Description of Artificial Sequence:  Enzymatic Nucleic Acid
  misc_feature (31)..(31): n stands for inosine
ucuaugaucugaugaggccguuaggccgaanuauuggu

SEQ ID NO: 11405 - RNA, 38 nt, Artificial Sequence
  Description of Artificial Sequence:  Enzymatic Nucleic Acid
  misc_feature (31)..(31): n stands for inosine
gacaucuacugaugaggccguuaggccgaanauuguau

SEQ ID NO: 11406 - RNA, 38 nt, Artificial Sequence
  Description of Artificial Sequence:  Enzymatic Nucleic Acid
  misc_feature (31)..(31): n stands for inosine
gcuuauuucugaugaggccguuaggccgaanacaucua

SEQ ID NO: 11407 - RNA, 38 nt, Artificial Sequence
  Description of Artificial Sequence:  Enzymatic Nucleic Acid
  misc_feature (31)..(31): n stands for inosine
ugcuuauucugaugaggccguuaggccgaangacaucu

SEQ ID NO: 11408 - RNA, 38 nt, Artificial Sequence
  Description of Artificial Sequence:  Enzymatic Nucleic Acid
  misc_feature (31)..(31): n stands for inosine
gcguggugcugaugaggccguuaggccgaancuuauuu

SEQ ID NO: 11409 - RNA, 38 nt, Artificial Sequence
  Description of Artificial Sequence:  Enzymatic Nucleic Acid
  misc_feature (31)..(31): n stands for inosine
gggcguggcugaugaggccguuaggccgaanugcuuau

SEQ ID NO: 11410 - RNA, 38 nt, Artificial Sequence
  Description of Artificial Sequence:  Enzymatic Nucleic Acid
  misc_feature (31)..(31): n stands for inosine
cugggcgucugaugaggccguuaggccgaanugugcuu

SEQ ID NO: 11411 - RNA, 38 nt, Artificial Sequence
  Description of Artificial Sequence:  Enzymatic Nucleic Acid
  misc_feature (31)..(31): n stands for inosine
acugggcgcugaugaggccguuaggccgaangugugcu

SEQ ID NO: 11412 - RNA, 38 nt, Artificial Sequence
  Description of Artificial Sequence:  Enzymatic Nucleic Acid
  misc_feature (31)..(31): n stands for inosine
uuugacugcugaugaggccguuaggccgaancguggug

SEQ ID NO: 11413 - RNA, 38 nt, Artificial Sequence
  Description of Artificial Sequence:  Enzymatic Nucleic Acid
  misc_feature (31)..(31): n stands for inosine
auuugacucugaugaggccguuaggccgaangcguggu

SEQ ID NO: 11414 - RNA, 38 nt, Artificial Sequence
  Description of Artificial Sequence:  Enzymatic Nucleic Acid
  misc_feature (31)..(31): n stands for inosine
aauuugaccugaugaggccguuaggccgaanggcgugg

SEQ ID NO: 11415 - RNA, 38 nt, Artificial Sequence
  Description of Artificial Sequence:  Enzymatic Nucleic Acid
  misc_feature (31)..(31): n stands for inosine
aaguaauucugaugaggccguuaggccgaanacugggc

SEQ ID NO: 11416 - RNA, 38 nt, Artificial Sequence
  Description of Artificial Sequence:  Enzymatic Nucleic Acid
  misc_feature (31)..(31): n stands for inosine
ggccucuacugaugaggccguuaggccgaanuaauuug

SEQ ID NO: 11417 - RNA, 38 nt, Artificial Sequence
  Description of Artificial Sequence:  Enzymatic Nucleic Acid
  misc_feature (31)..(31): n stands for inosine
aagaguaucugaugaggccguuaggccgaanccucuaa

SEQ ID NO: 11418 - RNA, 38 nt, Artificial Sequence
  Description of Artificial Sequence:  Enzymatic Nucleic Acid
  misc_feature (31)..(31): n stands for inosine
caagaguacugaugaggccguuaggccgaangccucua

SEQ ID NO: 11419 - RNA, 38 nt, Artificial Sequence
  Description of Artificial Sequence:  Enzymatic Nucleic Acid
  misc_feature (31)..(31): n stands for inosine
aggacaagcugaugaggccguuaggccgaanuauggcc

SEQ ID NO: 11420 - RNA, 38 nt, Artificial Sequence
  Description of Artificial Sequence:  Enzymatic Nucleic Acid
  misc_feature (31)..(31): n stands for inosine
ugaggacacugaugaggccguuaggccgaanaguaugg

SEQ ID NO: 11421 - RNA, 38 nt, Artificial Sequence
  Description of Artificial Sequence:  Enzymatic Nucleic Acid
  misc_feature (31)..(31): n stands for inosine
acaauugacugaugaggccguuaggccgaanacaagag

SEQ ID NO: 11422 - RNA, 38 nt, Artificial Sequence
  Description of Artificial Sequence:  Enzymatic Nucleic Acid
  misc_feature (31)..(31): n stands for inosine
uacaauugcugaugaggccguuaggccgaangacaaga

SEQ ID NO: 11423 - RNA, 38 nt, Artificial Sequence
  Description of Artificial Sequence:  Enzymatic Nucleic Acid
  misc_feature (31)..(31): n stands for inosine
aguacaaucugaugaggccguuaggccgaanaggacaa

SEQ ID NO: 11424 - RNA, 38 nt, Artificial Sequence
  Description of Artificial Sequence:  Enzymatic Nucleic Acid
  misc_feature (31)..(31): n stands for inosine
gugguagccugaugaggccguuaggccgaanuacaauu

SEQ ID NO: 11425 - RNA, 38 nt, Artificial Sequence
  Description of Artificial Sequence:  Enzymatic Nucleic Acid
  misc_feature (31)..(31): n stands for inosine
ggaguggucugaugaggccguuaggccgaancaguaca

SEQ ID NO: 11426 - RNA, 38 nt, Artificial Sequence
  Description of Artificial Sequence:  Enzymatic Nucleic Acid
  misc_feature (31)..(31): n stands for inosine
aagggagucugaugaggccguuaggccgaanuagcagu

SEQ ID NO: 11427 - RNA, 38 nt, Artificial Sequence
  Description of Artificial Sequence:  Enzymatic Nucleic Acid
  misc_feature (31)..(31): n stands for inosine
caagggagcugaugaggccguuaggccgaanguagcag

SEQ ID NO: 11428 - RNA, 38 nt, Artificial Sequence
  Description of Artificial Sequence:  Enzymatic Nucleic Acid
  misc_feature (31)..(31): n stands for inosine
uucaagggcugaugaggccguuaggccgaanugguagc

SEQ ID NO: 11429 - RNA, 38 nt, Artificial Sequence
  Description of Artificial Sequence:  Enzymatic Nucleic Acid
  misc_feature (31)..(31): n stands for inosine
uguucaagcugaugaggccguuaggccgaanaguggua

SEQ ID NO: 11430 - RNA, 38 nt, Artificial Sequence
  Description of Artificial Sequence:  Enzymatic Nucleic Acid
  misc_feature (31)..(31): n stands for inosine
guguucaacugaugaggccguuaggccgaangaguggu

SEQ ID NO: 11431 - RNA, 38 nt, Artificial Sequence
  Description of Artificial Sequence:  Enzymatic Nucleic Acid
  misc_feature (31)..(31): n stands for inosine
cguguucacugaugaggccguuaggccgaanggagugg

SEQ ID NO: 11432 - RNA, 38 nt, Artificial Sequence
  Description of Artificial Sequence:  Enzymatic Nucleic Acid
  misc_feature (31)..(31): n stands for inosine
aacucucgcugaugaggccguuaggccgaanuucaagg

SEQ ID NO: 11433 - RNA, 38 nt, Artificial Sequence
  Description of Artificial Sequence:  Enzymatic Nucleic Acid
  misc_feature (31)..(31): n stands for inosine
aggucauucugaugaggccguuaggccgaanaacucuc

SEQ ID NO: 11434 - RNA, 38 nt, Artificial Sequence
  Description of Artificial Sequence:  Enzymatic Nucleic Acid
  misc_feature (31)..(31): n stands for inosine
uaacuccacugaugaggccguuaggccgaanucauuug

SEQ ID NO: 11435 - RNA, 38 nt, Artificial Sequence
  Description of Artificial Sequence:  Enzymatic Nucleic Acid
  misc_feature (31)..(31): n stands for inosine
guaacucccugaugaggccguuaggccgaangucauuu

SEQ ID NO: 11436 - RNA, 38 nt, Artificial Sequence
  Description of Artificial Sequence:  Enzymatic Nucleic Acid
  misc_feature (31)..(31): n stands for inosine
uucaucagcugaugaggccguuaggccgaanuaacucc

SEQ ID NO: 11437 - RNA, 38 nt, Artificial Sequence
  Description of Artificial Sequence:  Enzymatic Nucleic Acid
  misc_feature (31)..(31): n stands for inosine
uuucaucacugaugaggccguuaggccgaanguaacuc

SEQ ID NO: 11438 - RNA, 38 nt, Artificial Sequence
  Description of Artificial Sequence:  Enzymatic Nucleic Acid
  misc_feature (31)..(31): n stands for inosine
uuuucauccugaugaggccguuaggccgaangguaacu

SEQ ID NO: 11439 - RNA, 38 nt, Artificial Sequence
  Description of Artificial Sequence:  Enzymatic Nucleic Acid
  misc_feature (31)..(31): n stands for inosine
cuuacggacugaugaggccguuaggccgaancucucuu

SEQ ID NO: 11440 - RNA, 38 nt, Artificial Sequence
  Description of Artificial Sequence:  Enzymatic Nucleic Acid
  misc_feature (31)..(31): n stands for inosine
cgccuuaccugaugaggccguuaggccgaanaagcucu

SEQ ID NO: 11441 - RNA, 38 nt, Artificial Sequence
  Description of Artificial Sequence:  Enzymatic Nucleic Acid
  misc_feature (31)..(31): n stands for inosine
auugcuuucugaugaggccguuaggccgaanucaauuc

SEQ ID NO: 11442 - RNA, 38 nt, Artificial Sequence
  Description of Artificial Sequence:  Enzymatic Nucleic Acid
  misc_feature (31)..(31): n stands for inosine
aauugcuucugaugaggccguuaggccgaangucaauu

SEQ ID NO: 11443 - RNA, 38 nt, Artificial Sequence
  Description of Artificial Sequence:  Enzymatic Nucleic Acid
  misc_feature (31)..(31): n stands for inosine
augggaaucugaugaggccguuaggccgaancuuuggu

SEQ ID NO: 11444 - RNA, 38 nt, Artificial Sequence
  Description of Artificial Sequence:  Enzymatic Nucleic Acid
  misc_feature (31)..(31): n stands for inosine
uuggcaugcugaugaggccguuaggccgaanaauugcu

SEQ ID NO: 11445 - RNA, 38 nt, Artificial Sequence
  Description of Artificial Sequence:  Enzymatic Nucleic Acid
  misc_feature (31)..(31): n stands for inosine
guuggcaucugaugaggccguuaggccgaangaauugc

SEQ ID NO: 11446 - RNA, 38 nt, Artificial Sequence
  Description of Artificial Sequence:  Enzymatic Nucleic Acid
  misc_feature (31)..(31): n stands for inosine
uguuggcacugaugaggccguuaggccgaanggaauug

SEQ ID NO: 11447 - RNA, 38 nt, Artificial Sequence
  Description of Artificial Sequence:  Enzymatic Nucleic Acid
  misc_feature (31)..(31): n stands for inosine
aauauguucugaugaggccguuaggccgaancauggga

SEQ ID NO: 11448 - RNA, 38 nt, Artificial Sequence
  Description of Artificial Sequence:  Enzymatic Nucleic Acid
  misc_feature (31)..(31): n stands for inosine
gaauaugucugaugaggccguuaggccgaangcauggg

SEQ ID NO: 11449 - RNA, 38 nt, Artificial Sequence
  Description of Artificial Sequence:  Enzymatic Nucleic Acid
  misc_feature (31)..(31): n stands for inosine
guagaauacugaugaggccguuaggccgaanuuggcau

SEQ ID NO: 11450 - RNA, 38 nt, Artificial Sequence
  Description of Artificial Sequence:  Enzymatic Nucleic Acid
  misc_feature (31)..(31): n stands for inosine
aacacugucugaugaggccguuaggccgaanaauaugu

SEQ ID NO: 11451 - RNA, 38 nt, Artificial Sequence
  Description of Artificial Sequence:  Enzymatic Nucleic Acid
  misc_feature (31)..(31): n stands for inosine
aagaacaccugaugaggccguuaggccgaanuagaaua

SEQ ID NO: 11452 - RNA, 38 nt, Artificial Sequence
  Description of Artificial Sequence:  Enzymatic Nucleic Acid
  misc_feature (31)..(31): n stands for inosine
caauaguacugaugaggccguuaggccgaanaacacug

SEQ ID NO: 11453 - RNA, 38 nt, Artificial Sequence
  Description of Artificial Sequence:  Enzymatic Nucleic Acid
  misc_feature (31)..(31): n stands for inosine
uugucaaucugaugaggccguuaggccgaanuaagaac

SEQ ID NO: 11454 - RNA, 38 nt, Artificial Sequence
  Description of Artificial Sequence:  Enzymatic Nucleic Acid
  misc_feature (31)..(31): n stands for inosine
cugcauuucugaugaggccguuaggccgaanucaauag

SEQ ID NO: 11455 - RNA, 38 nt, Artificial Sequence
  Description of Artificial Sequence:  Enzymatic Nucleic Acid
  misc_feature (31)..(31): n stands for inosine
cuuuguuccugaugaggccguuaggccgaancauuuug

SEQ ID NO: 11456 - RNA, 38 nt, Artificial Sequence
  Description of Artificial Sequence:  Enzymatic Nucleic Acid
  misc_feature (31)..(31): n stands for inosine
uuugucuucugaugaggccguuaggccgaanuucugca

SEQ ID NO: 11457 - RNA, 38 nt, Artificial Sequence
  Description of Artificial Sequence:  Enzymatic Nucleic Acid
  misc_feature (31)..(31): n stands for inosine
aaguccuucugaugaggccguuaggccgaanucuuugu

SEQ ID NO: 11458 - RNA, 38 nt, Artificial Sequence
  Description of Artificial Sequence:  Enzymatic Nucleic Acid
  misc_feature (31)..(31): n stands for inosine
aaguauaacugaugaggccguuaggccgaanuccuuug

SEQ ID NO: 11459 - RNA, 38 nt, Artificial Sequence
  Description of Artificial Sequence:  Enzymatic Nucleic Acid
  misc_feature (31)..(31): n stands for inosine
acacgacacugaugaggccguuaggccgaanuauaaag

SEQ ID NO: 11460 - RNA, 38 nt, Artificial Sequence
  Description of Artificial Sequence:  Enzymatic Nucleic Acid
  misc_feature (31)..(31): n stands for inosine
ugaaugaucugaugaggccguuaggccgaanuccacuc

SEQ ID NO: 11461 - RNA, 38 nt, Artificial Sequence
  Description of Artificial Sequence:  Enzymatic Nucleic Acid
  misc_feature (31)..(31): n stands for inosine
uugaaugacugaugaggccguuaggccgaanguccacu

SEQ ID NO: 11462 - RNA, 38 nt, Artificial Sequence
  Description of Artificial Sequence:  Enzymatic Nucleic Acid
  misc_feature (31)..(31): n stands for inosine
gauuugaacugaugaggccguuaggccgaanauggucc

SEQ ID NO: 11463 - RNA, 38 nt, Artificial Sequence
  Description of Artificial Sequence:  Enzymatic Nucleic Acid
  misc_feature (31)..(31): n stands for inosine
aacagauucugaugaggccguuaggccgaanaaugaug

SEQ ID NO: 11464 - RNA, 38 nt, Artificial Sequence
  Description of Artificial Sequence:  Enzymatic Nucleic Acid
  misc_feature (31)..(31): n stands for inosine
guguuaaccugaugaggccguuaggccgaanauuugaa

SEQ ID NO: 11465 - RNA, 38 nt, Artificial Sequence
  Description of Artificial Sequence:  Enzymatic Nucleic Acid
  misc_feature (31)..(31): n stands for inosine
cacugaggcugaugaggccguuaggccgaanuuaacag

SEQ ID NO: 11466 - RNA, 38 nt, Artificial Sequence
  Description of Artificial Sequence:  Enzymatic Nucleic Acid
  misc_feature (31)..(31): n stands for inosine
ugcacugacugaugaggccguuaggccgaanuguuaac

SEQ ID NO: 11467 - RNA, 38 nt, Artificial Sequence
  Description of Artificial Sequence:  Enzymatic Nucleic Acid
  misc_feature (31)..(31): n stands for inosine
augcacugcugaugaggccguuaggccgaanguguuaa

SEQ ID NO: 11468 - RNA, 38 nt, Artificial Sequence
  Description of Artificial Sequence:  Enzymatic Nucleic Acid
  misc_feature (31)..(31): n stands for inosine
auaugcaccugaugaggccguuaggccgaanagguguu

SEQ ID NO: 11469 - RNA, 38 nt, Artificial Sequence
  Description of Artificial Sequence:  Enzymatic Nucleic Acid
  misc_feature (31)..(31): n stands for inosine
cauauauacugaugaggccguuaggccgaancacugag

SEQ ID NO: 11470 - RNA, 38 nt, Artificial Sequence
  Description of Artificial Sequence:  Enzymatic Nucleic Acid
  misc_feature (31)..(31): n stands for inosine
gugaugaacugaugaggccguuaggccgaancuuuauc

SEQ ID NO: 11471 - RNA, 38 nt, Artificial Sequence
  Description of Artificial Sequence:  Enzymatic Nucleic Acid
  misc_feature (31)..(31): n stands for inosine
cacagugacugaugaggccguuaggccgaanaaugcuu

SEQ ID NO: 11472 - RNA, 38 nt, Artificial Sequence
  Description of Artificial Sequence:  Enzymatic Nucleic Acid
  misc_feature (31)..(31): n stands for inosine
uuucacagcugaugaggccguuaggccgaanaugaaug

SEQ ID NO: 11473 - RNA, 38 nt, Artificial Sequence
  Description of Artificial Sequence:  Enzymatic Nucleic Acid
  misc_feature (31)..(31): n stands for inosine
uguuucaccugaugaggccguuaggccgaanugaugaa

SEQ ID NO: 11474 - RNA, 38 nt, Artificial Sequence
  Description of Artificial Sequence:  Enzymatic Nucleic Acid
  misc_feature (31)..(31): n stands for inosine
guuuucgacugaugaggccguuaggccgaanuuucaca

SEQ ID NO: 11475 - RNA, 38 nt, Artificial Sequence
  Description of Artificial Sequence:  Enzymatic Nucleic Acid
  misc_feature (31)..(31): n stands for inosine
gcaccugccugaugaggccguuaggccgaanuuuucga

SEQ ID NO: 11476 - RNA, 38 nt, Artificial Sequence
  Description of Artificial Sequence:  Enzymatic Nucleic Acid
  misc_feature (31)..(31): n stands for inosine
caagcacccugaugaggccguuaggccgaancuguuuu

SEQ ID NO: 11477 - RNA, 38 nt, Artificial Sequence
  Description of Artificial Sequence:  Enzymatic Nucleic Acid
  misc_feature (31)..(31): n stands for inosine
cgguuucacugaugaggccguuaggccgaancaccugc

SEQ ID NO: 11478 - RNA, 38 nt, Artificial Sequence
  Description of Artificial Sequence:  Enzymatic Nucleic Acid
  misc_feature (31)..(31): n stands for inosine
ccagcuaccugaugaggccguuaggccgaanuuucaag

SEQ ID NO: 11479 - RNA, 38 nt, Artificial Sequence
  Description of Artificial Sequence:  Enzymatic Nucleic Acid
  misc_feature (31)..(31): n stands for inosine
cgcuugcccugaugaggccguuaggccgaancuacggu

SEQ ID NO: 11480 - RNA, 38 nt, Artificial Sequence
  Description of Artificial Sequence:  Enzymatic Nucleic Acid
  misc_feature (31)..(31): n stands for inosine
agaccgcucugaugaggccguuaggccgaanccagcua

SEQ ID NO: 11481 - RNA, 38 nt, Artificial Sequence
  Description of Artificial Sequence:  Enzymatic Nucleic Acid
  misc_feature (31)..(31): n stands for inosine
agccgguacugaugaggccguuaggccgaanaccgcuu

SEQ ID NO: 11482 - RNA, 38 nt, Artificial Sequence
  Description of Artificial Sequence:  Enzymatic Nucleic Acid
  misc_feature (31)..(31): n stands for inosine
agagagcccugaugaggccguuaggccgaanuaagacc

SEQ ID NO: 11483 - RNA, 38 nt, Artificial Sequence
  Description of Artificial Sequence:  Enzymatic Nucleic Acid
  misc_feature (31)..(31): n stands for inosine
ucauagagcugaugaggccguuaggccgaanccgguaa

SEQ ID NO: 11484 - RNA, 38 nt, Artificial Sequence
  Description of Artificial Sequence:  Enzymatic Nucleic Acid
  misc_feature (31)..(31): n stands for inosine
uuucauagcugaugaggccguuaggccgaanagccggu

SEQ ID NO: 11485 - RNA, 38 nt, Artificial Sequence
  Description of Artificial Sequence:  Enzymatic Nucleic Acid
  misc_feature (31)..(31): n stands for inosine
acuuucaucugaugaggccguuaggccgaanagagccg

SEQ ID NO: 11486 - RNA, 38 nt, Artificial Sequence
  Description of Artificial Sequence:  Enzymatic Nucleic Acid
  misc_feature (31)..(31): n stands for inosine
gagggaaacugaugaggccguuaggccgaanccuucac

SEQ ID NO: 11487 - RNA, 38 nt, Artificial Sequence
  Description of Artificial Sequence:  Enzymatic Nucleic Acid
  misc_feature (31)..(31): n stands for inosine
ccggcgagcugaugaggccguuaggccgaanaaaugcc

SEQ ID NO: 11488 - RNA, 38 nt, Artificial Sequence
  Description of Artificial Sequence:  Enzymatic Nucleic Acid
  misc_feature (31)..(31): n stands for inosine
uccggcgacugaugaggccguuaggccgaangaaaugc

SEQ ID NO: 11489 - RNA, 38 nt, Artificial Sequence
  Description of Artificial Sequence:  Enzymatic Nucleic Acid
  misc_feature (31)..(31): n stands for inosine
uuccggcgcugaugaggccguuaggccgaanggaaaug

SEQ ID NO: 11490 - RNA, 38 nt, Artificial Sequence
  Description of Artificial Sequence:  Enzymatic Nucleic Acid
  misc_feature (31)..(31): n stands for inosine
caacuucccugaugaggccguuaggccgaancgaggga

SEQ ID NO: 11491 - RNA, 38 nt, Artificial Sequence
  Description of Artificial Sequence:  Enzymatic Nucleic Acid
  misc_feature (31)..(31): n stands for inosine
cagucgcacugaugaggccguuaggccgaanuaaccca

SEQ ID NO: 11492 - RNA, 38 nt, Artificial Sequence
  Description of Artificial Sequence:  Enzymatic Nucleic Acid
  misc_feature (31)..(31): n stands for inosine
ucagucgccugaugaggccguuaggccgaanguaaccc

SEQ ID NO: 11493 - RNA, 38 nt, Artificial Sequence
  Description of Artificial Sequence:  Enzymatic Nucleic Acid
  misc_feature (31)..(31): n stands for inosine
gauuucuccugaugaggccguuaggccgaanucgcagg

SEQ ID NO: 11494 - RNA, 38 nt, Artificial Sequence
  Description of Artificial Sequence:  Enzymatic Nucleic Acid
  misc_feature (31)..(31): n stands for inosine
uagcgagccugaugaggccguuaggccgaanauuucuc

SEQ ID NO: 11495 - RNA, 38 nt, Artificial Sequence
  Description of Artificial Sequence:  Enzymatic Nucleic Acid
  misc_feature (31)..(31): n stands for inosine
aaauagcgcugaugaggccguuaggccgaancagauuu

SEQ ID NO: 11496 - RNA, 38 nt, Artificial Sequence
  Description of Artificial Sequence:  Enzymatic Nucleic Acid
  misc_feature (31)..(31): n stands for inosine
agucaaaucugaugaggccguuaggccgaancgagcag

SEQ ID NO: 11497 - RNA, 38 nt, Artificial Sequence
  Description of Artificial Sequence:  Enzymatic Nucleic Acid
  misc_feature (31)..(31): n stands for inosine
uagccacgcugaugaggccguuaggccgaanucaaaua

SEQ ID NO: 11498 - RNA, 38 nt, Artificial Sequence
  Description of Artificial Sequence:  Enzymatic Nucleic Acid
  misc_feature (31)..(31): n stands for inosine
uaacgagucugaugaggccguuaggccgaanccacgag

SEQ ID NO: 11499 - RNA, 38 nt, Artificial Sequence
  Description of Artificial Sequence:  Enzymatic Nucleic Acid
  misc_feature (31)..(31): n stands for inosine
aauuaacgcugaugaggccguuaggccgaanuagccac

SEQ ID NO: 11500 - RNA, 38 nt, Artificial Sequence
  Description of Artificial Sequence:  Enzymatic Nucleic Acid
  misc_feature (31)..(31): n stands for inosine
uacguccucugaugaggccguuaggccgaanauaauua

SEQ ID NO: 11501 - RNA, 38 nt, Artificial Sequence
  Description of Artificial Sequence:  Enzymatic Nucleic Acid
  misc_feature (31)..(31): n stands for inosine
uccucuuccugaugaggccguuaggccgaanuuacguc

SEQ ID NO: 11502 - RNA, 38 nt, Artificial Sequence
  Description of Artificial Sequence:  Enzymatic Nucleic Acid
  misc_feature (31)..(31): n stands for inosine
uaauuccccugaugaggccguuaggccgaancauccuc

SEQ ID NO: 11503 - RNA, 38 nt, Artificial Sequence
  Description of Artificial Sequence:  Enzymatic Nucleic Acid
  misc_feature (31)..(31): n stands for inosine
agcaagaucugaugaggccguuaggccgaanuauaauu

SEQ ID NO: 11504 - RNA, 38 nt, Artificial Sequence
  Description of Artificial Sequence:  Enzymatic Nucleic Acid
  misc_feature (31)..(31): n stands for inosine
gcucagcacugaugaggccguuaggccgaanauuguau

SEQ ID NO: 11505 - RNA, 38 nt, Artificial Sequence
  Description of Artificial Sequence:  Enzymatic Nucleic Acid
  misc_feature (31)..(31): n stands for inosine
uuaugcuccugaugaggccguuaggccgaancaagauu

SEQ ID NO: 11506 - RNA, 38 nt, Artificial Sequence
  Description of Artificial Sequence:  Enzymatic Nucleic Acid
  misc_feature (31)..(31): n stands for inosine
cuguuuuacugaugaggccguuaggccgaancucagca

SEQ ID NO: 11507 - RNA, 38 nt, Artificial Sequence
  Description of Artificial Sequence:  Enzymatic Nucleic Acid
  misc_feature (31)..(31): n stands for inosine
cauuugaccugaugaggccguuaggccgaanuuuuaug

SEQ ID NO: 11508 - RNA, 38 nt, Artificial Sequence
  Description of Artificial Sequence:  Enzymatic Nucleic Acid
  misc_feature (31)..(31): n stands for inosine
aacacauucugaugaggccguuaggccgaanacuguuu

SEQ ID NO: 11509 - RNA, 38 nt, Artificial Sequence
  Description of Artificial Sequence:  Enzymatic Nucleic Acid
  misc_feature (31)..(31): n stands for inosine
ggcagugacugaugaggccguuaggccgaanuuuuuaa

SEQ ID NO: 11510 - RNA, 38 nt, Artificial Sequence
  Description of Artificial Sequence:  Enzymatic Nucleic Acid
  misc_feature (31)..(31): n stands for inosine
uggcagugcugaugaggccguuaggccgaanguuuuua

SEQ ID NO: 11511 - RNA, 38 nt, Artificial Sequence
  Description of Artificial Sequence:  Enzymatic Nucleic Acid
  misc_feature (31)..(31): n stands for inosine
aguggcagcugaugaggccguuaggccgaanagguuuu

SEQ ID NO: 11512 - RNA, 38 nt, Artificial Sequence
  Description of Artificial Sequence:  Enzymatic Nucleic Acid
  misc_feature (31)..(31): n stands for inosine
agaguggccugaugaggccguuaggccgaanugagguu

SEQ ID NO: 11513 - RNA, 38 nt, Artificial Sequence
  Description of Artificial Sequence:  Enzymatic Nucleic Acid
  misc_feature (31)..(31): n stands for inosine
auuagagucugaugaggccguuaggccgaancagugag

SEQ ID NO: 11514 - RNA, 38 nt, Artificial Sequence
  Description of Artificial Sequence:  Enzymatic Nucleic Acid
  misc_feature (31)..(31): n stands for inosine
aauuagagcugaugaggccguuaggccgaangcaguga

SEQ ID NO: 11515 - RNA, 38 nt, Artificial Sequence
  Description of Artificial Sequence:  Enzymatic Nucleic Acid
  misc_feature (31)..(31): n stands for inosine
acaauuagcugaugaggccguuaggccgaanuggcagu

SEQ ID NO: 11516 - RNA, 38 nt, Artificial Sequence
  Description of Artificial Sequence:  Enzymatic Nucleic Acid
  misc_feature (31)..(31): n stands for inosine
ugacaauucugaugaggccguuaggccgaanaguggca

SEQ ID NO: 11517 - RNA, 38 nt, Artificial Sequence
  Description of Artificial Sequence:  Enzymatic Nucleic Acid
  misc_feature (31)..(31): n stands for inosine
uuucacaucugaugaggccguuaggccgaanacaauua

SEQ ID NO: 11518 - RNA, 38 nt, Artificial Sequence
  Description of Artificial Sequence:  Enzymatic Nucleic Acid
  misc_feature (31)..(31): n stands for inosine
aaaucuggcugaugaggccguuaggccgaanuuucaca

SEQ ID NO: 11519 - RNA, 38 nt, Artificial Sequence
  Description of Artificial Sequence:  Enzymatic Nucleic Acid
  misc_feature (31)..(31): n stands for inosine
uaaaucugcugaugaggccguuaggccgaanguuucac

SEQ ID NO: 11520 - RNA, 38 nt, Artificial Sequence
  Description of Artificial Sequence:  Enzymatic Nucleic Acid
  misc_feature (31)..(31): n stands for inosine
guaaaucucugaugaggccguuaggccgaangguuuca

SEQ ID NO: 11521 - RNA, 38 nt, Artificial Sequence
  Description of Artificial Sequence:  Enzymatic Nucleic Acid
  misc_feature (31)..(31): n stands for inosine
cguaaauccugaugaggccguuaggccgaanggguuuc

SEQ ID NO: 11522 - RNA, 38 nt, Artificial Sequence
  Description of Artificial Sequence:  Enzymatic Nucleic Acid
  misc_feature (31)..(31): n stands for inosine
gaugacaccugaugaggccguuaggccgaanccuuuuc

SEQ ID NO: 11523 - RNA, 38 nt, Artificial Sequence
  Description of Artificial Sequence:  Enzymatic Nucleic Acid
  misc_feature (31)..(31): n stands for inosine
ggaaacgacugaugaggccguuaggccgaanacacggc

SEQ ID NO: 11524 - RNA, 38 nt, Artificial Sequence
  Description of Artificial Sequence:  Enzymatic Nucleic Acid
  misc_feature (31)..(31): n stands for inosine
ccgggucucugaugaggccguuaggccgaanaaacgau

SEQ ID NO: 11525 - RNA, 38 nt, Artificial Sequence
  Description of Artificial Sequence:  Enzymatic Nucleic Acid
  misc_feature (31)..(31): n stands for inosine
gccggguccugaugaggccguuaggccgaangaaacga

SEQ ID NO: 11526 - RNA, 38 nt, Artificial Sequence
  Description of Artificial Sequence:  Enzymatic Nucleic Acid
  misc_feature (31)..(31): n stands for inosine
gagagccgcugaugaggccguuaggccgaanucuggaa

SEQ ID NO: 11527 - RNA, 38 nt, Artificial Sequence
  Description of Artificial Sequence:  Enzymatic Nucleic Acid
  misc_feature (31)..(31): n stands for inosine
agagagcccugaugaggccguuaggccgaangucugga

SEQ ID NO: 11528 - RNA, 38 nt, Artificial Sequence
  Description of Artificial Sequence:  Enzymatic Nucleic Acid
  misc_feature (31)..(31): n stands for inosine
ggguagagcugaugaggccguuaggccgaanccggguc

SEQ ID NO: 11529 - RNA, 38 nt, Artificial Sequence
  Description of Artificial Sequence:  Enzymatic Nucleic Acid
  misc_feature (31)..(31): n stands for inosine
guggguagcugaugaggccguuaggccgaanagccggg

SEQ ID NO: 11530 - RNA, 38 nt, Artificial Sequence
  Description of Artificial Sequence:  Enzymatic Nucleic Acid
  misc_feature (31)..(31): n stands for inosine
cagugggucugaugaggccguuaggccgaanagagccg

SEQ ID NO: 11531 - RNA, 38 nt, Artificial Sequence
  Description of Artificial Sequence:  Enzymatic Nucleic Acid
  misc_feature (31)..(31): n stands for inosine
gcccagugcugaugaggccguuaggccgaanuagagag

SEQ ID NO: 11532 - RNA, 38 nt, Artificial Sequence
  Description of Artificial Sequence:  Enzymatic Nucleic Acid
  misc_feature (31)..(31): n stands for inosine
ugcccagucugaugaggccguuaggccgaanguagaga

SEQ ID NO: 11533 - RNA, 38 nt, Artificial Sequence
  Description of Artificial Sequence:  Enzymatic Nucleic Acid
  misc_feature (31)..(31): n stands for inosine
cugcccagcugaugaggccguuaggccgaangguagag

SEQ ID NO: 11534 - RNA, 38 nt, Artificial Sequence
  Description of Artificial Sequence:  Enzymatic Nucleic Acid
  misc_feature (31)..(31): n stands for inosine
ugcugccccugaugaggccguuaggccgaanuggguag

SEQ ID NO: 11535 - RNA, 38 nt, Artificial Sequence
  Description of Artificial Sequence:  Enzymatic Nucleic Acid
  misc_feature (31)..(31): n stands for inosine
uugucugccugaugaggccguuaggccgaancccagug

SEQ ID NO: 11536 - RNA, 38 nt, Artificial Sequence
  Description of Artificial Sequence:  Enzymatic Nucleic Acid
  misc_feature (31)..(31): n stands for inosine
gauuuguccugaugaggccguuaggccgaancugccca

SEQ ID NO: 11537 - RNA, 38 nt, Artificial Sequence
  Description of Artificial Sequence:  Enzymatic Nucleic Acid
  misc_feature (31)..(31): n stands for inosine
ucaggauucugaugaggccguuaggccgaanucugcug

SEQ ID NO: 11538 - RNA, 38 nt, Artificial Sequence
  Description of Artificial Sequence:  Enzymatic Nucleic Acid
  misc_feature (31)..(31): n stands for inosine
acaagucacugaugaggccguuaggccgaanauuuguc

SEQ ID NO: 11539 - RNA, 38 nt, Artificial Sequence
  Description of Artificial Sequence:  Enzymatic Nucleic Acid
  misc_feature (31)..(31): n stands for inosine
uacaaguccugaugaggccguuaggccgaangauuugu

SEQ ID NO: 11540 - RNA, 38 nt, Artificial Sequence
  Description of Artificial Sequence:  Enzymatic Nucleic Acid
  misc_feature (31)..(31): n stands for inosine
gcgguacacugaugaggccguuaggccgaanucaggau

SEQ ID NO: 11541 - RNA, 38 nt, Artificial Sequence
  Description of Artificial Sequence:  Enzymatic Nucleic Acid
  misc_feature (31)..(31): n stands for inosine
ccauaugccugaugaggccguuaggccgaanuacaagu

SEQ ID NO: 11542 - RNA, 38 nt, Artificial Sequence
  Description of Artificial Sequence:  Enzymatic Nucleic Acid
  misc_feature (31)..(31): n stands for inosine
auaccauacugaugaggccguuaggccgaancgguaca

SEQ ID NO: 11543 - RNA, 38 nt, Artificial Sequence
  Description of Artificial Sequence:  Enzymatic Nucleic Acid
  misc_feature (31)..(31): n stands for inosine
agguugagcugaugaggccguuaggccgaanauaccau

SEQ ID NO: 11544 - RNA, 38 nt, Artificial Sequence
  Description of Artificial Sequence:  Enzymatic Nucleic Acid
  misc_feature (31)..(31): n stands for inosine
uagguugacugaugaggccguuaggccgaangauacca

SEQ ID NO: 11545 - RNA, 38 nt, Artificial Sequence
  Description of Artificial Sequence:  Enzymatic Nucleic Acid
  misc_feature (31)..(31): n stands for inosine
guagguugcugaugaggccguuaggccgaanggauacc

SEQ ID NO: 11546 - RNA, 38 nt, Artificial Sequence
  Description of Artificial Sequence:  Enzymatic Nucleic Acid
  misc_feature (31)..(31): n stands for inosine
uuguaggucugaugaggccguuaggccgaanagggaua

SEQ ID NO: 11547 - RNA, 38 nt, Artificial Sequence
  Description of Artificial Sequence:  Enzymatic Nucleic Acid
  misc_feature (31)..(31): n stands for inosine
ugauuguacugaugaggccguuaggccgaanuugaggg

SEQ ID NO: 11548 - RNA, 38 nt, Artificial Sequence
  Description of Artificial Sequence:  Enzymatic Nucleic Acid
  misc_feature (31)..(31): n stands for inosine
uugauugucugaugaggccguuaggccgaanguugagg

SEQ ID NO: 11549 - RNA, 38 nt, Artificial Sequence
  Description of Artificial Sequence:  Enzymatic Nucleic Acid
  misc_feature (31)..(31): n stands for inosine
cacuugaucugaugaggccguuaggccgaanuagguug

SEQ ID NO: 11550 - RNA, 38 nt, Artificial Sequence
  Description of Artificial Sequence:  Enzymatic Nucleic Acid
  misc_feature (31)..(31): n stands for inosine
gaaccacucugaugaggccguuaggccgaanauuguag

SEQ ID NO: 11551 - RNA, 38 nt, Artificial Sequence
  Description of Artificial Sequence:  Enzymatic Nucleic Acid
  misc_feature (31)..(31): n stands for inosine
ggggugcccugaugaggccguuaggccgaanaaccacu

SEQ ID NO: 11552 - RNA, 38 nt, Artificial Sequence
  Description of Artificial Sequence:  Enzymatic Nucleic Acid
  misc_feature (31)..(31): n stands for inosine
uacaggggcugaugaggccguuaggccgaanccagaac

SEQ ID NO: 11553 - RNA, 38 nt, Artificial Sequence
  Description of Artificial Sequence:  Enzymatic Nucleic Acid
  misc_feature (31)..(31): n stands for inosine
guuacaggcugaugaggccguuaggccgaanugccaga

SEQ ID NO: 11554 - RNA, 38 nt, Artificial Sequence
  Description of Artificial Sequence:  Enzymatic Nucleic Acid
  misc_feature (31)..(31): n stands for inosine
gguuacagcugaugaggccguuaggccgaangugccag

SEQ ID NO: 11555 - RNA, 38 nt, Artificial Sequence
  Description of Artificial Sequence:  Enzymatic Nucleic Acid
  misc_feature (31)..(31): n stands for inosine
ugguuacacugaugaggccguuaggccgaanggugcca

SEQ ID NO: 11556 - RNA, 38 nt, Artificial Sequence
  Description of Artificial Sequence:  Enzymatic Nucleic Acid
  misc_feature (31)..(31): n stands for inosine
augguuaccugaugaggccguuaggccgaangggugcc

SEQ ID NO: 11557 - RNA, 38 nt, Artificial Sequence
  Description of Artificial Sequence:  Enzymatic Nucleic Acid
  misc_feature (31)..(31): n stands for inosine
augauuaucugaugaggccguuaggccgaanuuacagg

SEQ ID NO: 11558 - RNA, 38 nt, Artificial Sequence
  Description of Artificial Sequence:  Enzymatic Nucleic Acid
  misc_feature (31)..(31): n stands for inosine
aaugauuacugaugaggccguuaggccgaanguuacag

SEQ ID NO: 11559 - RNA, 38 nt, Artificial Sequence
  Description of Artificial Sequence:  Enzymatic Nucleic Acid
  misc_feature (31)..(31): n stands for inosine
cuucggaacugaugaggccguuaggccgaanauuaugg

SEQ ID NO: 11560 - RNA, 38 nt, Artificial Sequence
  Description of Artificial Sequence:  Enzymatic Nucleic Acid
  misc_feature (31)..(31): n stands for inosine
cuugcuuccugaugaggccguuaggccgaanaaugauu

SEQ ID NO: 11561 - RNA, 38 nt, Artificial Sequence
  Description of Artificial Sequence:  Enzymatic Nucleic Acid
  misc_feature (31)..(31): n stands for inosine
ucacaccucugaugaggccguuaggccgaancuucgga

SEQ ID NO: 11562 - RNA, 38 nt, Artificial Sequence
  Description of Artificial Sequence:  Enzymatic Nucleic Acid
  misc_feature (31)..(31): n stands for inosine
ggaacaaacugaugaggccguuaggccgaanucacacc

SEQ ID NO: 11563 - RNA, 38 nt, Artificial Sequence
  Description of Artificial Sequence:  Enzymatic Nucleic Acid
  misc_feature (31)..(31): n stands for inosine
ucauuauucugaugaggccguuaggccgaanaacaaaa

SEQ ID NO: 11564 - RNA, 38 nt, Artificial Sequence
  Description of Artificial Sequence:  Enzymatic Nucleic Acid
  misc_feature (31)..(31): n stands for inosine
uucauuaucugaugaggccguuaggccgaangaacaaa

SEQ ID NO: 11565 - RNA, 38 nt, Artificial Sequence
  Description of Artificial Sequence:  Enzymatic Nucleic Acid
  misc_feature (31)..(31): n stands for inosine
aggauaaacugaugaggccguuaggccgaanacucuuc

SEQ ID NO: 11566 - RNA, 38 nt, Artificial Sequence
  Description of Artificial Sequence:  Enzymatic Nucleic Acid
  misc_feature (31)..(31): n stands for inosine
caggauaacugaugaggccguuaggccgaangacucuu

SEQ ID NO: 11567 - RNA, 38 nt, Artificial Sequence
  Description of Artificial Sequence:  Enzymatic Nucleic Acid
  misc_feature (31)..(31): n stands for inosine
agcauccacugaugaggccguuaggccgaanauaaagg

SEQ ID NO: 11568 - RNA, 38 nt, Artificial Sequence
  Description of Artificial Sequence:  Enzymatic Nucleic Acid
  misc_feature (31)..(31): n stands for inosine
cagcaucccugaugaggccguuaggccgaangauaaag

SEQ ID NO: 11569 - RNA, 38 nt, Artificial Sequence
  Description of Artificial Sequence:  Enzymatic Nucleic Acid
  misc_feature (31)..(31): n stands for inosine
uugcuguccugaugaggccguuaggccgaancauccag

SEQ ID NO: 11570 - RNA, 38 nt, Artificial Sequence
  Description of Artificial Sequence:  Enzymatic Nucleic Acid
  misc_feature (31)..(31): n stands for inosine
cauguugccugaugaggccguuaggccgaanucagcau

SEQ ID NO: 11571 - RNA, 38 nt, Artificial Sequence
  Description of Artificial Sequence:  Enzymatic Nucleic Acid
  misc_feature (31)..(31): n stands for inosine
ucccaugucugaugaggccguuaggccgaancugucag

SEQ ID NO: 11572 - RNA, 38 nt, Artificial Sequence
  Description of Artificial Sequence:  Enzymatic Nucleic Acid
  misc_feature (31)..(31): n stands for inosine
guuucccacugaugaggccguuaggccgaanuugcugu

SEQ ID NO: 11573 - RNA, 38 nt, Artificial Sequence
  Description of Artificial Sequence:  Enzymatic Nucleic Acid
  misc_feature (31)..(31): n stands for inosine
cucaauuccugaugaggccguuaggccgaanuuuccca

SEQ ID NO: 11574 - RNA, 38 nt, Artificial Sequence
  Description of Artificial Sequence:  Enzymatic Nucleic Acid
  misc_feature (31)..(31): n stands for inosine
cugagugacugaugaggccguuaggccgaancucucaa

SEQ ID NO: 11575 - RNA, 38 nt, Artificial Sequence
  Description of Artificial Sequence:  Enzymatic Nucleic Acid
  misc_feature (31)..(31): n stands for inosine
gcgcugagcugaugaggccguuaggccgaanaugcucu

SEQ ID NO: 11576 - RNA, 38 nt, Artificial Sequence
  Description of Artificial Sequence:  Enzymatic Nucleic Acid
  misc_feature (31)..(31): n stands for inosine
augcgcugcugaugaggccguuaggccgaanugaugcu

SEQ ID NO: 11577 - RNA, 38 nt, Artificial Sequence
  Description of Artificial Sequence:  Enzymatic Nucleic Acid
  misc_feature (31)..(31): n stands for inosine
ccaugcgccugaugaggccguuaggccgaanagugaug

SEQ ID NO: 11578 - RNA, 38 nt, Artificial Sequence
  Description of Artificial Sequence:  Enzymatic Nucleic Acid
  misc_feature (31)..(31): n stands for inosine
uauugccacugaugaggccguuaggccgaancgcugag

SEQ ID NO: 11579 - RNA, 38 nt, Artificial Sequence
  Description of Artificial Sequence:  Enzymatic Nucleic Acid
  misc_feature (31)..(31): n stands for inosine
ucuauuaucugaugaggccguuaggccgaanccaugcg

SEQ ID NO: 11580 - RNA, 38 nt, Artificial Sequence
  Description of Artificial Sequence:  Enzymatic Nucleic Acid
  misc_feature (31)..(31): n stands for inosine
aaggugcucugaugaggccguuaggccgaanccaucuu

SEQ ID NO: 11581 - RNA, 38 nt, Artificial Sequence
  Description of Artificial Sequence:  Enzymatic Nucleic Acid
  misc_feature (31)..(31): n stands for inosine
aaccaaggcugaugaggccguuaggccgaancuagcca

SEQ ID NO: 11582 - RNA, 38 nt, Artificial Sequence
  Description of Artificial Sequence:  Enzymatic Nucleic Acid
  misc_feature (31)..(31): n stands for inosine
acaaccaacugaugaggccguuaggccgaanugcuagc

SEQ ID NO: 11583 - RNA, 38 nt, Artificial Sequence
  Description of Artificial Sequence:  Enzymatic Nucleic Acid
  misc_feature (31)..(31): n stands for inosine
cacaaccacugaugaggccguuaggccgaangugcuag

SEQ ID NO: 11584 - RNA, 38 nt, Artificial Sequence
  Description of Artificial Sequence:  Enzymatic Nucleic Acid
  misc_feature (31)..(31): n stands for inosine
cuagaguccugaugaggccguuaggccgaanccacaac

SEQ ID NO: 11585 - RNA, 38 nt, Artificial Sequence
  Description of Artificial Sequence:  Enzymatic Nucleic Acid
  misc_feature (31)..(31): n stands for inosine
aauucuagcugaugaggccguuaggccgaanucagcca

SEQ ID NO: 11586 - RNA, 38 nt, Artificial Sequence
  Description of Artificial Sequence:  Enzymatic Nucleic Acid
  misc_feature (31)..(31): n stands for inosine
gaaauucucugaugaggccguuaggccgaanagucagc

SEQ ID NO: 11587 - RNA, 38 nt, Artificial Sequence
  Description of Artificial Sequence:  Enzymatic Nucleic Acid
  misc_feature (31)..(31): n stands for inosine
uagauucccugaugaggccguuaggccgaanaaauucu

SEQ ID NO: 11588 - RNA, 38 nt, Artificial Sequence
  Description of Artificial Sequence:  Enzymatic Nucleic Acid
  misc_feature (31)..(31): n stands for inosine
gcaaaugucugaugaggccguuaggccgaanauuccag

SEQ ID NO: 11589 - RNA, 38 nt, Artificial Sequence
  Description of Artificial Sequence:  Enzymatic Nucleic Acid
  misc_feature (31)..(31): n stands for inosine
uaugcaaacugaugaggccguuaggccgaanuagauuc

SEQ ID NO: 11590 - RNA, 38 nt, Artificial Sequence
  Description of Artificial Sequence:  Enzymatic Nucleic Acid
  misc_feature (31)..(31): n stands for inosine
ggaagcuacugaugaggccguuaggccgaancaaaugu

SEQ ID NO: 11591 - RNA, 38 nt, Artificial Sequence
  Description of Artificial Sequence:  Enzymatic Nucleic Acid
  misc_feature (31)..(31): n stands for inosine
uuauuggacugaugaggccguuaggccgaancuaugca

SEQ ID NO: 11592 - RNA, 38 nt, Artificial Sequence
  Description of Artificial Sequence:  Enzymatic Nucleic Acid
  misc_feature (31)..(31): n stands for inosine
acuuuauucugaugaggccguuaggccgaanaagcuau

SEQ ID NO: 11593 - RNA, 38 nt, Artificial Sequence
  Description of Artificial Sequence:  Enzymatic Nucleic Acid
  misc_feature (31)..(31): n stands for inosine
aacuuuaucugaugaggccguuaggccgaangaagcua

SEQ ID NO: 11594 - RNA, 38 nt, Artificial Sequence
  Description of Artificial Sequence:  Enzymatic Nucleic Acid
  misc_feature (31)..(31): n stands for inosine
cuucccaccugaugaggccguuaggccgaanucccaac

SEQ ID NO: 11595 - RNA, 38 nt, Artificial Sequence
  Description of Artificial Sequence:  Enzymatic Nucleic Acid
  misc_feature (31)..(31): n stands for inosine
aaagcuuacugaugaggccguuaggccgaanuuucuuc

SEQ ID NO: 11596 - RNA, 38 nt, Artificial Sequence
  Description of Artificial Sequence:  Enzymatic Nucleic Acid
  misc_feature (31)..(31): n stands for inosine
gauauaaacugaugaggccguuaggccgaancuuaugu

SEQ ID NO: 11597 - RNA, 38 nt, Artificial Sequence
  Description of Artificial Sequence:  Enzymatic Nucleic Acid
  misc_feature (31)..(31): n stands for inosine
cacaucugcugaugaggccguuaggccgaanauauaaa

SEQ ID NO: 11598 - RNA, 38 nt, Artificial Sequence
  Description of Artificial Sequence:  Enzymatic Nucleic Acid
  misc_feature (31)..(31): n stands for inosine
ggcacauccugaugaggccguuaggccgaanugauaua

SEQ ID NO: 11599 - RNA, 38 nt, Artificial Sequence
  Description of Artificial Sequence:  Enzymatic Nucleic Acid
  misc_feature (31)..(31): n stands for inosine
acccauuucugaugaggccguuaggccgaancacaucu

SEQ ID NO: 11600 - RNA, 38 nt, Artificial Sequence
  Description of Artificial Sequence:  Enzymatic Nucleic Acid
  misc_feature (31)..(31): n stands for inosine
aacccauucugaugaggccguuaggccgaangcacauc

SEQ ID NO: 11601 - RNA, 38 nt, Artificial Sequence
  Description of Artificial Sequence:  Enzymatic Nucleic Acid
  misc_feature (31)..(31): n stands for inosine
aguuaacacugaugaggccguuaggccgaanaaaccca

SEQ ID NO: 11602 - RNA, 38 nt, Artificial Sequence
  Description of Artificial Sequence:  Enzymatic Nucleic Acid
  misc_feature (31)..(31): n stands for inosine
uuuuuccacugaugaggccguuaggccgaanuuaacau

SEQ ID NO: 11603 - RNA, 38 nt, Artificial Sequence
  Description of Artificial Sequence:  Enzymatic Nucleic Acid
  misc_feature (31)..(31): n stands for inosine
cuuccguccugaugaggccguuaggccgaancauuuuu

SEQ ID NO: 11604 - RNA, 38 nt, Artificial Sequence
  Description of Artificial Sequence:  Enzymatic Nucleic Acid
  misc_feature (31)..(31): n stands for inosine
caguuucacugaugaggccguuaggccgaanuccucuc

SEQ ID NO: 11605 - RNA, 38 nt, Artificial Sequence
  Description of Artificial Sequence:  Enzymatic Nucleic Acid
  misc_feature (31)..(31): n stands for inosine
acaguuuccugaugaggccguuaggccgaanguccucu

SEQ ID NO: 11606 - RNA, 38 nt, Artificial Sequence
  Description of Artificial Sequence:  Enzymatic Nucleic Acid
  misc_feature (31)..(31): n stands for inosine
ugcaagaccugaugaggccguuaggccgaanuuucagg

SEQ ID NO: 11607 - RNA, 38 nt, Artificial Sequence
  Description of Artificial Sequence:  Enzymatic Nucleic Acid
  misc_feature (31)..(31): n stands for inosine
acugugcacugaugaggccguuaggccgaanacaguuu

SEQ ID NO: 11608 - RNA, 38 nt, Artificial Sequence
  Description of Artificial Sequence:  Enzymatic Nucleic Acid
  misc_feature (31)..(31): n stands for inosine
guuaacugcugaugaggccguuaggccgaancaagaca

SEQ ID NO: 11609 - RNA, 38 nt, Artificial Sequence
  Description of Artificial Sequence:  Enzymatic Nucleic Acid
  misc_feature (31)..(31): n stands for inosine
uuguuaaccugaugaggccguuaggccgaanugcaaga

SEQ ID NO: 11610 - RNA, 38 nt, Artificial Sequence
  Description of Artificial Sequence:  Enzymatic Nucleic Acid
  misc_feature (31)..(31): n stands for inosine
uaagaacucugaugaggccguuaggccgaanuuaacug

SEQ ID NO: 11611 - RNA, 38 nt, Artificial Sequence
  Description of Artificial Sequence:  Enzymatic Nucleic Acid
  misc_feature (31)..(31): n stands for inosine
ucuguauacugaugaggccguuaggccgaanaacuugu

SEQ ID NO: 11612 - RNA, 38 nt, Artificial Sequence
  Description of Artificial Sequence:  Enzymatic Nucleic Acid
  misc_feature (31)..(31): n stands for inosine
aacgucuccugaugaggccguuaggccgaanuauaaga

SEQ ID NO: 11613 - RNA, 38 nt, Artificial Sequence
  Description of Artificial Sequence:  Enzymatic Nucleic Acid
  misc_feature (31)..(31): n stands for inosine
aaaauccacugaugaggccguuaggccgaanuaacguc

SEQ ID NO: 11614 - RNA, 38 nt, Artificial Sequence
  Description of Artificial Sequence:  Enzymatic Nucleic Acid
  misc_feature (31)..(31): n stands for inosine
cuguccgccugaugaggccguuaggccgaanuaaaauc

SEQ ID NO: 11615 - RNA, 38 nt, Artificial Sequence
  Description of Artificial Sequence:  Enzymatic Nucleic Acid
  misc_feature (31)..(31): n stands for inosine
uuauuaaccugaugaggccguuaggccgaanuccgcag

SEQ ID NO: 11616 - RNA, 38 nt, Artificial Sequence
  Description of Artificial Sequence:  Enzymatic Nucleic Acid
  misc_feature (31)..(31): n stands for inosine
cauuguuccugaugaggccguuaggccgaanuuauuaa

SEQ ID NO: 11617 - RNA, 38 nt, Artificial Sequence
  Description of Artificial Sequence:  Enzymatic Nucleic Acid
  misc_feature (31)..(31): n stands for inosine
uagugcaucugaugaggccguuaggccgaanuucuguu

SEQ ID NO: 11618 - RNA, 38 nt, Artificial Sequence
  Description of Artificial Sequence:  Enzymatic Nucleic Acid
  misc_feature (31)..(31): n stands for inosine
uacuguagcugaugaggccguuaggccgaancauuguu

SEQ ID NO: 11619 - RNA, 38 nt, Artificial Sequence
  Description of Artificial Sequence:  Enzymatic Nucleic Acid
  misc_feature (31)..(31): n stands for inosine
aauacugucugaugaggccguuaggccgaanugcauug

SEQ ID NO: 11620 - RNA, 38 nt, Artificial Sequence
  Description of Artificial Sequence:  Enzymatic Nucleic Acid
  misc_feature (31)..(31): n stands for inosine
gcuaauaccugaugaggccguuaggccgaanuagugca

SEQ ID NO: 11621 - RNA, 38 nt, Artificial Sequence
  Description of Artificial Sequence:  Enzymatic Nucleic Acid
  misc_feature (31)..(31): n stands for inosine
uuuuugcucugaugaggccguuaggccgaancuaauac

SEQ ID NO: 11622 - RNA, 38 nt, Artificial Sequence
  Description of Artificial Sequence:  Enzymatic Nucleic Acid
  misc_feature (31)..(31): n stands for inosine
ccauuuuucugaugaggccguuaggccgaancuugcua

SEQ ID NO: 11623 - RNA, 38 nt, Artificial Sequence
  Description of Artificial Sequence:  Enzymatic Nucleic Acid
  misc_feature (31)..(31): n stands for inosine
uuagugaucugaugaggccguuaggccgaanccauuuu

SEQ ID NO: 11624 - RNA, 38 nt, Artificial Sequence
  Description of Artificial Sequence:  Enzymatic Nucleic Acid
  misc_feature (31)..(31): n stands for inosine
cuuagugacugaugaggccguuaggccgaangccauuu

SEQ ID NO: 11625 - RNA, 38 nt, Artificial Sequence
  Description of Artificial Sequence:  Enzymatic Nucleic Acid
  misc_feature (31)..(31): n stands for inosine
cuccuuagcugaugaggccguuaggccgaanauggcca

SEQ ID NO: 11626 - RNA, 38 nt, Artificial Sequence
  Description of Artificial Sequence:  Enzymatic Nucleic Acid
  misc_feature (31)..(31): n stands for inosine
ugcuccuucugaugaggccguuaggccgaanugauggc

SEQ ID NO: 11627 - RNA, 38 nt, Artificial Sequence
  Description of Artificial Sequence:  Enzymatic Nucleic Acid
  misc_feature (31)..(31): n stands for inosine
ugauggagcugaugaggccguuaggccgaancuccuua

SEQ ID NO: 11628 - RNA, 38 nt, Artificial Sequence
  Description of Artificial Sequence:  Enzymatic Nucleic Acid
  misc_feature (31)..(31): n stands for inosine
agugauggcugaugaggccguuaggccgaanugcuccu

SEQ ID NO: 11629 - RNA, 38 nt, Artificial Sequence
  Description of Artificial Sequence:  Enzymatic Nucleic Acid
  misc_feature (31)..(31): n stands for inosine
agagugaucugaugaggccguuaggccgaanagugcuc

SEQ ID NO: 11630 - RNA, 38 nt, Artificial Sequence
  Description of Artificial Sequence:  Enzymatic Nucleic Acid
  misc_feature (31)..(31): n stands for inosine
aagagugacugaugaggccguuaggccgaangagugcu

SEQ ID NO: 11631 - RNA, 38 nt, Artificial Sequence
  Description of Artificial Sequence:  Enzymatic Nucleic Acid
  misc_feature (31)..(31): n stands for inosine
auuaagagcugaugaggccguuaggccgaanauggagu

SEQ ID NO: 11632 - RNA, 38 nt, Artificial Sequence
  Description of Artificial Sequence:  Enzymatic Nucleic Acid
  misc_feature (31)..(31): n stands for inosine
agauuaagcugaugaggccguuaggccgaanugaugga

SEQ ID NO: 11633 - RNA, 38 nt, Artificial Sequence
  Description of Artificial Sequence:  Enzymatic Nucleic Acid
  misc_feature (31)..(31): n stands for inosine
uaagauuacugaugaggccguuaggccgaanagugaug

SEQ ID NO: 11634 - RNA, 38 nt, Artificial Sequence
  Description of Artificial Sequence:  Enzymatic Nucleic Acid
  misc_feature (31)..(31): n stands for inosine
ugaugguacugaugaggccguuaggccgaanauuaaga

SEQ ID NO: 11635 - RNA, 38 nt, Artificial Sequence
  Description of Artificial Sequence:  Enzymatic Nucleic Acid
  misc_feature (31)..(31): n stands for inosine
uucaugaucugaugaggccguuaggccgaanuaagauu

SEQ ID NO: 11636 - RNA, 38 nt, Artificial Sequence
  Description of Artificial Sequence:  Enzymatic Nucleic Acid
  misc_feature (31)..(31): n stands for inosine
auucaugacugaugaggccguuaggccgaanguaagau

SEQ ID NO: 11637 - RNA, 38 nt, Artificial Sequence
  Description of Artificial Sequence:  Enzymatic Nucleic Acid
  misc_feature (31)..(31): n stands for inosine
aacauucacugaugaggccguuaggccgaanaugguaa

SEQ ID NO: 11638 - RNA, 38 nt, Artificial Sequence
  Description of Artificial Sequence:  Enzymatic Nucleic Acid
  misc_feature (31)..(31): n stands for inosine
ucuugcagcugaugaggccguuaggccgaanaaacauu

SEQ ID NO: 11639 - RNA, 38 nt, Artificial Sequence
  Description of Artificial Sequence:  Enzymatic Nucleic Acid
  misc_feature (31)..(31): n stands for inosine
aucuugcacugaugaggccguuaggccgaangaaacau

SEQ ID NO: 11640 - RNA, 38 nt, Artificial Sequence
  Description of Artificial Sequence:  Enzymatic Nucleic Acid
  misc_feature (31)..(31): n stands for inosine
aaucuugccugaugaggccguuaggccgaanggaaaca

SEQ ID NO: 11641 - RNA, 38 nt, Artificial Sequence
  Description of Artificial Sequence:  Enzymatic Nucleic Acid
  misc_feature (31)..(31): n stands for inosine
cugaaucucugaugaggccguuaggccgaancagggaa

SEQ ID NO: 11642 - RNA, 38 nt, Artificial Sequence
  Description of Artificial Sequence:  Enzymatic Nucleic Acid
  misc_feature (31)..(31): n stands for inosine
uaggugcccugaugaggccguuaggccgaanaaucuug

SEQ ID NO: 11643 - RNA, 38 nt, Artificial Sequence
  Description of Artificial Sequence:  Enzymatic Nucleic Acid
  misc_feature (31)..(31): n stands for inosine
ggcauaggcugaugaggccguuaggccgaanccugaau

SEQ ID NO: 11644 - RNA, 38 nt, Artificial Sequence
  Description of Artificial Sequence:  Enzymatic Nucleic Acid
  misc_feature (31)..(31): n stands for inosine
caggcauacugaugaggccguuaggccgaanugccuga

SEQ ID NO: 11645 - RNA, 38 nt, Artificial Sequence
  Description of Artificial Sequence:  Enzymatic Nucleic Acid
  misc_feature (31)..(31): n stands for inosine
gcaggcaucugaugaggccguuaggccgaangugccug

SEQ ID NO: 11646 - RNA, 38 nt, Artificial Sequence
  Description of Artificial Sequence:  Enzymatic Nucleic Acid
  misc_feature (31)..(31): n stands for inosine
gcucugcacugaugaggccguuaggccgaancauaggu

SEQ ID NO: 11647 - RNA, 38 nt, Artificial Sequence
  Description of Artificial Sequence:  Enzymatic Nucleic Acid
  misc_feature (31)..(31): n stands for inosine
ggcucugccugaugaggccguuaggccgaangcauagg

SEQ ID NO: 11648 - RNA, 38 nt, Artificial Sequence
  Description of Artificial Sequence:  Enzymatic Nucleic Acid
  misc_feature (31)..(31): n stands for inosine
ccuggcuccugaugaggccguuaggccgaancaggcau

SEQ ID NO: 11649 - RNA, 38 nt, Artificial Sequence
  Description of Artificial Sequence:  Enzymatic Nucleic Acid
  misc_feature (31)..(31): n stands for inosine
acauuccucugaugaggccguuaggccgaancucugca

SEQ ID NO: 11650 - RNA, 38 nt, Artificial Sequence
  Description of Artificial Sequence:  Enzymatic Nucleic Acid
  misc_feature (31)..(31): n stands for inosine
uacauucccugaugaggccguuaggccgaangcucugc

SEQ ID NO: 11651 - RNA, 38 nt, Artificial Sequence
  Description of Artificial Sequence:  Enzymatic Nucleic Acid
  misc_feature (31)..(31): n stands for inosine
uuccccugcugaugaggccguuaggccgaanuauacau

SEQ ID NO: 11652 - RNA, 38 nt, Artificial Sequence
  Description of Artificial Sequence:  Enzymatic Nucleic Acid
  misc_feature (31)..(31): n stands for inosine
ucuucccccugaugaggccguuaggccgaanuguauac

SEQ ID NO: 11653 - RNA, 38 nt, Artificial Sequence
  Description of Artificial Sequence:  Enzymatic Nucleic Acid
  misc_feature (31)..(31): n stands for inosine
cuucuggacugaugaggccguuaggccgaanauuucuu

SEQ ID NO: 11654 - RNA, 38 nt, Artificial Sequence
  Description of Artificial Sequence:  Enzymatic Nucleic Acid
  misc_feature (31)..(31): n stands for inosine
ucuucuggcugaugaggccguuaggccgaangauuucu

SEQ ID NO: 11655 - RNA, 38 nt, Artificial Sequence
  Description of Artificial Sequence:  Enzymatic Nucleic Acid
  misc_feature (31)..(31): n stands for inosine
uuucuucucugaugaggccguuaggccgaanaggauuu

SEQ ID NO: 11656 - RNA, 38 nt, Artificial Sequence
  Description of Artificial Sequence:  Enzymatic Nucleic Acid
  misc_feature (31)..(31): n stands for inosine
cuuucuuccugaugaggccguuaggccgaangaggauu

SEQ ID NO: 11657 - RNA, 38 nt, Artificial Sequence
  Description of Artificial Sequence:  Enzymatic Nucleic Acid
  misc_feature (31)..(31): n stands for inosine
ucucugaucugaugaggccguuaggccgaanuaauuuc

SEQ ID NO: 11658 - RNA, 38 nt, Artificial Sequence
  Description of Artificial Sequence:  Enzymatic Nucleic Acid
  misc_feature (31)..(31): n stands for inosine
cugaucuccugaugaggccguuaggccgaanauuguaa

SEQ ID NO: 11659 - RNA, 38 nt, Artificial Sequence
  Description of Artificial Sequence:  Enzymatic Nucleic Acid
  misc_feature (31)..(31): n stands for inosine
gugcuucccugaugaggccguuaggccgaanaucucug

SEQ ID NO: 11660 - RNA, 38 nt, Artificial Sequence
  Description of Artificial Sequence:  Enzymatic Nucleic Acid
  misc_feature (31)..(31): n stands for inosine
agguauggcugaugaggccguuaggccgaancuuccug

SEQ ID NO: 11661 - RNA, 38 nt, Artificial Sequence
  Description of Artificial Sequence:  Enzymatic Nucleic Acid
  misc_feature (31)..(31): n stands for inosine
ggagguaucugaugaggccguuaggccgaanugcuucc

SEQ ID NO: 11662 - RNA, 38 nt, Artificial Sequence
  Description of Artificial Sequence:  Enzymatic Nucleic Acid
  misc_feature (31)..(31): n stands for inosine
aggagguacugaugaggccguuaggccgaangugcuuc

SEQ ID NO: 11663 - RNA, 38 nt, Artificial Sequence
  Description of Artificial Sequence:  Enzymatic Nucleic Acid
  misc_feature (31)..(31): n stands for inosine
ucgcaggacugaugaggccguuaggccgaanuauggug

SEQ ID NO: 11664 - RNA, 38 nt, Artificial Sequence
  Description of Artificial Sequence:  Enzymatic Nucleic Acid
  misc_feature (31)..(31): n stands for inosine
uucgcaggcugaugaggccguuaggccgaanguauggu

SEQ ID NO: 11665 - RNA, 38 nt, Artificial Sequence
  Description of Artificial Sequence:  Enzymatic Nucleic Acid
  misc_feature (31)..(31): n stands for inosine
guuucgcacugaugaggccguuaggccgaanagguaug

SEQ ID NO: 11666 - RNA, 38 nt, Artificial Sequence
  Description of Artificial Sequence:  Enzymatic Nucleic Acid
  misc_feature (31)..(31): n stands for inosine
gguuucgccugaugaggccguuaggccgaangagguau

SEQ ID NO: 11667 - RNA, 38 nt, Artificial Sequence
  Description of Artificial Sequence:  Enzymatic Nucleic Acid
  misc_feature (31)..(31): n stands for inosine
aucacugacugaugaggccguuaggccgaanuuucgca

SEQ ID NO: 11668 - RNA, 38 nt, Artificial Sequence
  Description of Artificial Sequence:  Enzymatic Nucleic Acid
  misc_feature (31)..(31): n stands for inosine
gaucacugcugaugaggccguuaggccgaanguuucgc

SEQ ID NO: 11669 - RNA, 38 nt, Artificial Sequence
  Description of Artificial Sequence:  Enzymatic Nucleic Acid
  misc_feature (31)..(31): n stands for inosine
gugaucaccugaugaggccguuaggccgaanagguuuc

SEQ ID NO: 11670 - RNA, 38 nt, Artificial Sequence
  Description of Artificial Sequence:  Enzymatic Nucleic Acid
  misc_feature (31)..(31): n stands for inosine
ccacugugcugaugaggccguuaggccgaanaucacug

SEQ ID NO: 11671 - RNA, 38 nt, Artificial Sequence
  Description of Artificial Sequence:  Enzymatic Nucleic Acid
  misc_feature (31)..(31): n stands for inosine
ggccacugcugaugaggccguuaggccgaanugaucac

SEQ ID NO: 11672 - RNA, 38 nt, Artificial Sequence
  Description of Artificial Sequence:  Enzymatic Nucleic Acid
  misc_feature (31)..(31): n stands for inosine
auggccaccugaugaggccguuaggccgaanugugauc

SEQ ID NO: 11673 - RNA, 38 nt, Artificial Sequence
  Description of Artificial Sequence:  Enzymatic Nucleic Acid
  misc_feature (31)..(31): n stands for inosine
cugcugaucugaugaggccguuaggccgaanccacugu

SEQ ID NO: 11674 - RNA, 38 nt, Artificial Sequence
  Description of Artificial Sequence:  Enzymatic Nucleic Acid
  misc_feature (31)..(31): n stands for inosine
acugcugacugaugaggccguuaggccgaangccacug

SEQ ID NO: 11675 - RNA, 38 nt, Artificial Sequence
  Description of Artificial Sequence:  Enzymatic Nucleic Acid
  misc_feature (31)..(31): n stands for inosine
ggaacugccugaugaggccguuaggccgaanauggcca

SEQ ID NO: 11676 - RNA, 38 nt, Artificial Sequence
  Description of Artificial Sequence:  Enzymatic Nucleic Acid
  misc_feature (31)..(31): n stands for inosine
gguggaaccugaugaggccguuaggccgaancugaugg

SEQ ID NO: 11677 - RNA, 38 nt, Artificial Sequence
  Description of Artificial Sequence:  Enzymatic Nucleic Acid
  misc_feature (31)..(31): n stands for inosine
aaaguggucugaugaggccguuaggccgaanaacugcu

SEQ ID NO: 11678 - RNA, 38 nt, Artificial Sequence
  Description of Artificial Sequence:  Enzymatic Nucleic Acid
  misc_feature (31)..(31): n stands for inosine
uaaaguggcugaugaggccguuaggccgaangaacugc

SEQ ID NO: 11679 - RNA, 38 nt, Artificial Sequence
  Description of Artificial Sequence:  Enzymatic Nucleic Acid
  misc_feature (31)..(31): n stands for inosine
ucuaaagucugaugaggccguuaggccgaanuggaacu

SEQ ID NO: 11680 - RNA, 38 nt, Artificial Sequence
  Description of Artificial Sequence:  Enzymatic Nucleic Acid
  misc_feature (31)..(31): n stands for inosine
gucuaaagcugaugaggccguuaggccgaanguggaac

SEQ ID NO: 11681 - RNA, 38 nt, Artificial Sequence
  Description of Artificial Sequence:  Enzymatic Nucleic Acid
  misc_feature (31)..(31): n stands for inosine
cagucuaacugaugaggccguuaggccgaanuggugga

SEQ ID NO: 11682 - RNA, 38 nt, Artificial Sequence
  Description of Artificial Sequence:  Enzymatic Nucleic Acid
  misc_feature (31)..(31): n stands for inosine
agcaugaccugaugaggccguuaggccgaanucuaaag

SEQ ID NO: 11683 - RNA, 38 nt, Artificial Sequence
  Description of Artificial Sequence:  Enzymatic Nucleic Acid
  misc_feature (31)..(31): n stands for inosine
cauuagcacugaugaggccguuaggccgaanacagucu

SEQ ID NO: 11684 - RNA, 38 nt, Artificial Sequence
  Description of Artificial Sequence:  Enzymatic Nucleic Acid
  misc_feature (31)..(31): n stands for inosine
acaccauucugaugaggccguuaggccgaancaugaca

SEQ ID NO: 11685 - RNA, 38 nt, Artificial Sequence
  Description of Artificial Sequence:  Enzymatic Nucleic Acid
  misc_feature (31)..(31): n stands for inosine
aggcucggcugaugaggccguuaggccgaanacaccau

SEQ ID NO: 11686 - RNA, 38 nt, Artificial Sequence
  Description of Artificial Sequence:  Enzymatic Nucleic Acid
  misc_feature (31)..(31): n stands for inosine
gaggcucgcugaugaggccguuaggccgaangacacca

SEQ ID NO: 11687 - RNA, 38 nt, Artificial Sequence
  Description of Artificial Sequence:  Enzymatic Nucleic Acid
  misc_feature (31)..(31): n stands for inosine
ugaggcuccugaugaggccguuaggccgaanggacacc

SEQ ID NO: 11688 - RNA, 38 nt, Artificial Sequence
  Description of Artificial Sequence:  Enzymatic Nucleic Acid
  misc_feature (31)..(31): n stands for inosine
ugaucugacugaugaggccguuaggccgaancucgggg

SEQ ID NO: 11689 - RNA, 38 nt, Artificial Sequence
  Description of Artificial Sequence:  Enzymatic Nucleic Acid
  misc_feature (31)..(31): n stands for inosine
gugaucugcugaugaggccguuaggccgaangcucggg

SEQ ID NO: 11690 - RNA, 38 nt, Artificial Sequence
  Description of Artificial Sequence:  Enzymatic Nucleic Acid
  misc_feature (31)..(31): n stands for inosine
aagugauccugaugaggccguuaggccgaanaggcucg

SEQ ID NO: 11691 - RNA, 38 nt, Artificial Sequence
  Description of Artificial Sequence:  Enzymatic Nucleic Acid
  misc_feature (31)..(31): n stands for inosine
aaaccaagcugaugaggccguuaggccgaanaucugag

SEQ ID NO: 11692 - RNA, 38 nt, Artificial Sequence
  Description of Artificial Sequence:  Enzymatic Nucleic Acid
  misc_feature (31)..(31): n stands for inosine
uuaaaccacugaugaggccguuaggccgaanugaucug

SEQ ID NO: 11693 - RNA, 38 nt, Artificial Sequence
  Description of Artificial Sequence:  Enzymatic Nucleic Acid
  misc_feature (31)..(31): n stands for inosine
uuuguggucugaugaggccguuaggccgaanuuuuuaa

SEQ ID NO: 11694 - RNA, 38 nt, Artificial Sequence
  Description of Artificial Sequence:  Enzymatic Nucleic Acid
  misc_feature (31)..(31): n stands for inosine
uauuuugucugaugaggccguuaggccgaanuuguuuu

SEQ ID NO: 11695 - RNA, 38 nt, Artificial Sequence
  Description of Artificial Sequence:  Enzymatic Nucleic Acid
  misc_feature (31)..(31): n stands for inosine
guauuuugcugaugaggccguuaggccgaanguuguuu

SEQ ID NO: 11696 - RNA, 38 nt, Artificial Sequence
  Description of Artificial Sequence:  Enzymatic Nucleic Acid
  misc_feature (31)..(31): n stands for inosine
uuguauuucugaugaggccguuaggccgaanugguugu

SEQ ID NO: 11697 - RNA, 38 nt, Artificial Sequence
  Description of Artificial Sequence:  Enzymatic Nucleic Acid
  misc_feature (31)..(31): n stands for inosine
gcucuugucugaugaggccguuaggccgaanuauuuug

SEQ ID NO: 11698 - RNA, 38 nt, Artificial Sequence
  Description of Artificial Sequence:  Enzymatic Nucleic Acid
  misc_feature (31)..(31): n stands for inosine
caggcucucugaugaggccguuaggccgaanuuguauu

SEQ ID NO: 11699 - RNA, 38 nt, Artificial Sequence
  Description of Artificial Sequence:  Enzymatic Nucleic Acid
  misc_feature (31)..(31): n stands for inosine
uaauuccacugaugaggccguuaggccgaancucuugu

SEQ ID NO: 11700 - RNA, 38 nt, Artificial Sequence
  Description of Artificial Sequence:  Enzymatic Nucleic Acid
  misc_feature (31)..(31): n stands for inosine
auaauucccugaugaggccguuaggccgaangcucuug

SEQ ID NO: 11701 - RNA, 38 nt, Artificial Sequence
  Description of Artificial Sequence:  Enzymatic Nucleic Acid
  misc_feature (31)..(31): n stands for inosine
ugcuuccucugaugaggccguuaggccgaanuccuaaa

SEQ ID NO: 11702 - RNA, 38 nt, Artificial Sequence
  Description of Artificial Sequence:  Enzymatic Nucleic Acid
  misc_feature (31)..(31): n stands for inosine
cugcuucccugaugaggccguuaggccgaanguccuaa

SEQ ID NO: 11703 - RNA, 38 nt, Artificial Sequence
  Description of Artificial Sequence:  Enzymatic Nucleic Acid
  misc_feature (31)..(31): n stands for inosine
cagcgugccugaugaggccguuaggccgaancuuccug

SEQ ID NO: 11704 - RNA, 38 nt, Artificial Sequence
  Description of Artificial Sequence:  Enzymatic Nucleic Acid
  misc_feature (31)..(31): n stands for inosine
aaacagcgcugaugaggccguuaggccgaancugcuuc

SEQ ID NO: 11705 - RNA, 38 nt, Artificial Sequence
  Description of Artificial Sequence:  Enzymatic Nucleic Acid
  misc_feature (31)..(31): n stands for inosine
caauaaaccugaugaggccguuaggccgaancgugcug

SEQ ID NO: 11706 - RNA, 38 nt, Artificial Sequence
  Description of Artificial Sequence:  Enzymatic Nucleic Acid
  misc_feature (31)..(31): n stands for inosine
cucuucugcugaugaggccguuaggccgaanacucuuu

SEQ ID NO: 11707 - RNA, 38 nt, Artificial Sequence
  Description of Artificial Sequence:  Enzymatic Nucleic Acid
  misc_feature (31)..(31): n stands for inosine
uccucuuccugaugaggccguuaggccgaanugacucu

SEQ ID NO: 11708 - RNA, 38 nt, Artificial Sequence
  Description of Artificial Sequence:  Enzymatic Nucleic Acid
  misc_feature (31)..(31): n stands for inosine
gcagugaucugaugaggccguuaggccgaanacaccuu

SEQ ID NO: 11709 - RNA, 38 nt, Artificial Sequence
  Description of Artificial Sequence:  Enzymatic Nucleic Acid
  misc_feature (31)..(31): n stands for inosine
cuuugcagcugaugaggccguuaggccgaanauagaca

SEQ ID NO: 11710 - RNA, 38 nt, Artificial Sequence
  Description of Artificial Sequence:  Enzymatic Nucleic Acid
  misc_feature (31)..(31): n stands for inosine
ggcuuugccugaugaggccguuaggccgaanugauaga

SEQ ID NO: 11711 - RNA, 38 nt, Artificial Sequence
  Description of Artificial Sequence:  Enzymatic Nucleic Acid
  misc_feature (31)..(31): n stands for inosine
gguggcuucugaugaggccguuaggccgaancagugau

SEQ ID NO: 11712 - RNA, 38 nt, Artificial Sequence
  Description of Artificial Sequence:  Enzymatic Nucleic Acid
  misc_feature (31)..(31): n stands for inosine
ugguuggucugaugaggccguuaggccgaancuuugca

SEQ ID NO: 11713 - RNA, 38 nt, Artificial Sequence
  Description of Artificial Sequence:  Enzymatic Nucleic Acid
  misc_feature (31)..(31): n stands for inosine
cugguuggcugaugaggccguuaggccgaangcuuugc

SEQ ID NO: 11714 - RNA, 38 nt, Artificial Sequence
  Description of Artificial Sequence:  Enzymatic Nucleic Acid
  misc_feature (31)..(31): n stands for inosine
uucugguucugaugaggccguuaggccgaanuggcuuu

SEQ ID NO: 11715 - RNA, 38 nt, Artificial Sequence
  Description of Artificial Sequence:  Enzymatic Nucleic Acid
  misc_feature (31)..(31): n stands for inosine
cuucuggucugaugaggccguuaggccgaanguggcuu

SEQ ID NO: 11716 - RNA, 38 nt, Artificial Sequence
  Description of Artificial Sequence:  Enzymatic Nucleic Acid
  misc_feature (31)..(31): n stands for inosine
gcccuucucugaugaggccguuaggccgaanuuggugg

SEQ ID NO: 11717 - RNA, 38 nt, Artificial Sequence
  Description of Artificial Sequence:  Enzymatic Nucleic Acid
  misc_feature (31)..(31): n stands for inosine
agcccuuccugaugaggccguuaggccgaanguuggug

SEQ ID NO: 11718 - RNA, 38 nt, Artificial Sequence
  Description of Artificial Sequence:  Enzymatic Nucleic Acid
  misc_feature (31)..(31): n stands for inosine
uuccacagcugaugaggccguuaggccgaancccuucu

SEQ ID NO: 11719 - RNA, 38 nt, Artificial Sequence
  Description of Artificial Sequence:  Enzymatic Nucleic Acid
  misc_feature (31)..(31): n stands for inosine
cuuuccaccugaugaggccguuaggccgaanagcccuu

SEQ ID NO: 11720 - RNA, 38 nt, Artificial Sequence
  Description of Artificial Sequence:  Enzymatic Nucleic Acid
  misc_feature (31)..(31): n stands for inosine
agguaugccugaugaggccguuaggccgaanaacuuuc

SEQ ID NO: 11721 - RNA, 38 nt, Artificial Sequence
  Description of Artificial Sequence:  Enzymatic Nucleic Acid
  misc_feature (31)..(31): n stands for inosine
gugagguacugaugaggccguuaggccgaancugaacu

SEQ ID NO: 11722 - RNA, 38 nt, Artificial Sequence
  Description of Artificial Sequence:  Enzymatic Nucleic Acid
  misc_feature (31)..(31): n stands for inosine
aacagugacugaugaggccguuaggccgaanuaugcug

SEQ ID NO: 11723 - RNA, 38 nt, Artificial Sequence
  Description of Artificial Sequence:  Enzymatic Nucleic Acid
  misc_feature (31)..(31): n stands for inosine
gaacagugcugaugaggccguuaggccgaanguaugcu

SEQ ID NO: 11724 - RNA, 38 nt, Artificial Sequence
  Description of Artificial Sequence:  Enzymatic Nucleic Acid
  misc_feature (31)..(31): n stands for inosine
uugaacagcugaugaggccguuaggccgaanagguaug

SEQ ID NO: 11725 - RNA, 38 nt, Artificial Sequence
  Description of Artificial Sequence:  Enzymatic Nucleic Acid
  misc_feature (31)..(31): n stands for inosine
ccuugaaccugaugaggccguuaggccgaanugaggua

SEQ ID NO: 11726 - RNA, 38 nt, Artificial Sequence
  Description of Artificial Sequence:  Enzymatic Nucleic Acid
  misc_feature (31)..(31): n stands for inosine
agguuccucugaugaggccguuaggccgaanaacagug

SEQ ID NO: 11727 - RNA, 38 nt, Artificial Sequence
  Description of Artificial Sequence:  Enzymatic Nucleic Acid
  misc_feature (31)..(31): n stands for inosine
uuguccgacugaugaggccguuaggccgaanuuccuug

SEQ ID NO: 11728 - RNA, 38 nt, Artificial Sequence
  Description of Artificial Sequence:  Enzymatic Nucleic Acid
  misc_feature (31)..(31): n stands for inosine
cuuguccgcugaugaggccguuaggccgaanguuccuu

SEQ ID NO: 11729 - RNA, 38 nt, Artificial Sequence
  Description of Artificial Sequence:  Enzymatic Nucleic Acid
  misc_feature (31)..(31): n stands for inosine
auuagacucugaugaggccguuaggccgaanuccgagg

SEQ ID NO: 11730 - RNA, 38 nt, Artificial Sequence
  Description of Artificial Sequence:  Enzymatic Nucleic Acid
  misc_feature (31)..(31): n stands for inosine
uccagauucugaugaggccguuaggccgaanacuuguc

SEQ ID NO: 11731 - RNA, 38 nt, Artificial Sequence
  Description of Artificial Sequence:  Enzymatic Nucleic Acid
  misc_feature (31)..(31): n stands for inosine
ucagcucccugaugaggccguuaggccgaanauuagac

SEQ ID NO: 11732 - RNA, 38 nt, Artificial Sequence
  Description of Artificial Sequence:  Enzymatic Nucleic Acid
  misc_feature (31)..(31): n stands for inosine
gagugauccugaugaggccguuaggccgaancuccaga

SEQ ID NO: 11733 - RNA, 38 nt, Artificial Sequence
  Description of Artificial Sequence:  Enzymatic Nucleic Acid
  misc_feature (31)..(31): n stands for inosine
uguuagagcugaugaggccguuaggccgaanaucagcu

SEQ ID NO: 11734 - RNA, 38 nt, Artificial Sequence
  Description of Artificial Sequence:  Enzymatic Nucleic Acid
  misc_feature (31)..(31): n stands for inosine
cauguuagcugaugaggccguuaggccgaanugaucag

SEQ ID NO: 11735 - RNA, 38 nt, Artificial Sequence
  Description of Artificial Sequence:  Enzymatic Nucleic Acid
  misc_feature (31)..(31): n stands for inosine
ugcauguucugaugaggccguuaggccgaanagugauc

SEQ ID NO: 11736 - RNA, 38 nt, Artificial Sequence
  Description of Artificial Sequence:  Enzymatic Nucleic Acid
  misc_feature (31)..(31): n stands for inosine
caggugcacugaugaggccguuaggccgaanuuagagu

SEQ ID NO: 11737 - RNA, 38 nt, Artificial Sequence
  Description of Artificial Sequence:  Enzymatic Nucleic Acid
  misc_feature (31)..(31): n stands for inosine
cacacaggcugaugaggccguuaggccgaancauguua

SEQ ID NO: 11738 - RNA, 38 nt, Artificial Sequence
  Description of Artificial Sequence:  Enzymatic Nucleic Acid
  misc_feature (31)..(31): n stands for inosine
gccacacacugaugaggccguuaggccgaanugcaugu

SEQ ID NO: 11739 - RNA, 38 nt, Artificial Sequence
  Description of Artificial Sequence:  Enzymatic Nucleic Acid
  misc_feature (31)..(31): n stands for inosine
agccacaccugaugaggccguuaggccgaangugcaug

SEQ ID NO: 11740 - RNA, 38 nt, Artificial Sequence
  Description of Artificial Sequence:  Enzymatic Nucleic Acid
  misc_feature (31)..(31): n stands for inosine
agagucgccugaugaggccguuaggccgaanccacaca

SEQ ID NO: 11741 - RNA, 38 nt, Artificial Sequence
  Description of Artificial Sequence:  Enzymatic Nucleic Acid
  misc_feature (31)..(31): n stands for inosine
cagaagagcugaugaggccguuaggccgaanucgcagc

SEQ ID NO: 11742 - RNA, 38 nt, Artificial Sequence
  Description of Artificial Sequence:  Enzymatic Nucleic Acid
  misc_feature (31)..(31): n stands for inosine
gccagaagcugaugaggccguuaggccgaanagucgca

SEQ ID NO: 11743 - RNA, 38 nt, Artificial Sequence
  Description of Artificial Sequence:  Enzymatic Nucleic Acid
  misc_feature (31)..(31): n stands for inosine
gagccagacugaugaggccguuaggccgaanagagucg

SEQ ID NO: 11744 - RNA, 38 nt, Artificial Sequence
  Description of Artificial Sequence:  Enzymatic Nucleic Acid
  misc_feature (31)..(31): n stands for inosine
uaggagcccugaugaggccguuaggccgaanaagagag

SEQ ID NO: 11745 - RNA, 38 nt, Artificial Sequence
  Description of Artificial Sequence:  Enzymatic Nucleic Acid
  misc_feature (31)..(31): n stands for inosine
uuaauaggcugaugaggccguuaggccgaanccagaag

SEQ ID NO: 11746 - RNA, 38 nt, Artificial Sequence
  Description of Artificial Sequence:  Enzymatic Nucleic Acid
  misc_feature (31)..(31): n stands for inosine
gguuaauacugaugaggccguuaggccgaanagccaga

SEQ ID NO: 11747 - RNA, 38 nt, Artificial Sequence
  Description of Artificial Sequence:  Enzymatic Nucleic Acid
  misc_feature (31)..(31): n stands for inosine
ggguuaaucugaugaggccguuaggccgaangagccag

SEQ ID NO: 11748 - RNA, 38 nt, Artificial Sequence
  Description of Artificial Sequence:  Enzymatic Nucleic Acid
  misc_feature (31)..(31): n stands for inosine
auaaggagcugaugaggccguuaggccgaanuuaauag

SEQ ID NO: 11749 - RNA, 38 nt, Artificial Sequence
  Description of Artificial Sequence:  Enzymatic Nucleic Acid
  misc_feature (31)..(31): n stands for inosine
gauaaggacugaugaggccguuaggccgaanguuaaua

SEQ ID NO: 11750 - RNA, 38 nt, Artificial Sequence
  Description of Artificial Sequence:  Enzymatic Nucleic Acid
  misc_feature (31)..(31): n stands for inosine
ggauaaggcugaugaggccguuaggccgaangguuaau

SEQ ID NO: 11751 - RNA, 38 nt, Artificial Sequence
  Description of Artificial Sequence:  Enzymatic Nucleic Acid
  misc_feature (31)..(31): n stands for inosine
ucggauaacugaugaggccguuaggccgaanaggguua

SEQ ID NO: 11752 - RNA, 38 nt, Artificial Sequence
  Description of Artificial Sequence:  Enzymatic Nucleic Acid
  misc_feature (31)..(31): n stands for inosine
uucggauacugaugaggccguuaggccgaangaggguu

SEQ ID NO: 11753 - RNA, 38 nt, Artificial Sequence
  Description of Artificial Sequence:  Enzymatic Nucleic Acid
  misc_feature (31)..(31): n stands for inosine
cauuuuuccugaugaggccguuaggccgaanauaagga

SEQ ID NO: 11754 - RNA, 38 nt, Artificial Sequence
  Description of Artificial Sequence:  Enzymatic Nucleic Acid
  misc_feature (31)..(31): n stands for inosine
ucagaagacugaugaggccguuaggccgaanaccuuuu

SEQ ID NO: 11755 - RNA, 38 nt, Artificial Sequence
  Description of Artificial Sequence:  Enzymatic Nucleic Acid
  misc_feature (31)..(31): n stands for inosine
auuucagacugaugaggccguuaggccgaanaagaccu

SEQ ID NO: 11756 - RNA, 38 nt, Artificial Sequence
  Description of Artificial Sequence:  Enzymatic Nucleic Acid
  misc_feature (31)..(31): n stands for inosine
uuuauuuccugaugaggccguuaggccgaanaagaaga

SEQ ID NO: 11757 - RNA, 38 nt, Artificial Sequence
  Description of Artificial Sequence:  Enzymatic Nucleic Acid
  misc_feature (31)..(31): n stands for inosine
agguaguccugaugaggccguuaggccgaanucuuuau

SEQ ID NO: 11758 - RNA, 38 nt, Artificial Sequence
  Description of Artificial Sequence:  Enzymatic Nucleic Acid
  misc_feature (31)..(31): n stands for inosine
ugauaggucugaugaggccguuaggccgaanucagucu

SEQ ID NO: 11759 - RNA, 38 nt, Artificial Sequence
  Description of Artificial Sequence:  Enzymatic Nucleic Acid
  misc_feature (31)..(31): n stands for inosine
aauugauacugaugaggccguuaggccgaanuagucag

SEQ ID NO: 11760 - RNA, 38 nt, Artificial Sequence
  Description of Artificial Sequence:  Enzymatic Nucleic Acid
  misc_feature (31)..(31): n stands for inosine
uaauugaucugaugaggccguuaggccgaanguaguca

SEQ ID NO: 11761 - RNA, 38 nt, Artificial Sequence
  Description of Artificial Sequence:  Enzymatic Nucleic Acid
  misc_feature (31)..(31): n stands for inosine
auuauaaucugaugaggccguuaggccgaanauaggua

SEQ ID NO: 11762 - RNA, 38 nt, Artificial Sequence
  Description of Artificial Sequence:  Enzymatic Nucleic Acid
  misc_feature (31)..(31): n stands for inosine
uucaucugcugaugaggccguuaggccgaanuccauua

SEQ ID NO: 11763 - RNA, 38 nt, Artificial Sequence
  Description of Artificial Sequence:  Enzymatic Nucleic Acid
  misc_feature (31)..(31): n stands for inosine
cuucaucucugaugaggccguuaggccgaanguccauu

SEQ ID NO: 11764 - RNA, 38 nt, Artificial Sequence
  Description of Artificial Sequence:  Enzymatic Nucleic Acid
  misc_feature (31)..(31): n stands for inosine
acuucauccugaugaggccguuaggccgaangguccau

SEQ ID NO: 11765 - RNA, 38 nt, Artificial Sequence
  Description of Artificial Sequence:  Enzymatic Nucleic Acid
  misc_feature (31)..(31): n stands for inosine
cauccaaacugaugaggccguuaggccgaanaacuuca

SEQ ID NO: 11766 - RNA, 38 nt, Artificial Sequence
  Description of Artificial Sequence:  Enzymatic Nucleic Acid
  misc_feature (31)..(31): n stands for inosine
ucauccaacugaugaggccguuaggccgaangaacuuc

SEQ ID NO: 11767 - RNA, 38 nt, Artificial Sequence
  Description of Artificial Sequence:  Enzymatic Nucleic Acid
  misc_feature (31)..(31): n stands for inosine
gcucacaccugaugaggccguuaggccgaancucaucc

SEQ ID NO: 11768 - RNA, 38 nt, Artificial Sequence
  Description of Artificial Sequence:  Enzymatic Nucleic Acid
  misc_feature (31)..(31): n stands for inosine
cauaagggcugaugaggccguuaggccgaanccgcuca

SEQ ID NO: 11769 - RNA, 38 nt, Artificial Sequence
  Description of Artificial Sequence:  Enzymatic Nucleic Acid
  misc_feature (31)..(31): n stands for inosine
aucauaagcugaugaggccguuaggccgaanagccgcu

SEQ ID NO: 11770 - RNA, 38 nt, Artificial Sequence
  Description of Artificial Sequence:  Enzymatic Nucleic Acid
  misc_feature (31)..(31): n stands for inosine
caucauaacugaugaggccguuaggccgaangagccgc

SEQ ID NO: 11771 - RNA, 38 nt, Artificial Sequence
  Description of Artificial Sequence:  Enzymatic Nucleic Acid
  misc_feature (31)..(31): n stands for inosine
gcaucauacugaugaggccguuaggccgaanggagccg

SEQ ID NO: 11772 - RNA, 38 nt, Artificial Sequence
  Description of Artificial Sequence:  Enzymatic Nucleic Acid
  misc_feature (31)..(31): n stands for inosine
cacuugcucugaugaggccguuaggccgaancaucaua

SEQ ID NO: 11773 - RNA, 38 nt, Artificial Sequence
  Description of Artificial Sequence:  Enzymatic Nucleic Acid
  misc_feature (31)..(31): n stands for inosine
ccacuugccugaugaggccguuaggccgaangcaucau

SEQ ID NO: 11774 - RNA, 38 nt, Artificial Sequence
  Description of Artificial Sequence:  Enzymatic Nucleic Acid
  misc_feature (31)..(31): n stands for inosine
cucccacucugaugaggccguuaggccgaancuggcau

SEQ ID NO: 11775 - RNA, 38 nt, Artificial Sequence
  Description of Artificial Sequence:  Enzymatic Nucleic Acid
  misc_feature (31)..(31): n stands for inosine
cucucccgcugaugaggccguuaggccgaancaaacuc

SEQ ID NO: 11776 - RNA, 38 nt, Artificial Sequence
  Description of Artificial Sequence:  Enzymatic Nucleic Acid
  misc_feature (31)..(31): n stands for inosine
ucucuccccugaugaggccguuaggccgaangcaaacu

SEQ ID NO: 11777 - RNA, 38 nt, Artificial Sequence
  Description of Artificial Sequence:  Enzymatic Nucleic Acid
  misc_feature (31)..(31): n stands for inosine
ccaguuuacugaugaggccguuaggccgaanucucucc

SEQ ID NO: 11778 - RNA, 38 nt, Artificial Sequence
  Description of Artificial Sequence:  Enzymatic Nucleic Acid
  misc_feature (31)..(31): n stands for inosine
auuugccccugaugaggccguuaggccgaanuuuaagu

SEQ ID NO: 11779 - RNA, 38 nt, Artificial Sequence
  Description of Artificial Sequence:  Enzymatic Nucleic Acid
  misc_feature (31)..(31): n stands for inosine
aagugauucugaugaggccguuaggccgaancccaguu

SEQ ID NO: 11780 - RNA, 38 nt, Artificial Sequence
  Description of Artificial Sequence:  Enzymatic Nucleic Acid
  misc_feature (31)..(31): n stands for inosine
cuuccaagcugaugaggccguuaggccgaanauuugcc

SEQ ID NO: 11781 - RNA, 38 nt, Artificial Sequence
  Description of Artificial Sequence:  Enzymatic Nucleic Acid
  misc_feature (31)..(31): n stands for inosine
cucuuccacugaugaggccguuaggccgaanugauuug

SEQ ID NO: 11782 - RNA, 38 nt, Artificial Sequence
  Description of Artificial Sequence:  Enzymatic Nucleic Acid
  misc_feature (31)..(31): n stands for inosine
uuuccaaacugaugaggccguuaggccgaanccccucu

SEQ ID NO: 11783 - RNA, 38 nt, Artificial Sequence
  Description of Artificial Sequence:  Enzymatic Nucleic Acid
  misc_feature (31)..(31): n stands for inosine
cugaugcucugaugaggccguuaggccgaanaaccacu

SEQ ID NO: 11784 - RNA, 38 nt, Artificial Sequence
  Description of Artificial Sequence:  Enzymatic Nucleic Acid
  misc_feature (31)..(31): n stands for inosine
aaugcugacugaugaggccguuaggccgaancuugaac

SEQ ID NO: 11785 - RNA, 38 nt, Artificial Sequence
  Description of Artificial Sequence:  Enzymatic Nucleic Acid
  misc_feature (31)..(31): n stands for inosine
ccaaaugccugaugaggccguuaggccgaanaugcuug

SEQ ID NO: 11786 - RNA, 38 nt, Artificial Sequence
  Description of Artificial Sequence:  Enzymatic Nucleic Acid
  misc_feature (31)..(31): n stands for inosine
augccaaacugaugaggccguuaggccgaancugaugc

SEQ ID NO: 11787 - RNA, 38 nt, Artificial Sequence
  Description of Artificial Sequence:  Enzymatic Nucleic Acid
  misc_feature (31)..(31): n stands for inosine
uuucuuaacugaugaggccguuaggccgaanccaaaug

SEQ ID NO: 11788 - RNA, 38 nt, Artificial Sequence
  Description of Artificial Sequence:  Enzymatic Nucleic Acid
  misc_feature (31)..(31): n stands for inosine
cacguaggcugaugaggccguuaggccgaanauuucuu

SEQ ID NO: 11789 - RNA, 38 nt, Artificial Sequence
  Description of Artificial Sequence:  Enzymatic Nucleic Acid
  misc_feature (31)..(31): n stands for inosine
ggcacguacugaugaggccguuaggccgaanugauuuc

SEQ ID NO: 11790 - RNA, 38 nt, Artificial Sequence
  Description of Artificial Sequence:  Enzymatic Nucleic Acid
  misc_feature (31)..(31): n stands for inosine
cggcacgucugaugaggccguuaggccgaangugauuu

SEQ ID NO: 11791 - RNA, 38 nt, Artificial Sequence
  Description of Artificial Sequence:  Enzymatic Nucleic Acid
  misc_feature (31)..(31): n stands for inosine
cacagucccugaugaggccguuaggccgaancacguag

SEQ ID NO: 11792 - RNA, 38 nt, Artificial Sequence
  Description of Artificial Sequence:  Enzymatic Nucleic Acid
  misc_feature (31)..(31): n stands for inosine
acagccaccugaugaggccguuaggccgaanuccggca

SEQ ID NO: 11793 - RNA, 38 nt, Artificial Sequence
  Description of Artificial Sequence:  Enzymatic Nucleic Acid
  misc_feature (31)..(31): n stands for inosine
auuuucaccugaugaggccguuaggccgaanccacagu

SEQ ID NO: 11794 - RNA, 38 nt, Artificial Sequence
  Description of Artificial Sequence:  Enzymatic Nucleic Acid
  misc_feature (31)..(31): n stands for inosine
ccucuuuccugaugaggccguuaggccgaancauuuuc

SEQ ID NO: 11795 - RNA, 38 nt, Artificial Sequence
  Description of Artificial Sequence:  Enzymatic Nucleic Acid
  misc_feature (31)..(31): n stands for inosine
cuggccgucugaugaggccguuaggccgaancccccuc

SEQ ID NO: 11796 - RNA, 38 nt, Artificial Sequence
  Description of Artificial Sequence:  Enzymatic Nucleic Acid
  misc_feature (31)..(31): n stands for inosine
gcuggccgcugaugaggccguuaggccgaangcccccu

SEQ ID NO: 11797 - RNA, 38 nt, Artificial Sequence
  Description of Artificial Sequence:  Enzymatic Nucleic Acid
  misc_feature (31)..(31): n stands for inosine
uacucgcucugaugaggccguuaggccgaanccguggc

SEQ ID NO: 11798 - RNA, 38 nt, Artificial Sequence
  Description of Artificial Sequence:  Enzymatic Nucleic Acid
  misc_feature (31)..(31): n stands for inosine
guacucgccugaugaggccguuaggccgaangccgugg

SEQ ID NO: 11799 - RNA, 38 nt, Artificial Sequence
  Description of Artificial Sequence:  Enzymatic Nucleic Acid
  misc_feature (31)..(31): n stands for inosine
cagagcuucugaugaggccguuaggccgaanuacucgc

SEQ ID NO: 11800 - RNA, 38 nt, Artificial Sequence
  Description of Artificial Sequence:  Enzymatic Nucleic Acid
  misc_feature (31)..(31): n stands for inosine
gucaucagcugaugaggccguuaggccgaancuuugua

SEQ ID NO: 11801 - RNA, 38 nt, Artificial Sequence
  Description of Artificial Sequence:  Enzymatic Nucleic Acid
  misc_feature (31)..(31): n stands for inosine
cagucauccugaugaggccguuaggccgaanagcuuug

SEQ ID NO: 11802 - RNA, 38 nt, Artificial Sequence
  Description of Artificial Sequence:  Enzymatic Nucleic Acid
  misc_feature (31)..(31): n stands for inosine
uuuagcuccugaugaggccguuaggccgaanucaucag

SEQ ID NO: 11803 - RNA, 38 nt, Artificial Sequence
  Description of Artificial Sequence:  Enzymatic Nucleic Acid
  misc_feature (31)..(31): n stands for inosine
agauuuuucugaugaggccguuaggccgaancucaguc

SEQ ID NO: 11804 - RNA, 38 nt, Artificial Sequence
  Description of Artificial Sequence:  Enzymatic Nucleic Acid
  misc_feature (31)..(31): n stands for inosine
gugggucacugaugaggccguuaggccgaanauuuuua

SEQ ID NO: 11805 - RNA, 38 nt, Artificial Sequence
  Description of Artificial Sequence:  Enzymatic Nucleic Acid
  misc_feature (31)..(31): n stands for inosine
ccaaugugcugaugaggccguuaggccgaanucaagau

SEQ ID NO: 11806 - RNA, 38 nt, Artificial Sequence
  Description of Artificial Sequence:  Enzymatic Nucleic Acid
  misc_feature (31)..(31): n stands for inosine
gccaaugucugaugaggccguuaggccgaangucaaga

SEQ ID NO: 11807 - RNA, 38 nt, Artificial Sequence
  Description of Artificial Sequence:  Enzymatic Nucleic Acid
  misc_feature (31)..(31): n stands for inosine
ggccaaugcugaugaggccguuaggccgaanggucaag

SEQ ID NO: 11808 - RNA, 38 nt, Artificial Sequence
  Description of Artificial Sequence:  Enzymatic Nucleic Acid
  misc_feature (31)..(31): n stands for inosine
guggccaacugaugaggccguuaggccgaanuggguca

SEQ ID NO: 11809 - RNA, 38 nt, Artificial Sequence
  Description of Artificial Sequence:  Enzymatic Nucleic Acid
  misc_feature (31)..(31): n stands for inosine
cagauggucugaugaggccguuaggccgaanccaaugu

SEQ ID NO: 11810 - RNA, 38 nt, Artificial Sequence
  Description of Artificial Sequence:  Enzymatic Nucleic Acid
  misc_feature (31)..(31): n stands for inosine
ucagauggcugaugaggccguuaggccgaangccaaug

SEQ ID NO: 11811 - RNA, 38 nt, Artificial Sequence
  Description of Artificial Sequence:  Enzymatic Nucleic Acid
  misc_feature (31)..(31): n stands for inosine
guucagaucugaugaggccguuaggccgaanuggccaa

SEQ ID NO: 11812 - RNA, 38 nt, Artificial Sequence
  Description of Artificial Sequence:  Enzymatic Nucleic Acid
  misc_feature (31)..(31): n stands for inosine
cguucagacugaugaggccguuaggccgaanguggcca

SEQ ID NO: 11813 - RNA, 38 nt, Artificial Sequence
  Description of Artificial Sequence:  Enzymatic Nucleic Acid
  misc_feature (31)..(31): n stands for inosine
ccacguuccugaugaggccguuaggccgaanauggugg

SEQ ID NO: 11814 - RNA, 38 nt, Artificial Sequence
  Description of Artificial Sequence:  Enzymatic Nucleic Acid
  misc_feature (31)..(31): n stands for inosine
ucccagcacugaugaggccguuaggccgaanuuaacca

SEQ ID NO: 11815 - RNA, 38 nt, Artificial Sequence
  Description of Artificial Sequence:  Enzymatic Nucleic Acid
  misc_feature (31)..(31): n stands for inosine
cucccagccugaugaggccguuaggccgaanguuaacc

SEQ ID NO: 11816 - RNA, 38 nt, Artificial Sequence
  Description of Artificial Sequence:  Enzymatic Nucleic Acid
  misc_feature (31)..(31): n stands for inosine
aggcuccccugaugaggccguuaggccgaancagguua

SEQ ID NO: 11817 - RNA, 38 nt, Artificial Sequence
  Description of Artificial Sequence:  Enzymatic Nucleic Acid
  misc_feature (31)..(31): n stands for inosine
uuggugcacugaugaggccguuaggccgaancucccag

SEQ ID NO: 11818 - RNA, 38 nt, Artificial Sequence
  Description of Artificial Sequence:  Enzymatic Nucleic Acid
  misc_feature (31)..(31): n stands for inosine
cuuggugccugaugaggccguuaggccgaangcuccca

SEQ ID NO: 11819 - RNA, 38 nt, Artificial Sequence
  Description of Artificial Sequence:  Enzymatic Nucleic Acid
  misc_feature (31)..(31): n stands for inosine
uugcuuggcugaugaggccguuaggccgaancaggcuc

SEQ ID NO: 11820 - RNA, 38 nt, Artificial Sequence
  Description of Artificial Sequence:  Enzymatic Nucleic Acid
  misc_feature (31)..(31): n stands for inosine
ccuugcuucugaugaggccguuaggccgaanugcaggc

SEQ ID NO: 11821 - RNA, 38 nt, Artificial Sequence
  Description of Artificial Sequence:  Enzymatic Nucleic Acid
  misc_feature (31)..(31): n stands for inosine
uccuugcucugaugaggccguuaggccgaangugcagg

SEQ ID NO: 11822 - RNA, 38 nt, Artificial Sequence
  Description of Artificial Sequence:  Enzymatic Nucleic Acid
  misc_feature (31)..(31): n stands for inosine
gcccuccucugaugaggccguuaggccgaancuuggug

SEQ ID NO: 11823 - RNA, 38 nt, Artificial Sequence
  Description of Artificial Sequence:  Enzymatic Nucleic Acid
  misc_feature (31)..(31): n stands for inosine
ccaucagacugaugaggccguuaggccgaancccuccu

SEQ ID NO: 11824 - RNA, 38 nt, Artificial Sequence
  Description of Artificial Sequence:  Enzymatic Nucleic Acid
  misc_feature (31)..(31): n stands for inosine
accaucagcugaugaggccguuaggccgaangcccucc

SEQ ID NO: 11825 - RNA, 38 nt, Artificial Sequence
  Description of Artificial Sequence:  Enzymatic Nucleic Acid
  misc_feature (31)..(31): n stands for inosine
ucaccauccugaugaggccguuaggccgaanaggcccu

SEQ ID NO: 11826 - RNA, 38 nt, Artificial Sequence
  Description of Artificial Sequence:  Enzymatic Nucleic Acid
  misc_feature (31)..(31): n stands for inosine
auauuugccugaugaggccguuaggccgaanuauucaa

SEQ ID NO: 11827 - RNA, 38 nt, Artificial Sequence
  Description of Artificial Sequence:  Enzymatic Nucleic Acid
  misc_feature (31)..(31): n stands for inosine
uccauauucugaugaggccguuaggccgaancaguauu

SEQ ID NO: 11828 - RNA, 38 nt, Artificial Sequence
  Description of Artificial Sequence:  Enzymatic Nucleic Acid
  misc_feature (31)..(31): n stands for inosine
aguuggagcugaugaggccguuaggccgaanauuucca

SEQ ID NO: 11829 - RNA, 38 nt, Artificial Sequence
  Description of Artificial Sequence:  Enzymatic Nucleic Acid
  misc_feature (31)..(31): n stands for inosine
guaguuggcugaugaggccguuaggccgaanagauuuc

SEQ ID NO: 11830 - RNA, 38 nt, Artificial Sequence
  Description of Artificial Sequence:  Enzymatic Nucleic Acid
  misc_feature (31)..(31): n stands for inosine
agguaguucugaugaggccguuaggccgaanagagauu

SEQ ID NO: 11831 - RNA, 38 nt, Artificial Sequence
  Description of Artificial Sequence:  Enzymatic Nucleic Acid
  misc_feature (31)..(31): n stands for inosine
gagguagucugaugaggccguuaggccgaangagagau

SEQ ID NO: 11832 - RNA, 38 nt, Artificial Sequence
  Description of Artificial Sequence:  Enzymatic Nucleic Acid
  misc_feature (31)..(31): n stands for inosine
cuugaggucugaugaggccguuaggccgaanuuggaga

SEQ ID NO: 11833 - RNA, 38 nt, Artificial Sequence
  Description of Artificial Sequence:  Enzymatic Nucleic Acid
  misc_feature (31)..(31): n stands for inosine
gcucuugacugaugaggccguuaggccgaanuaguugg

SEQ ID NO: 11834 - RNA, 38 nt, Artificial Sequence
  Description of Artificial Sequence:  Enzymatic Nucleic Acid
  misc_feature (31)..(31): n stands for inosine
ugcucuugcugaugaggccguuaggccgaanguaguug

SEQ ID NO: 11835 - RNA, 38 nt, Artificial Sequence
  Description of Artificial Sequence:  Enzymatic Nucleic Acid
  misc_feature (31)..(31): n stands for inosine
uuugcucucugaugaggccguuaggccgaanagguagu

SEQ ID NO: 11836 - RNA, 38 nt, Artificial Sequence
  Description of Artificial Sequence:  Enzymatic Nucleic Acid
  misc_feature (31)..(31): n stands for inosine
gucacguucugaugaggccguuaggccgaancucuuga

SEQ ID NO: 11837 - RNA, 38 nt, Artificial Sequence
  Description of Artificial Sequence:  Enzymatic Nucleic Acid
  misc_feature (31)..(31): n stands for inosine
aaaaaauacugaugaggccguuaggccgaanucacguu

SEQ ID NO: 11838 - RNA, 38 nt, Artificial Sequence
  Description of Artificial Sequence:  Enzymatic Nucleic Acid
  misc_feature (31)..(31): n stands for inosine
ccuuguugcugaugaggccguuaggccgaanaaaaaau

SEQ ID NO: 11839 - RNA, 38 nt, Artificial Sequence
  Description of Artificial Sequence:  Enzymatic Nucleic Acid
  misc_feature (31)..(31): n stands for inosine
auccuugucugaugaggccguuaggccgaanagaaaaa

SEQ ID NO: 11840 - RNA, 38 nt, Artificial Sequence
  Description of Artificial Sequence:  Enzymatic Nucleic Acid
  misc_feature (31)..(31): n stands for inosine
ugcauccucugaugaggccguuaggccgaanuugagaa

SEQ ID NO: 11841 - RNA, 38 nt, Artificial Sequence
  Description of Artificial Sequence:  Enzymatic Nucleic Acid
  misc_feature (31)..(31): n stands for inosine
uguagugccugaugaggccguuaggccgaancauccuu

SEQ ID NO: 11842 - RNA, 38 nt, Artificial Sequence
  Description of Artificial Sequence:  Enzymatic Nucleic Acid
  misc_feature (31)..(31): n stands for inosine
auguguagcugaugaggccguuaggccgaancugcauc

SEQ ID NO: 11843 - RNA, 38 nt, Artificial Sequence
  Description of Artificial Sequence:  Enzymatic Nucleic Acid
  misc_feature (31)..(31): n stands for inosine
ccaugugucugaugaggccguuaggccgaanugcugca

SEQ ID NO: 11844 - RNA, 38 nt, Artificial Sequence
  Description of Artificial Sequence:  Enzymatic Nucleic Acid
  misc_feature (31)..(31): n stands for inosine
gcuccaugcugaugaggccguuaggccgaanuagugcu

SEQ ID NO: 11845 - RNA, 38 nt, Artificial Sequence
  Description of Artificial Sequence:  Enzymatic Nucleic Acid
  misc_feature (31)..(31): n stands for inosine
aggcuccacugaugaggccguuaggccgaanuguagug

SEQ ID NO: 11846 - RNA, 38 nt, Artificial Sequence
  Description of Artificial Sequence:  Enzymatic Nucleic Acid
  misc_feature (31)..(31): n stands for inosine
cuuucuuacugaugaggccguuaggccgaancuccaug

SEQ ID NO: 11847 - RNA, 38 nt, Artificial Sequence
  Description of Artificial Sequence:  Enzymatic Nucleic Acid
  misc_feature (31)..(31): n stands for inosine
ucuuucuucugaugaggccguuaggccgaangcuccau

SEQ ID NO: 11848 - RNA, 38 nt, Artificial Sequence
  Description of Artificial Sequence:  Enzymatic Nucleic Acid
  misc_feature (31)..(31): n stands for inosine
ccaggccucugaugaggccguuaggccgaancuccauu

SEQ ID NO: 11849 - RNA, 38 nt, Artificial Sequence
  Description of Artificial Sequence:  Enzymatic Nucleic Acid
  misc_feature (31)..(31): n stands for inosine
uccaggcccugaugaggccguuaggccgaangcuccau

SEQ ID NO: 11850 - RNA, 38 nt, Artificial Sequence
  Description of Artificial Sequence:  Enzymatic Nucleic Acid
  misc_feature (31)..(31): n stands for inosine
uuguuccacugaugaggccguuaggccgaanccuggcu

SEQ ID NO: 11851 - RNA, 38 nt, Artificial Sequence
  Description of Artificial Sequence:  Enzymatic Nucleic Acid
  misc_feature (31)..(31): n stands for inosine
cuuguucccugaugaggccguuaggccgaangccuggc

SEQ ID NO: 11852 - RNA, 38 nt, Artificial Sequence
  Description of Artificial Sequence:  Enzymatic Nucleic Acid
  misc_feature (31)..(31): n stands for inosine
ucuugccucugaugaggccguuaggccgaanuuccagg

SEQ ID NO: 11853 - RNA, 38 nt, Artificial Sequence
  Description of Artificial Sequence:  Enzymatic Nucleic Acid
  misc_feature (31)..(31): n stands for inosine
ugguuucucugaugaggccguuaggccgaanccuuguu

SEQ ID NO: 11854 - RNA, 38 nt, Artificial Sequence
  Description of Artificial Sequence:  Enzymatic Nucleic Acid
  misc_feature (31)..(31): n stands for inosine
cuagucuucugaugaggccguuaggccgaanuuucuug

SEQ ID NO: 11855 - RNA, 38 nt, Artificial Sequence
  Description of Artificial Sequence:  Enzymatic Nucleic Acid
  misc_feature (31)..(31): n stands for inosine
ucuagucucugaugaggccguuaggccgaanguuucuu

SEQ ID NO: 11856 - RNA, 38 nt, Artificial Sequence
  Description of Artificial Sequence:  Enzymatic Nucleic Acid
  misc_feature (31)..(31): n stands for inosine
cgcuaucucugaugaggccguuaggccgaanucuuggu

SEQ ID NO: 11857 - RNA, 38 nt, Artificial Sequence
  Description of Artificial Sequence:  Enzymatic Nucleic Acid
  misc_feature (31)..(31): n stands for inosine
gcugcuggcugaugaggccguuaggccgaanacgcuau

SEQ ID NO: 11858 - RNA, 38 nt, Artificial Sequence
  Description of Artificial Sequence:  Enzymatic Nucleic Acid
  misc_feature (31)..(31): n stands for inosine
ucgcugcucugaugaggccguuaggccgaanugacgcu

SEQ ID NO: 11859 - RNA, 38 nt, Artificial Sequence
  Description of Artificial Sequence:  Enzymatic Nucleic Acid
  misc_feature (31)..(31): n stands for inosine
uucgcugccugaugaggccguuaggccgaangugacgc

SEQ ID NO: 11860 - RNA, 38 nt, Artificial Sequence
  Description of Artificial Sequence:  Enzymatic Nucleic Acid
  misc_feature (31)..(31): n stands for inosine
gcuuucgccugaugaggccguuaggccgaancugguga

SEQ ID NO: 11861 - RNA, 38 nt, Artificial Sequence
  Description of Artificial Sequence:  Enzymatic Nucleic Acid
  misc_feature (31)..(31): n stands for inosine
gcucgcaacugaugaggccguuaggccgaancuuucgc

SEQ ID NO: 11862 - RNA, 38 nt, Artificial Sequence
  Description of Artificial Sequence:  Enzymatic Nucleic Acid
  misc_feature (31)..(31): n stands for inosine
aaagccggcugaugaggccguuaggccgaancucgcaa

SEQ ID NO: 11863 - RNA, 38 nt, Artificial Sequence
  Description of Artificial Sequence:  Enzymatic Nucleic Acid
  misc_feature (31)..(31): n stands for inosine
ugaaagcccugaugaggccguuaggccgaanagcucgc

SEQ ID NO: 11864 - RNA, 38 nt, Artificial Sequence
  Description of Artificial Sequence:  Enzymatic Nucleic Acid
  misc_feature (31)..(31): n stands for inosine
uuccugaacugaugaggccguuaggccgaanccggagc

SEQ ID NO: 11865 - RNA, 38 nt, Artificial Sequence
  Description of Artificial Sequence:  Enzymatic Nucleic Acid
  misc_feature (31)..(31): n stands for inosine
uaucuucccugaugaggccguuaggccgaanaaagccg

SEQ ID NO: 11866 - RNA, 38 nt, Artificial Sequence
  Description of Artificial Sequence:  Enzymatic Nucleic Acid
  misc_feature (31)..(31): n stands for inosine
caucacuccugaugaggccguuaggccgaanacuuuua

SEQ ID NO: 11867 - RNA, 38 nt, Artificial Sequence
  Description of Artificial Sequence:  Enzymatic Nucleic Acid
  misc_feature (31)..(31): n stands for inosine
aaaccguccugaugaggccguuaggccgaanaauccuc

SEQ ID NO: 11868 - RNA, 38 nt, Artificial Sequence
  Description of Artificial Sequence:  Enzymatic Nucleic Acid
  misc_feature (31)..(31): n stands for inosine
cuccuugucugaugaggccguuaggccgaanaaaccgu

SEQ ID NO: 11869 - RNA, 38 nt, Artificial Sequence
  Description of Artificial Sequence:  Enzymatic Nucleic Acid
  misc_feature (31)..(31): n stands for inosine
gggcuccucugaugaggccguuaggccgaanuagaaac

SEQ ID NO: 11870 - RNA, 38 nt, Artificial Sequence
  Description of Artificial Sequence:  Enzymatic Nucleic Acid
  misc_feature (31)..(31): n stands for inosine
uagugaugcugaugaggccguuaggccgaancuccuug

SEQ ID NO: 11871 - RNA, 38 nt, Artificial Sequence
  Description of Artificial Sequence:  Enzymatic Nucleic Acid
  misc_feature (31)..(31): n stands for inosine
auagugaucugaugaggccguuaggccgaangcuccuu

SEQ ID NO: 11872 - RNA, 38 nt, Artificial Sequence
  Description of Artificial Sequence:  Enzymatic Nucleic Acid
  misc_feature (31)..(31): n stands for inosine
cauagugacugaugaggccguuaggccgaanggcuccu

SEQ ID NO: 11873 - RNA, 38 nt, Artificial Sequence
  Description of Artificial Sequence:  Enzymatic Nucleic Acid
  misc_feature (31)..(31): n stands for inosine
uuccauagcugaugaggccguuaggccgaanaugggcu

SEQ ID NO: 11874 - RNA, 38 nt, Artificial Sequence
  Description of Artificial Sequence:  Enzymatic Nucleic Acid
  misc_feature (31)..(31): n stands for inosine
ucuuccaucugaugaggccguuaggccgaanugauggg

SEQ ID NO: 11875 - RNA, 38 nt, Artificial Sequence
  Description of Artificial Sequence:  Enzymatic Nucleic Acid
  misc_feature (31)..(31): n stands for inosine
aagaaauccugaugaggccguuaggccgaanaucuucc

SEQ ID NO: 11876 - RNA, 38 nt, Artificial Sequence
  Description of Artificial Sequence:  Enzymatic Nucleic Acid
  misc_feature (31)..(31): n stands for inosine
aaacuguacugaugaggccguuaggccgaanaaaucag

SEQ ID NO: 11877 - RNA, 38 nt, Artificial Sequence
  Description of Artificial Sequence:  Enzymatic Nucleic Acid
  misc_feature (31)..(31): n stands for inosine
uugaaaaccugaugaggccguuaggccgaanuaagaaa

SEQ ID NO: 11878 - RNA, 38 nt, Artificial Sequence
  Description of Artificial Sequence:  Enzymatic Nucleic Acid
  misc_feature (31)..(31): n stands for inosine
uggccacucugaugaggccguuaggccgaanaaaacug

SEQ ID NO: 11879 - RNA, 38 nt, Artificial Sequence
  Description of Artificial Sequence:  Enzymatic Nucleic Acid
  misc_feature (31)..(31): n stands for inosine
augccucucugaugaggccguuaggccgaanccacuug

SEQ ID NO: 11880 - RNA, 38 nt, Artificial Sequence
  Description of Artificial Sequence:  Enzymatic Nucleic Acid
  misc_feature (31)..(31): n stands for inosine
caugccuccugaugaggccguuaggccgaangccacuu

SEQ ID NO: 11881 - RNA, 38 nt, Artificial Sequence
  Description of Artificial Sequence:  Enzymatic Nucleic Acid
  misc_feature (31)..(31): n stands for inosine
gaacuccacugaugaggccguuaggccgaanccucugg

SEQ ID NO: 11882 - RNA, 38 nt, Artificial Sequence
  Description of Artificial Sequence:  Enzymatic Nucleic Acid
  misc_feature (31)..(31): n stands for inosine
ggaagacacugaugaggccguuaggccgaanaacucca

SEQ ID NO: 11883 - RNA, 38 nt, Artificial Sequence
  Description of Artificial Sequence:  Enzymatic Nucleic Acid
  misc_feature (31)..(31): n stands for inosine
uggaagaccugaugaggccguuaggccgaangaacucc

SEQ ID NO: 11884 - RNA, 38 nt, Artificial Sequence
  Description of Artificial Sequence:  Enzymatic Nucleic Acid
  misc_feature (31)..(31): n stands for inosine
uuucuggacugaugaggccguuaggccgaanacaggaa

SEQ ID NO: 11885 - RNA, 38 nt, Artificial Sequence
  Description of Artificial Sequence:  Enzymatic Nucleic Acid
  misc_feature (31)..(31): n stands for inosine
cacuuucucugaugaggccguuaggccgaanaagacag

SEQ ID NO: 11886 - RNA, 38 nt, Artificial Sequence
  Description of Artificial Sequence:  Enzymatic Nucleic Acid
  misc_feature (31)..(31): n stands for inosine
gcacuuuccugaugaggccguuaggccgaangaagaca

SEQ ID NO: 11887 - RNA, 38 nt, Artificial Sequence
  Description of Artificial Sequence:  Enzymatic Nucleic Acid
  misc_feature (31)..(31): n stands for inosine
ccgaugaacugaugaggccguuaggccgaancacuuuc

SEQ ID NO: 11888 - RNA, 38 nt, Artificial Sequence
  Description of Artificial Sequence:  Enzymatic Nucleic Acid
  misc_feature (31)..(31): n stands for inosine
ggucccgacugaugaggccguuaggccgaanaaugcac

SEQ ID NO: 11889 - RNA, 38 nt, Artificial Sequence
  Description of Artificial Sequence:  Enzymatic Nucleic Acid
  misc_feature (31)..(31): n stands for inosine
cgcugccacugaugaggccguuaggccgaanucccgau

SEQ ID NO: 11890 - RNA, 38 nt, Artificial Sequence
  Description of Artificial Sequence:  Enzymatic Nucleic Acid
  misc_feature (31)..(31): n stands for inosine
ucgcugcccugaugaggccguuaggccgaangucccga

SEQ ID NO: 11891 - RNA, 38 nt, Artificial Sequence
  Description of Artificial Sequence:  Enzymatic Nucleic Acid
  misc_feature (31)..(31): n stands for inosine
uuucucgccugaugaggccguuaggccgaanccagguc

SEQ ID NO: 11892 - RNA, 38 nt, Artificial Sequence
  Description of Artificial Sequence:  Enzymatic Nucleic Acid
  misc_feature (31)..(31): n stands for inosine
uaaaagaacugaugaggccguuaggccgaanuuucucg

SEQ ID NO: 11893 - RNA, 38 nt, Artificial Sequence
  Description of Artificial Sequence:  Enzymatic Nucleic Acid
  misc_feature (31)..(31): n stands for inosine
cagauaaacugaugaggccguuaggccgaanaauguuu

SEQ ID NO: 11894 - RNA, 38 nt, Artificial Sequence
  Description of Artificial Sequence:  Enzymatic Nucleic Acid
  misc_feature (31)..(31): n stands for inosine
uuguucuccugaugaggccguuaggccgaanauaaaag

SEQ ID NO: 11895 - RNA, 38 nt, Artificial Sequence
  Description of Artificial Sequence:  Enzymatic Nucleic Acid
  misc_feature (31)..(31): n stands for inosine
caccacgucugaugaggccguuaggccgaanuucucag

SEQ ID NO: 11896 - RNA, 38 nt, Artificial Sequence
  Description of Artificial Sequence:  Enzymatic Nucleic Acid
  misc_feature (31)..(31): n stands for inosine
ccgggcaacugaugaggccguuaggccgaanccaaaau

SEQ ID NO: 11897 - RNA, 38 nt, Artificial Sequence
  Description of Artificial Sequence:  Enzymatic Nucleic Acid
  misc_feature (31)..(31): n stands for inosine
cccgggcacugaugaggccguuaggccgaangccaaaa

SEQ ID NO: 11898 - RNA, 38 nt, Artificial Sequence
  Description of Artificial Sequence:  Enzymatic Nucleic Acid
  misc_feature (31)..(31): n stands for inosine
auaucccgcugaugaggccguuaggccgaancaaggcc

SEQ ID NO: 11899 - RNA, 38 nt, Artificial Sequence
  Description of Artificial Sequence:  Enzymatic Nucleic Acid
  misc_feature (31)..(31): n stands for inosine
aauauccccugaugaggccguuaggccgaangcaaggc

SEQ ID NO: 11900 - RNA, 38 nt, Artificial Sequence
  Description of Artificial Sequence:  Enzymatic Nucleic Acid
  misc_feature (31)..(31): n stands for inosine
auaaucggcugaugaggccguuaggccgaanuucuuau

SEQ ID NO: 11901 - RNA, 38 nt, Artificial Sequence
  Description of Artificial Sequence:  Enzymatic Nucleic Acid
  misc_feature (31)..(31): n stands for inosine
cauaaucgcugaugaggccguuaggccgaanguucuua

SEQ ID NO: 11902 - RNA, 38 nt, Artificial Sequence
  Description of Artificial Sequence:  Enzymatic Nucleic Acid
  misc_feature (31)..(31): n stands for inosine
acauaauccugaugaggccguuaggccgaangguucuu

SEQ ID NO: 11903 - RNA, 38 nt, Artificial Sequence
  Description of Artificial Sequence:  Enzymatic Nucleic Acid
  misc_feature (31)..(31): n stands for inosine
ggaagucgcugaugaggccguuaggccgaanuaucucc

SEQ ID NO: 11904 - RNA, 38 nt, Artificial Sequence
  Description of Artificial Sequence:  Enzymatic Nucleic Acid
  misc_feature (31)..(31): n stands for inosine
ucagaggacugaugaggccguuaggccgaanucgagua

SEQ ID NO: 11905 - RNA, 38 nt, Artificial Sequence
  Description of Artificial Sequence:  Enzymatic Nucleic Acid
  misc_feature (31)..(31): n stands for inosine
auuucagacugaugaggccguuaggccgaanaagucga

SEQ ID NO: 11906 - RNA, 38 nt, Artificial Sequence
  Description of Artificial Sequence:  Enzymatic Nucleic Acid
  misc_feature (31)..(31): n stands for inosine
cauuucagcugaugaggccguuaggccgaangaagucg

SEQ ID NO: 11907 - RNA, 38 nt, Artificial Sequence
  Description of Artificial Sequence:  Enzymatic Nucleic Acid
  misc_feature (31)..(31): n stands for inosine
uccauuuccugaugaggccguuaggccgaanaggaagu

SEQ ID NO: 11908 - RNA, 38 nt, Artificial Sequence
  Description of Artificial Sequence:  Enzymatic Nucleic Acid
  misc_feature (31)..(31): n stands for inosine
gauucgggcugaugaggccguuaggccgaanccaucca

SEQ ID NO: 11909 - RNA, 38 nt, Artificial Sequence
  Description of Artificial Sequence:  Enzymatic Nucleic Acid
  misc_feature (31)..(31): n stands for inosine
uagauucgcugaugaggccguuaggccgaanagccauc

SEQ ID NO: 11910 - RNA, 38 nt, Artificial Sequence
  Description of Artificial Sequence:  Enzymatic Nucleic Acid
  misc_feature (31)..(31): n stands for inosine
auagauuccugaugaggccguuaggccgaangagccau

SEQ ID NO: 11911 - RNA, 38 nt, Artificial Sequence
  Description of Artificial Sequence:  Enzymatic Nucleic Acid
  misc_feature (31)..(31): n stands for inosine
ucaaagaucugaugaggccguuaggccgaanauucggg

SEQ ID NO: 11912 - RNA, 38 nt, Artificial Sequence
  Description of Artificial Sequence:  Enzymatic Nucleic Acid
  misc_feature (31)..(31): n stands for inosine
uuugucaacugaugaggccguuaggccgaanauagauu

SEQ ID NO: 11913 - RNA, 38 nt, Artificial Sequence
  Description of Artificial Sequence:  Enzymatic Nucleic Acid
  misc_feature (31)..(31): n stands for inosine
guagauuucugaugaggccguuaggccgaanucaaaga

SEQ ID NO: 11914 - RNA, 38 nt, Artificial Sequence
  Description of Artificial Sequence:  Enzymatic Nucleic Acid
  misc_feature (31)..(31): n stands for inosine
ggugcugucugaugaggccguuaggccgaanauuuugu

SEQ ID NO: 11915 - RNA, 38 nt, Artificial Sequence
  Description of Artificial Sequence:  Enzymatic Nucleic Acid
  misc_feature (31)..(31): n stands for inosine
cuuggugccugaugaggccguuaggccgaanuagauuu

SEQ ID NO: 11916 - RNA, 38 nt, Artificial Sequence
  Description of Artificial Sequence:  Enzymatic Nucleic Acid
  misc_feature (31)..(31): n stands for inosine
gcucuuggcugaugaggccguuaggccgaancuguaga

SEQ ID NO: 11917 - RNA, 38 nt, Artificial Sequence
  Description of Artificial Sequence:  Enzymatic Nucleic Acid
  misc_feature (31)..(31): n stands for inosine
ucgcucuucugaugaggccguuaggccgaanugcugua

SEQ ID NO: 11918 - RNA, 38 nt, Artificial Sequence
  Description of Artificial Sequence:  Enzymatic Nucleic Acid
  misc_feature (31)..(31): n stands for inosine
gucgcucucugaugaggccguuaggccgaangugcugu

SEQ ID NO: 11919 - RNA, 38 nt, Artificial Sequence
  Description of Artificial Sequence:  Enzymatic Nucleic Acid
  misc_feature (31)..(31): n stands for inosine
acuccguacugaugaggccguuaggccgaanaccacac

SEQ ID NO: 11920 - RNA, 38 nt, Artificial Sequence
  Description of Artificial Sequence:  Enzymatic Nucleic Acid
  misc_feature (31)..(31): n stands for inosine
uuucccaccugaugaggccguuaggccgaancaauacu

SEQ ID NO: 11921 - RNA, 38 nt, Artificial Sequence
  Description of Artificial Sequence:  Enzymatic Nucleic Acid
  misc_feature (31)..(31): n stands for inosine
uaaggagacugaugaggccguuaggccgaanauuuccc

SEQ ID NO: 11922 - RNA, 38 nt, Artificial Sequence
  Description of Artificial Sequence:  Enzymatic Nucleic Acid
  misc_feature (31)..(31): n stands for inosine
accuaaggcugaugaggccguuaggccgaanaagauuu

SEQ ID NO: 11923 - RNA, 38 nt, Artificial Sequence
  Description of Artificial Sequence:  Enzymatic Nucleic Acid
  misc_feature (31)..(31): n stands for inosine
ccaccuaacugaugaggccguuaggccgaanagaagau

SEQ ID NO: 11924 - RNA, 38 nt, Artificial Sequence
  Description of Artificial Sequence:  Enzymatic Nucleic Acid
  misc_feature (31)..(31): n stands for inosine
cccaccuacugaugaggccguuaggccgaangagaaga

SEQ ID NO: 11925 - RNA, 38 nt, Artificial Sequence
  Description of Artificial Sequence:  Enzymatic Nucleic Acid
  misc_feature (31)..(31): n stands for inosine
ggguauggcugaugaggccguuaggccgaanacccacc

SEQ ID NO: 11926 - RNA, 38 nt, Artificial Sequence
  Description of Artificial Sequence:  Enzymatic Nucleic Acid
  misc_feature (31)..(31): n stands for inosine
cuggguaucugaugaggccguuaggccgaanagaccca

SEQ ID NO: 11927 - RNA, 38 nt, Artificial Sequence
  Description of Artificial Sequence:  Enzymatic Nucleic Acid
  misc_feature (31)..(31): n stands for inosine
ccuggguacugaugaggccguuaggccgaangagaccc

SEQ ID NO: 11928 - RNA, 38 nt, Artificial Sequence
  Description of Artificial Sequence:  Enzymatic Nucleic Acid
  misc_feature (31)..(31): n stands for inosine
uacuccugcugaugaggccguuaggccgaanuauggag

SEQ ID NO: 11929 - RNA, 38 nt, Artificial Sequence
  Description of Artificial Sequence:  Enzymatic Nucleic Acid
  misc_feature (31)..(31): n stands for inosine
guacuccucugaugaggccguuaggccgaanguaugga

SEQ ID NO: 11930 - RNA, 38 nt, Artificial Sequence
  Description of Artificial Sequence:  Enzymatic Nucleic Acid
  misc_feature (31)..(31): n stands for inosine
uguacucccugaugaggccguuaggccgaangguaugg

SEQ ID NO: 11931 - RNA, 38 nt, Artificial Sequence
  Description of Artificial Sequence:  Enzymatic Nucleic Acid
  misc_feature (31)..(31): n stands for inosine
cauccauucugaugaggccguuaggccgaanuacuccu

SEQ ID NO: 11932 - RNA, 38 nt, Artificial Sequence
  Description of Artificial Sequence:  Enzymatic Nucleic Acid
  misc_feature (31)..(31): n stands for inosine
acugcaaacugaugaggccguuaggccgaanuccucau

SEQ ID NO: 11933 - RNA, 38 nt, Artificial Sequence
  Description of Artificial Sequence:  Enzymatic Nucleic Acid
  misc_feature (31)..(31): n stands for inosine
caggcgaccugaugaggccguuaggccgaancaaaagu

SEQ ID NO: 11934 - RNA, 38 nt, Artificial Sequence
  Description of Artificial Sequence:  Enzymatic Nucleic Acid
  misc_feature (31)..(31): n stands for inosine
uucccucacugaugaggccguuaggccgaancgacugc

SEQ ID NO: 11935 - RNA, 38 nt, Artificial Sequence
  Description of Artificial Sequence:  Enzymatic Nucleic Acid
  misc_feature (31)..(31): n stands for inosine
cuucccuccugaugaggccguuaggccgaangcgacug

SEQ ID NO: 11936 - RNA, 38 nt, Artificial Sequence
  Description of Artificial Sequence:  Enzymatic Nucleic Acid
  misc_feature (31)..(31): n stands for inosine
cauccucacugaugaggccguuaggccgaanccuuccc

SEQ ID NO: 11937 - RNA, 38 nt, Artificial Sequence
  Description of Artificial Sequence:  Enzymatic Nucleic Acid
  misc_feature (31)..(31): n stands for inosine
uacucaggcugaugaggccguuaggccgaancucucau

SEQ ID NO: 11938 - RNA, 38 nt, Artificial Sequence
  Description of Artificial Sequence:  Enzymatic Nucleic Acid
  misc_feature (31)..(31): n stands for inosine
aguacucacugaugaggccguuaggccgaanagcucuc

SEQ ID NO: 11939 - RNA, 38 nt, Artificial Sequence
  Description of Artificial Sequence:  Enzymatic Nucleic Acid
  misc_feature (31)..(31): n stands for inosine
gaguacuccugaugaggccguuaggccgaangagcucu

SEQ ID NO: 11940 - RNA, 38 nt, Artificial Sequence
  Description of Artificial Sequence:  Enzymatic Nucleic Acid
  misc_feature (31)..(31): n stands for inosine
aggaguagcugaugaggccguuaggccgaanuacucag

SEQ ID NO: 11941 - RNA, 38 nt, Artificial Sequence
  Description of Artificial Sequence:  Enzymatic Nucleic Acid
  misc_feature (31)..(31): n stands for inosine
ucaggagucugaugaggccguuaggccgaanaguacuc

SEQ ID NO: 11942 - RNA, 38 nt, Artificial Sequence
  Description of Artificial Sequence:  Enzymatic Nucleic Acid
  misc_feature (31)..(31): n stands for inosine
auuucaggcugaugaggccguuaggccgaanuagagua

SEQ ID NO: 11943 - RNA, 38 nt, Artificial Sequence
  Description of Artificial Sequence:  Enzymatic Nucleic Acid
  misc_feature (31)..(31): n stands for inosine
agauuucacugaugaggccguuaggccgaanaguagag

SEQ ID NO: 11944 - RNA, 38 nt, Artificial Sequence
  Description of Artificial Sequence:  Enzymatic Nucleic Acid
  misc_feature (31)..(31): n stands for inosine
uagauuuccugaugaggccguuaggccgaangaguaga

SEQ ID NO: 11945 - RNA, 38 nt, Artificial Sequence
  Description of Artificial Sequence:  Enzymatic Nucleic Acid
  misc_feature (31)..(31): n stands for inosine
gaucugaucugaugaggccguuaggccgaanauuucag

SEQ ID NO: 11946 - RNA, 38 nt, Artificial Sequence
  Description of Artificial Sequence:  Enzymatic Nucleic Acid
  misc_feature (31)..(31): n stands for inosine
gcaugauccugaugaggccguuaggccgaanauagauu

SEQ ID NO: 11947 - RNA, 38 nt, Artificial Sequence
  Description of Artificial Sequence:  Enzymatic Nucleic Acid
  misc_feature (31)..(31): n stands for inosine
guccagcacugaugaggccguuaggccgaanaucugau

SEQ ID NO: 11948 - RNA, 38 nt, Artificial Sequence
  Description of Artificial Sequence:  Enzymatic Nucleic Acid
  misc_feature (31)..(31): n stands for inosine
agcagucccugaugaggccguuaggccgaancaugauc

SEQ ID NO: 11949 - RNA, 38 nt, Artificial Sequence
  Description of Artificial Sequence:  Enzymatic Nucleic Acid
  misc_feature (31)..(31): n stands for inosine
gugccagccugaugaggccguuaggccgaanuccagca

SEQ ID NO: 11950 - RNA, 38 nt, Artificial Sequence
  Description of Artificial Sequence:  Enzymatic Nucleic Acid
  misc_feature (31)..(31): n stands for inosine
ucugugcccugaugaggccguuaggccgaancagucca

SEQ ID NO: 11951 - RNA, 38 nt, Artificial Sequence
  Description of Artificial Sequence:  Enzymatic Nucleic Acid
  misc_feature (31)..(31): n stands for inosine
ggucucugcugaugaggccguuaggccgaanccagcag

SEQ ID NO: 11952 - RNA, 38 nt, Artificial Sequence
  Description of Artificial Sequence:  Enzymatic Nucleic Acid
  misc_feature (31)..(31): n stands for inosine
ugggucuccugaugaggccguuaggccgaanugccagc

SEQ ID NO: 11953 - RNA, 38 nt, Artificial Sequence
  Description of Artificial Sequence:  Enzymatic Nucleic Acid
  misc_feature (31)..(31): n stands for inosine
uucuuuugcugaugaggccguuaggccgaanucucugu

SEQ ID NO: 11954 - RNA, 38 nt, Artificial Sequence
  Description of Artificial Sequence:  Enzymatic Nucleic Acid
  misc_feature (31)..(31): n stands for inosine
uuucuuuucugaugaggccguuaggccgaangucucug

SEQ ID NO: 11955 - RNA, 38 nt, Artificial Sequence
  Description of Artificial Sequence:  Enzymatic Nucleic Acid
  misc_feature (31)..(31): n stands for inosine
cuuucuuucugaugaggccguuaggccgaanggucucu

SEQ ID NO: 11956 - RNA, 38 nt, Artificial Sequence
  Description of Artificial Sequence:  Enzymatic Nucleic Acid
  misc_feature (31)..(31): n stands for inosine
caaaucuucugaugaggccguuaggccgaanccuuucu

SEQ ID NO: 11957 - RNA, 38 nt, Artificial Sequence
  Description of Artificial Sequence:  Enzymatic Nucleic Acid
  misc_feature (31)..(31): n stands for inosine
gcaaaucucugaugaggccguuaggccgaangccuuuc

SEQ ID NO: 11958 - RNA, 38 nt, Artificial Sequence
  Description of Artificial Sequence:  Enzymatic Nucleic Acid
  misc_feature (31)..(31): n stands for inosine
acaaguuccugaugaggccguuaggccgaancaaaucu

SEQ ID NO: 11959 - RNA, 38 nt, Artificial Sequence
  Description of Artificial Sequence:  Enzymatic Nucleic Acid
  misc_feature (31)..(31): n stands for inosine
uuuccacacugaugaggccguuaggccgaanuucugca

SEQ ID NO: 11960 - RNA, 38 nt, Artificial Sequence
  Description of Artificial Sequence:  Enzymatic Nucleic Acid
  misc_feature (31)..(31): n stands for inosine
aaucaccucugaugaggccguuaggccgaanuuuuucc

SEQ ID NO: 11961 - RNA, 38 nt, Artificial Sequence
  Description of Artificial Sequence:  Enzymatic Nucleic Acid
  misc_feature (31)..(31): n stands for inosine
uugcuugacugaugaggccguuaggccgaancaaauca

SEQ ID NO: 11962 - RNA, 38 nt, Artificial Sequence
  Description of Artificial Sequence:  Enzymatic Nucleic Acid
  misc_feature (31)..(31): n stands for inosine
cauuugcucugaugaggccguuaggccgaanaagcaaa

SEQ ID NO: 11963 - RNA, 38 nt, Artificial Sequence
  Description of Artificial Sequence:  Enzymatic Nucleic Acid
  misc_feature (31)..(31): n stands for inosine
uguacauucugaugaggccguuaggccgaancuugaag

SEQ ID NO: 11964 - RNA, 38 nt, Artificial Sequence
  Description of Artificial Sequence:  Enzymatic Nucleic Acid
  misc_feature (31)..(31): n stands for inosine
cauccugucugaugaggccguuaggccgaanuacauuu

SEQ ID NO: 11965 - RNA, 38 nt, Artificial Sequence
  Description of Artificial Sequence:  Enzymatic Nucleic Acid
  misc_feature (31)..(31): n stands for inosine
uaccaucccugaugaggccguuaggccgaanuuguaca

SEQ ID NO: 11966 - RNA, 38 nt, Artificial Sequence
  Description of Artificial Sequence:  Enzymatic Nucleic Acid
  misc_feature (31)..(31): n stands for inosine
ugggaugucugaugaggccguuaggccgaanucuuuac

SEQ ID NO: 11967 - RNA, 38 nt, Artificial Sequence
  Description of Artificial Sequence:  Enzymatic Nucleic Acid
  misc_feature (31)..(31): n stands for inosine
gauugggacugaugaggccguuaggccgaanuagucuu

SEQ ID NO: 11968 - RNA, 38 nt, Artificial Sequence
  Description of Artificial Sequence:  Enzymatic Nucleic Acid
  misc_feature (31)..(31): n stands for inosine
auugauugcugaugaggccguuaggccgaanauguagu

SEQ ID NO: 11969 - RNA, 38 nt, Artificial Sequence
  Description of Artificial Sequence:  Enzymatic Nucleic Acid
  misc_feature (31)..(31): n stands for inosine
cauugauucugaugaggccguuaggccgaangauguag

SEQ ID NO: 11970 - RNA, 38 nt, Artificial Sequence
  Description of Artificial Sequence:  Enzymatic Nucleic Acid
  misc_feature (31)..(31): n stands for inosine
gcauugaucugaugaggccguuaggccgaanggaugua

SEQ ID NO: 11971 - RNA, 38 nt, Artificial Sequence
  Description of Artificial Sequence:  Enzymatic Nucleic Acid
  misc_feature (31)..(31): n stands for inosine
uauggcaucugaugaggccguuaggccgaanauuggga

SEQ ID NO: 11972 - RNA, 38 nt, Artificial Sequence
  Description of Artificial Sequence:  Enzymatic Nucleic Acid
  misc_feature (31)..(31): n stands for inosine
gucaguaucugaugaggccguuaggccgaancauugau

SEQ ID NO: 11973 - RNA, 38 nt, Artificial Sequence
  Description of Artificial Sequence:  Enzymatic Nucleic Acid
  misc_feature (31)..(31): n stands for inosine
ugucaguacugaugaggccguuaggccgaangcauuga

SEQ ID NO: 11974 - RNA, 38 nt, Artificial Sequence
  Description of Artificial Sequence:  Enzymatic Nucleic Acid
  misc_feature (31)..(31): n stands for inosine
uuccuguccugaugaggccguuaggccgaanuauggca

SEQ ID NO: 11975 - RNA, 38 nt, Artificial Sequence
  Description of Artificial Sequence:  Enzymatic Nucleic Acid
  misc_feature (31)..(31): n stands for inosine
cuauuucccugaugaggccguuaggccgaanucaguau

SEQ ID NO: 11976 - RNA, 38 nt, Artificial Sequence
  Description of Artificial Sequence:  Enzymatic Nucleic Acid
  misc_feature (31)..(31): n stands for inosine
guugaguacugaugaggccguuaggccgaanuaaaccc

SEQ ID NO: 11977 - RNA, 38 nt, Artificial Sequence
  Description of Artificial Sequence:  Enzymatic Nucleic Acid
  misc_feature (31)..(31): n stands for inosine
aggaguugcugaugaggccguuaggccgaanuauguaa

SEQ ID NO: 11978 - RNA, 38 nt, Artificial Sequence
  Description of Artificial Sequence:  Enzymatic Nucleic Acid
  misc_feature (31)..(31): n stands for inosine
gcaggagucugaugaggccguuaggccgaanaguaugu

SEQ ID NO: 11979 - RNA, 38 nt, Artificial Sequence
  Description of Artificial Sequence:  Enzymatic Nucleic Acid
  misc_feature (31)..(31): n stands for inosine
aaggcaggcugaugaggccguuaggccgaanuugagua

SEQ ID NO: 11980 - RNA, 38 nt, Artificial Sequence
  Description of Artificial Sequence:  Enzymatic Nucleic Acid
  misc_feature (31)..(31): n stands for inosine
agaaggcacugaugaggccguuaggccgaanaguugag

SEQ ID NO: 11981 - RNA, 38 nt, Artificial Sequence
  Description of Artificial Sequence:  Enzymatic Nucleic Acid
  misc_feature (31)..(31): n stands for inosine
gagaaggccugaugaggccguuaggccgaangaguuga

SEQ ID NO: 11982 - RNA, 38 nt, Artificial Sequence
  Description of Artificial Sequence:  Enzymatic Nucleic Acid
  misc_feature (31)..(31): n stands for inosine
ucagagaacugaugaggccguuaggccgaancaggagu

SEQ ID NO: 11983 - RNA, 38 nt, Artificial Sequence
  Description of Artificial Sequence:  Enzymatic Nucleic Acid
  misc_feature (31)..(31): n stands for inosine
cucagagacugaugaggccguuaggccgaangcaggag

SEQ ID NO: 11984 - RNA, 38 nt, Artificial Sequence
  Description of Artificial Sequence:  Enzymatic Nucleic Acid
  misc_feature (31)..(31): n stands for inosine
guccucagcugaugaggccguuaggccgaanaaggcag

SEQ ID NO: 11985 - RNA, 38 nt, Artificial Sequence
  Description of Artificial Sequence:  Enzymatic Nucleic Acid
  misc_feature (31)..(31): n stands for inosine
aaguccuccugaugaggccguuaggccgaanagaaggc

SEQ ID NO: 11986 - RNA, 38 nt, Artificial Sequence
  Description of Artificial Sequence:  Enzymatic Nucleic Acid
  misc_feature (31)..(31): n stands for inosine
cuugaagacugaugaggccguuaggccgaanuccucag

SEQ ID NO: 11987 - RNA, 38 nt, Artificial Sequence
  Description of Artificial Sequence:  Enzymatic Nucleic Acid
  misc_feature (31)..(31): n stands for inosine
uuccuugacugaugaggccguuaggccgaanaaguccu

SEQ ID NO: 11988 - RNA, 38 nt, Artificial Sequence
  Description of Artificial Sequence:  Enzymatic Nucleic Acid
  misc_feature (31)..(31): n stands for inosine
acuuuccucugaugaggccguuaggccgaanaagaagu

SEQ ID NO: 11989 - RNA, 38 nt, Artificial Sequence
  Description of Artificial Sequence:  Enzymatic Nucleic Acid
  misc_feature (31)..(31): n stands for inosine
uucggagccugaugaggccguuaggccgaanaaauacu

SEQ ID NO: 11990 - RNA, 38 nt, Artificial Sequence
  Description of Artificial Sequence:  Enzymatic Nucleic Acid
  misc_feature (31)..(31): n stands for inosine
aacuucggcugaugaggccguuaggccgaancugaaau

SEQ ID NO: 11991 - RNA, 38 nt, Artificial Sequence
  Description of Artificial Sequence:  Enzymatic Nucleic Acid
  misc_feature (31)..(31): n stands for inosine
uaaacuuccugaugaggccguuaggccgaanagcugaa

SEQ ID NO: 11992 - RNA, 38 nt, Artificial Sequence
  Description of Artificial Sequence:  Enzymatic Nucleic Acid
  misc_feature (31)..(31): n stands for inosine
gagcuucccugaugaggccguuaggccgaanaauuaaa

SEQ ID NO: 11993 - RNA, 38 nt, Artificial Sequence
  Description of Artificial Sequence:  Enzymatic Nucleic Acid
  misc_feature (31)..(31): n stands for inosine
aucaucagcugaugaggccguuaggccgaancuuccug

SEQ ID NO: 11994 - RNA, 38 nt, Artificial Sequence
  Description of Artificial Sequence:  Enzymatic Nucleic Acid
  misc_feature (31)..(31): n stands for inosine
acaucauccugaugaggccguuaggccgaanagcuucc

SEQ ID NO: 11995 - RNA, 38 nt, Artificial Sequence
  Description of Artificial Sequence:  Enzymatic Nucleic Acid
  misc_feature (31)..(31): n stands for inosine
uacauauccugaugaggccguuaggccgaanacaucau

SEQ ID NO: 11996 - RNA, 38 nt, Artificial Sequence
  Description of Artificial Sequence:  Enzymatic Nucleic Acid
  misc_feature (31)..(31): n stands for inosine
aacuugaacugaugaggccguuaggccgaancauuuac

SEQ ID NO: 11997 - RNA, 38 nt, Artificial Sequence
  Description of Artificial Sequence:  Enzymatic Nucleic Acid
  misc_feature (31)..(31): n stands for inosine
caugaacucugaugaggccguuaggccgaanaaagcau

SEQ ID NO: 11998 - RNA, 38 nt, Artificial Sequence
  Description of Artificial Sequence:  Enzymatic Nucleic Acid
  misc_feature (31)..(31): n stands for inosine
caggcucacugaugaggccguuaggccgaanaacuuga

SEQ ID NO: 11999 - RNA, 38 nt, Artificial Sequence
  Description of Artificial Sequence:  Enzymatic Nucleic Acid
  misc_feature (31)..(31): n stands for inosine
ucuuuccacugaugaggccguuaggccgaancucauga

SEQ ID NO: 12000 - RNA, 38 nt, Artificial Sequence
  Description of Artificial Sequence:  Enzymatic Nucleic Acid
  misc_feature (31)..(31): n stands for inosine
uucuuucccugaugaggccguuaggccgaangcucaug

SEQ ID NO: 12001 - RNA, 38 nt, Artificial Sequence
  Description of Artificial Sequence:  Enzymatic Nucleic Acid
  misc_feature (31)..(31): n stands for inosine
aaagguuucugaugaggccguuaggccgaanauucuuu

SEQ ID NO: 12002 - RNA, 38 nt, Artificial Sequence
  Description of Artificial Sequence:  Enzymatic Nucleic Acid
  misc_feature (31)..(31): n stands for inosine
ucuucaaacugaugaggccguuaggccgaanuuuugau

SEQ ID NO: 12003 - RNA, 38 nt, Artificial Sequence
  Description of Artificial Sequence:  Enzymatic Nucleic Acid
  misc_feature (31)..(31): n stands for inosine
uucuucaacugaugaggccguuaggccgaanguuuuga

SEQ ID NO: 12004 - RNA, 38 nt, Artificial Sequence
  Description of Artificial Sequence:  Enzymatic Nucleic Acid
  misc_feature (31)..(31): n stands for inosine
ucgguaaacugaugaggccguuaggccgaanuucuuca

SEQ ID NO: 12005 - RNA, 38 nt, Artificial Sequence
  Description of Artificial Sequence:  Enzymatic Nucleic Acid
  misc_feature (31)..(31): n stands for inosine
uggcauuccugaugaggccguuaggccgaanuaaaagu

SEQ ID NO: 12006 - RNA, 38 nt, Artificial Sequence
  Description of Artificial Sequence:  Enzymatic Nucleic Acid
  misc_feature (31)..(31): n stands for inosine
auggaggucugaugaggccguuaggccgaancauucgg

SEQ ID NO: 12007 - RNA, 38 nt, Artificial Sequence
  Description of Artificial Sequence:  Enzymatic Nucleic Acid
  misc_feature (31)..(31): n stands for inosine
cauggaggcugaugaggccguuaggccgaangcauucg

SEQ ID NO: 12008 - RNA, 38 nt, Artificial Sequence
  Description of Artificial Sequence:  Enzymatic Nucleic Acid
  misc_feature (31)..(31): n stands for inosine
aacauggacugaugaggccguuaggccgaanuggcauu

SEQ ID NO: 12009 - RNA, 38 nt, Artificial Sequence
  Description of Artificial Sequence:  Enzymatic Nucleic Acid
  misc_feature (31)..(31): n stands for inosine
aaacauggcugaugaggccguuaggccgaanguggcau

SEQ ID NO: 12010 - RNA, 38 nt, Artificial Sequence
  Description of Artificial Sequence:  Enzymatic Nucleic Acid
  misc_feature (31)..(31): n stands for inosine
ucaaacaucugaugaggccguuaggccgaanagguggc

SEQ ID NO: 12011 - RNA, 38 nt, Artificial Sequence
  Description of Artificial Sequence:  Enzymatic Nucleic Acid
  misc_feature (31)..(31): n stands for inosine
aucaaacacugaugaggccguuaggccgaangaggugg

SEQ ID NO: 12012 - RNA, 38 nt, Artificial Sequence
  Description of Artificial Sequence:  Enzymatic Nucleic Acid
  misc_feature (31)..(31): n stands for inosine
gcccuggucugaugaggccguuaggccgaanucaucaa

SEQ ID NO: 12013 - RNA, 38 nt, Artificial Sequence
  Description of Artificial Sequence:  Enzymatic Nucleic Acid
  misc_feature (31)..(31): n stands for inosine
gucgcccucugaugaggccguuaggccgaanuagucau

SEQ ID NO: 12014 - RNA, 38 nt, Artificial Sequence
  Description of Artificial Sequence:  Enzymatic Nucleic Acid
  misc_feature (31)..(31): n stands for inosine
ugucgccccugaugaggccguuaggccgaanguaguca

SEQ ID NO: 12015 - RNA, 38 nt, Artificial Sequence
  Description of Artificial Sequence:  Enzymatic Nucleic Acid
  misc_feature (31)..(31): n stands for inosine
agugcugccugaugaggccguuaggccgaanucgcccu

SEQ ID NO: 12016 - RNA, 38 nt, Artificial Sequence
  Description of Artificial Sequence:  Enzymatic Nucleic Acid
  misc_feature (31)..(31): n stands for inosine
cagagugccugaugaggccguuaggccgaancugucgc

SEQ ID NO: 12017 - RNA, 38 nt, Artificial Sequence
  Description of Artificial Sequence:  Enzymatic Nucleic Acid
  misc_feature (31)..(31): n stands for inosine
caacagagcugaugaggccguuaggccgaancugcugu

SEQ ID NO: 12018 - RNA, 38 nt, Artificial Sequence
  Description of Artificial Sequence:  Enzymatic Nucleic Acid
  misc_feature (31)..(31): n stands for inosine
gccaacagcugaugaggccguuaggccgaanugcugcu

SEQ ID NO: 12019 - RNA, 38 nt, Artificial Sequence
  Description of Artificial Sequence:  Enzymatic Nucleic Acid
  misc_feature (31)..(31): n stands for inosine
aggccaaccugaugaggccguuaggccgaanagugcug

SEQ ID NO: 12020 - RNA, 38 nt, Artificial Sequence
  Description of Artificial Sequence:  Enzymatic Nucleic Acid
  misc_feature (31)..(31): n stands for inosine
augggagacugaugaggccguuaggccgaanccaacag

SEQ ID NO: 12021 - RNA, 38 nt, Artificial Sequence
  Description of Artificial Sequence:  Enzymatic Nucleic Acid
  misc_feature (31)..(31): n stands for inosine
caugggagcugaugaggccguuaggccgaangccaaca

SEQ ID NO: 12022 - RNA, 38 nt, Artificial Sequence
  Description of Artificial Sequence:  Enzymatic Nucleic Acid
  misc_feature (31)..(31): n stands for inosine
agcaugggcugaugaggccguuaggccgaanaggccaa

SEQ ID NO: 12023 - RNA, 38 nt, Artificial Sequence
  Description of Artificial Sequence:  Enzymatic Nucleic Acid
  misc_feature (31)..(31): n stands for inosine
ucagcaugcugaugaggccguuaggccgaanagaggcc

SEQ ID NO: 12024 - RNA, 38 nt, Artificial Sequence
  Description of Artificial Sequence:  Enzymatic Nucleic Acid
  misc_feature (31)..(31): n stands for inosine
uucagcaucugaugaggccguuaggccgaangagaggc

SEQ ID NO: 12025 - RNA, 38 nt, Artificial Sequence
  Description of Artificial Sequence:  Enzymatic Nucleic Acid
  misc_feature (31)..(31): n stands for inosine
cuucagcacugaugaggccguuaggccgaanggagagg

SEQ ID NO: 12026 - RNA, 38 nt, Artificial Sequence
  Description of Artificial Sequence:  Enzymatic Nucleic Acid
  misc_feature (31)..(31): n stands for inosine
agcgcuuccugaugaggccguuaggccgaancauggga

SEQ ID NO: 12027 - RNA, 38 nt, Artificial Sequence
  Description of Artificial Sequence:  Enzymatic Nucleic Acid
  misc_feature (31)..(31): n stands for inosine
ccaggugacugaugaggccguuaggccgaancgcuuca

SEQ ID NO: 12028 - RNA, 38 nt, Artificial Sequence
  Description of Artificial Sequence:  Enzymatic Nucleic Acid
  misc_feature (31)..(31): n stands for inosine
aguccaggcugaugaggccguuaggccgaanaagcgcu

SEQ ID NO: 12029 - RNA, 38 nt, Artificial Sequence
  Description of Artificial Sequence:  Enzymatic Nucleic Acid
  misc_feature (31)..(31): n stands for inosine
ucaguccacugaugaggccguuaggccgaanugaagcg

SEQ ID NO: 12030 - RNA, 38 nt, Artificial Sequence
  Description of Artificial Sequence:  Enzymatic Nucleic Acid
  misc_feature (31)..(31): n stands for inosine
gucagucccugaugaggccguuaggccgaangugaagc

SEQ ID NO: 12031 - RNA, 38 nt, Artificial Sequence
  Description of Artificial Sequence:  Enzymatic Nucleic Acid
  misc_feature (31)..(31): n stands for inosine
uugcuguccugaugaggccguuaggccgaanuccaggu

SEQ ID NO: 12032 - RNA, 38 nt, Artificial Sequence
  Description of Artificial Sequence:  Enzymatic Nucleic Acid
  misc_feature (31)..(31): n stands for inosine
ggguuugccugaugaggccguuaggccgaanucagucc

SEQ ID NO: 12033 - RNA, 38 nt, Artificial Sequence
  Description of Artificial Sequence:  Enzymatic Nucleic Acid
  misc_feature (31)..(31): n stands for inosine
cuuggguucugaugaggccguuaggccgaancugucag

SEQ ID NO: 12034 - RNA, 38 nt, Artificial Sequence
  Description of Artificial Sequence:  Enzymatic Nucleic Acid
  misc_feature (31)..(31): n stands for inosine
aggccuugcugaugaggccguuaggccgaanuuugcug

SEQ ID NO: 12035 - RNA, 38 nt, Artificial Sequence
  Description of Artificial Sequence:  Enzymatic Nucleic Acid
  misc_feature (31)..(31): n stands for inosine
gaggccuucugaugaggccguuaggccgaanguuugcu

SEQ ID NO: 12036 - RNA, 38 nt, Artificial Sequence
  Description of Artificial Sequence:  Enzymatic Nucleic Acid
  misc_feature (31)..(31): n stands for inosine
cgaggccucugaugaggccguuaggccgaangguuugc

SEQ ID NO: 12037 - RNA, 38 nt, Artificial Sequence
  Description of Artificial Sequence:  Enzymatic Nucleic Acid
  misc_feature (31)..(31): n stands for inosine
uugagcgacugaugaggccguuaggccgaanccuuggg

SEQ ID NO: 12038 - RNA, 38 nt, Artificial Sequence
  Description of Artificial Sequence:  Enzymatic Nucleic Acid
  misc_feature (31)..(31): n stands for inosine
cuugagcgcugaugaggccguuaggccgaangccuugg

SEQ ID NO: 12039 - RNA, 38 nt, Artificial Sequence
  Description of Artificial Sequence:  Enzymatic Nucleic Acid
  misc_feature (31)..(31): n stands for inosine
caaucuugcugaugaggccguuaggccgaancgaggcc

SEQ ID NO: 12040 - RNA, 38 nt, Artificial Sequence
  Description of Artificial Sequence:  Enzymatic Nucleic Acid
  misc_feature (31)..(31): n stands for inosine
gucaaucucugaugaggccguuaggccgaanagcgagg

SEQ ID NO: 12041 - RNA, 38 nt, Artificial Sequence
  Description of Artificial Sequence:  Enzymatic Nucleic Acid
  misc_feature (31)..(31): n stands for inosine
uacucucacugaugaggccguuaggccgaanucaaucu

SEQ ID NO: 12042 - RNA, 38 nt, Artificial Sequence
  Description of Artificial Sequence:  Enzymatic Nucleic Acid
  misc_feature (31)..(31): n stands for inosine
cuuuuacucugaugaggccguuaggccgaanuuacucu

SEQ ID NO: 12043 - RNA, 38 nt, Artificial Sequence
  Description of Artificial Sequence:  Enzymatic Nucleic Acid
  misc_feature (31)..(31): n stands for inosine
acuuuuaccugaugaggccguuaggccgaanguuacuc

SEQ ID NO: 12044 - RNA, 38 nt, Artificial Sequence
  Description of Artificial Sequence:  Enzymatic Nucleic Acid
  misc_feature (31)..(31): n stands for inosine
caucagaccugaugaggccguuaggccgaanccccgac

SEQ ID NO: 12045 - RNA, 38 nt, Artificial Sequence
  Description of Artificial Sequence:  Enzymatic Nucleic Acid
  misc_feature (31)..(31): n stands for inosine
cugacauccugaugaggccguuaggccgaanacagccc

SEQ ID NO: 12046 - RNA, 38 nt, Artificial Sequence
  Description of Artificial Sequence:  Enzymatic Nucleic Acid
  misc_feature (31)..(31): n stands for inosine
gggccugccugaugaggccguuaggccgaanacaucag

SEQ ID NO: 12047 - RNA, 38 nt, Artificial Sequence
  Description of Artificial Sequence:  Enzymatic Nucleic Acid
  misc_feature (31)..(31): n stands for inosine
acugggcccugaugaggccguuaggccgaancugacau

SEQ ID NO: 12048 - RNA, 38 nt, Artificial Sequence
  Description of Artificial Sequence:  Enzymatic Nucleic Acid
  misc_feature (31)..(31): n stands for inosine
agaaacugcugaugaggccguuaggccgaanccugcug

SEQ ID NO: 12049 - RNA, 38 nt, Artificial Sequence
  Description of Artificial Sequence:  Enzymatic Nucleic Acid
  misc_feature (31)..(31): n stands for inosine
cagaaacucugaugaggccguuaggccgaangccugcu

SEQ ID NO: 12050 - RNA, 38 nt, Artificial Sequence
  Description of Artificial Sequence:  Enzymatic Nucleic Acid
  misc_feature (31)..(31): n stands for inosine
gcagaaaccugaugaggccguuaggccgaanggccugc

SEQ ID NO: 12051 - RNA, 38 nt, Artificial Sequence
  Description of Artificial Sequence:  Enzymatic Nucleic Acid
  misc_feature (31)..(31): n stands for inosine
ggaauggccugaugaggccguuaggccgaanaaacugg

SEQ ID NO: 12052 - RNA, 38 nt, Artificial Sequence
  Description of Artificial Sequence:  Enzymatic Nucleic Acid
  misc_feature (31)..(31): n stands for inosine
gcuggaaucugaugaggccguuaggccgaancagaaac

SEQ ID NO: 12053 - RNA, 38 nt, Artificial Sequence
  Description of Artificial Sequence:  Enzymatic Nucleic Acid
  misc_feature (31)..(31): n stands for inosine
agcuggaacugaugaggccguuaggccgaangcagaaa

SEQ ID NO: 12054 - RNA, 38 nt, Artificial Sequence
  Description of Artificial Sequence:  Enzymatic Nucleic Acid
  misc_feature (31)..(31): n stands for inosine
ccacagcucugaugaggccguuaggccgaanaauggca

SEQ ID NO: 12055 - RNA, 38 nt, Artificial Sequence
  Description of Artificial Sequence:  Enzymatic Nucleic Acid
  misc_feature (31)..(31): n stands for inosine
cccacagccugaugaggccguuaggccgaangaauggc

SEQ ID NO: 12056 - RNA, 38 nt, Artificial Sequence
  Description of Artificial Sequence:  Enzymatic Nucleic Acid
  misc_feature (31)..(31): n stands for inosine
gugcccaccugaugaggccguuaggccgaancuggaau

SEQ ID NO: 12057 - RNA, 38 nt, Artificial Sequence
  Description of Artificial Sequence:  Enzymatic Nucleic Acid
  misc_feature (31)..(31): n stands for inosine
cgcugacgcugaugaggccguuaggccgaancccacag

SEQ ID NO: 12058 - RNA, 38 nt, Artificial Sequence
  Description of Artificial Sequence:  Enzymatic Nucleic Acid
  misc_feature (31)..(31): n stands for inosine
gccuucgccugaugaggccguuaggccgaanacgugcc

SEQ ID NO: 12059 - RNA, 38 nt, Artificial Sequence
  Description of Artificial Sequence:  Enzymatic Nucleic Acid
  misc_feature (31)..(31): n stands for inosine
ccugcgcucugaugaggccguuaggccgaanccuucgc

SEQ ID NO: 12060 - RNA, 38 nt, Artificial Sequence
  Description of Artificial Sequence:  Enzymatic Nucleic Acid
  misc_feature (31)..(31): n stands for inosine
ggugaacccugaugaggccguuaggccgaancgcuugc

SEQ ID NO: 12061 - RNA, 38 nt, Artificial Sequence
  Description of Artificial Sequence:  Enzymatic Nucleic Acid
  misc_feature (31)..(31): n stands for inosine
gucguaggcugaugaggccguuaggccgaanaaccugc

SEQ ID NO: 12062 - RNA, 38 nt, Artificial Sequence
  Description of Artificial Sequence:  Enzymatic Nucleic Acid
  misc_feature (31)..(31): n stands for inosine
uggucguacugaugaggccguuaggccgaanugaaccu

SEQ ID NO: 12063 - RNA, 38 nt, Artificial Sequence
  Description of Artificial Sequence:  Enzymatic Nucleic Acid
  misc_feature (31)..(31): n stands for inosine
guggucgucugaugaggccguuaggccgaangugaacc

SEQ ID NO: 12064 - RNA, 38 nt, Artificial Sequence
  Description of Artificial Sequence:  Enzymatic Nucleic Acid
  misc_feature (31)..(31): n stands for inosine
cucagcgucugaugaggccguuaggccgaanucguagg

SEQ ID NO: 12065 - RNA, 38 nt, Artificial Sequence
  Description of Artificial Sequence:  Enzymatic Nucleic Acid
  misc_feature (31)..(31): n stands for inosine
gcucagcgcugaugaggccguuaggccgaangucguag

SEQ ID NO: 12066 - RNA, 38 nt, Artificial Sequence
  Description of Artificial Sequence:  Enzymatic Nucleic Acid
  misc_feature (31)..(31): n stands for inosine
uccagcuccugaugaggccguuaggccgaancgugguc

SEQ ID NO: 12067 - RNA, 38 nt, Artificial Sequence
  Description of Artificial Sequence:  Enzymatic Nucleic Acid
  misc_feature (31)..(31): n stands for inosine
uccuuucccugaugaggccguuaggccgaancucagcg

SEQ ID NO: 12068 - RNA, 38 nt, Artificial Sequence
  Description of Artificial Sequence:  Enzymatic Nucleic Acid
  misc_feature (31)..(31): n stands for inosine
cggggagccugaugaggccguuaggccgaancacgcga

SEQ ID NO: 12069 - RNA, 38 nt, Artificial Sequence
  Description of Artificial Sequence:  Enzymatic Nucleic Acid
  misc_feature (31)..(31): n stands for inosine
gggcggggcugaugaggccguuaggccgaancagcacg

SEQ ID NO: 12070 - RNA, 38 nt, Artificial Sequence
  Description of Artificial Sequence:  Enzymatic Nucleic Acid
  misc_feature (31)..(31): n stands for inosine
gggggcggcugaugaggccguuaggccgaanagcagca

SEQ ID NO: 12071 - RNA, 38 nt, Artificial Sequence
  Description of Artificial Sequence:  Enzymatic Nucleic Acid
  misc_feature (31)..(31): n stands for inosine
ugggggcgcugaugaggccguuaggccgaangagcagc

SEQ ID NO: 12072 - RNA, 38 nt, Artificial Sequence
  Description of Artificial Sequence:  Enzymatic Nucleic Acid
  misc_feature (31)..(31): n stands for inosine
cugggggccugaugaggccguuaggccgaanggagcag

SEQ ID NO: 12073 - RNA, 38 nt, Artificial Sequence
  Description of Artificial Sequence:  Enzymatic Nucleic Acid
  misc_feature (31)..(31): n stands for inosine
agucugggcugaugaggccguuaggccgaancggggag

SEQ ID NO: 12074 - RNA, 38 nt, Artificial Sequence
  Description of Artificial Sequence:  Enzymatic Nucleic Acid
  misc_feature (31)..(31): n stands for inosine
uagucuggcugaugaggccguuaggccgaangcgggga

SEQ ID NO: 12075 - RNA, 38 nt, Artificial Sequence
  Description of Artificial Sequence:  Enzymatic Nucleic Acid
  misc_feature (31)..(31): n stands for inosine
guagucugcugaugaggccguuaggccgaanggcgggg

SEQ ID NO: 12076 - RNA, 38 nt, Artificial Sequence
  Description of Artificial Sequence:  Enzymatic Nucleic Acid
  misc_feature (31)..(31): n stands for inosine
uguagucucugaugaggccguuaggccgaangggcggg

SEQ ID NO: 12077 - RNA, 38 nt, Artificial Sequence
  Description of Artificial Sequence:  Enzymatic Nucleic Acid
  misc_feature (31)..(31): n stands for inosine
uuguaguccugaugaggccguuaggccgaanggggcgg

SEQ ID NO: 12078 - RNA, 38 nt, Artificial Sequence
  Description of Artificial Sequence:  Enzymatic Nucleic Acid
  misc_feature (31)..(31): n stands for inosine
cgaguugucugaugaggccguuaggccgaanucugggg

SEQ ID NO: 12079 - RNA, 38 nt, Artificial Sequence
  Description of Artificial Sequence:  Enzymatic Nucleic Acid
  misc_feature (31)..(31): n stands for inosine
caccgagucugaugaggccguuaggccgaanuagucug

SEQ ID NO: 12080 - RNA, 38 nt, Artificial Sequence
  Description of Artificial Sequence:  Enzymatic Nucleic Acid
  misc_feature (31)..(31): n stands for inosine
gaccaccgcugaugaggccguuaggccgaanuuguagu

SEQ ID NO: 12081 - RNA, 38 nt, Artificial Sequence
  Description of Artificial Sequence:  Enzymatic Nucleic Acid
  misc_feature (31)..(31): n stands for inosine
ggaguacacugaugaggccguuaggccgaanaccaccg

SEQ ID NO: 12082 - RNA, 38 nt, Artificial Sequence
  Description of Artificial Sequence:  Enzymatic Nucleic Acid
  misc_feature (31)..(31): n stands for inosine
uggaguaccugaugaggccguuaggccgaangaccacc

SEQ ID NO: 12083 - RNA, 38 nt, Artificial Sequence
  Description of Artificial Sequence:  Enzymatic Nucleic Acid
  misc_feature (31)..(31): n stands for inosine
ugggguggcugaugaggccguuaggccgaanuacagga

SEQ ID NO: 12084 - RNA, 38 nt, Artificial Sequence
  Description of Artificial Sequence:  Enzymatic Nucleic Acid
  misc_feature (31)..(31): n stands for inosine
gguggggucugaugaggccguuaggccgaanaguacag

SEQ ID NO: 12085 - RNA, 38 nt, Artificial Sequence
  Description of Artificial Sequence:  Enzymatic Nucleic Acid
  misc_feature (31)..(31): n stands for inosine
ggguggggcugaugaggccguuaggccgaangaguaca

SEQ ID NO: 12086 - RNA, 38 nt, Artificial Sequence
  Description of Artificial Sequence:  Enzymatic Nucleic Acid
  misc_feature (31)..(31): n stands for inosine
auggguggcugaugaggccguuaggccgaanuggagua

SEQ ID NO: 12087 - RNA, 38 nt, Artificial Sequence
  Description of Artificial Sequence:  Enzymatic Nucleic Acid
  misc_feature (31)..(31): n stands for inosine
gaugggugcugaugaggccguuaggccgaanguggagu

SEQ ID NO: 12088 - RNA, 38 nt, Artificial Sequence
  Description of Artificial Sequence:  Enzymatic Nucleic Acid
  misc_feature (31)..(31): n stands for inosine
agaugggucugaugaggccguuaggccgaangguggag

SEQ ID NO: 12089 - RNA, 38 nt, Artificial Sequence
  Description of Artificial Sequence:  Enzymatic Nucleic Acid
  misc_feature (31)..(31): n stands for inosine
uagaugggcugaugaggccguuaggccgaangggugga

SEQ ID NO: 12090 - RNA, 38 nt, Artificial Sequence
  Description of Artificial Sequence:  Enzymatic Nucleic Acid
  misc_feature (31)..(31): n stands for inosine
ucuagaugcugaugaggccguuaggccgaanuggggug

SEQ ID NO: 12091 - RNA, 38 nt, Artificial Sequence
  Description of Artificial Sequence:  Enzymatic Nucleic Acid
  misc_feature (31)..(31): n stands for inosine
cucuagaucugaugaggccguuaggccgaanguggggu

SEQ ID NO: 12092 - RNA, 38 nt, Artificial Sequence
  Description of Artificial Sequence:  Enzymatic Nucleic Acid
  misc_feature (31)..(31): n stands for inosine
acucuagacugaugaggccguuaggccgaanggugggg

SEQ ID NO: 12093 - RNA, 38 nt, Artificial Sequence
  Description of Artificial Sequence:  Enzymatic Nucleic Acid
  misc_feature (31)..(31): n stands for inosine
caaacucucugaugaggccguuaggccgaanaugggug

SEQ ID NO: 12094 - RNA, 38 nt, Artificial Sequence
  Description of Artificial Sequence:  Enzymatic Nucleic Acid
  misc_feature (31)..(31): n stands for inosine
aggcuucgcugaugaggccguuaggccgaanucaaacu

SEQ ID NO: 12095 - RNA, 38 nt, Artificial Sequence
  Description of Artificial Sequence:  Enzymatic Nucleic Acid
  misc_feature (31)..(31): n stands for inosine
agaaauaacugaugaggccguuaggccgaancuucgug

SEQ ID NO: 12096 - RNA, 38 nt, Artificial Sequence
  Description of Artificial Sequence:  Enzymatic Nucleic Acid
  misc_feature (31)..(31): n stands for inosine
uagaaauacugaugaggccguuaggccgaangcuucgu

SEQ ID NO: 12097 - RNA, 38 nt, Artificial Sequence
  Description of Artificial Sequence:  Enzymatic Nucleic Acid
  misc_feature (31)..(31): n stands for inosine
gugcuucucugaugaggccguuaggccgaanaaauaag

SEQ ID NO: 12098 - RNA, 38 nt, Artificial Sequence
  Description of Artificial Sequence:  Enzymatic Nucleic Acid
  misc_feature (31)..(31): n stands for inosine
uacacaugcugaugaggccguuaggccgaancuucuag

SEQ ID NO: 12099 - RNA, 38 nt, Artificial Sequence
  Description of Artificial Sequence:  Enzymatic Nucleic Acid
  misc_feature (31)..(31): n stands for inosine
aauacacacugaugaggccguuaggccgaanugcuucu

SEQ ID NO: 12100 - RNA, 38 nt, Artificial Sequence
  Description of Artificial Sequence:  Enzymatic Nucleic Acid
  misc_feature (31)..(31): n stands for inosine
uuccugggcugaugaggccguuaggccgaanuauaaau

SEQ ID NO: 12101 - RNA, 38 nt, Artificial Sequence
  Description of Artificial Sequence:  Enzymatic Nucleic Acid
  misc_feature (31)..(31): n stands for inosine
uuuccuggcugaugaggccguuaggccgaanguauaaa

SEQ ID NO: 12102 - RNA, 38 nt, Artificial Sequence
  Description of Artificial Sequence:  Enzymatic Nucleic Acid
  misc_feature (31)..(31): n stands for inosine
guuuccugcugaugaggccguuaggccgaangguauaa

SEQ ID NO: 12103 - RNA, 38 nt, Artificial Sequence
  Description of Artificial Sequence:  Enzymatic Nucleic Acid
  misc_feature (31)..(31): n stands for inosine
aguuuccucugaugaggccguuaggccgaanggguaua

SEQ ID NO: 12104 - RNA, 38 nt, Artificial Sequence
  Description of Artificial Sequence:  Enzymatic Nucleic Acid
  misc_feature (31)..(31): n stands for inosine
uaguuucccugaugaggccguuaggccgaangggguau

SEQ ID NO: 12105 - RNA, 38 nt, Artificial Sequence
  Description of Artificial Sequence:  Enzymatic Nucleic Acid
  misc_feature (31)..(31): n stands for inosine
caaaagcucugaugaggccguuaggccgaanuuuccug

SEQ ID NO: 12106 - RNA, 38 nt, Artificial Sequence
  Description of Artificial Sequence:  Enzymatic Nucleic Acid
  misc_feature (31)..(31): n stands for inosine
cuggcaaacugaugaggccguuaggccgaancuaguuu

SEQ ID NO: 12107 - RNA, 38 nt, Artificial Sequence
  Description of Artificial Sequence:  Enzymatic Nucleic Acid
  misc_feature (31)..(31): n stands for inosine
auaauacucugaugaggccguuaggccgaancaaaagc

SEQ ID NO: 12108 - RNA, 38 nt, Artificial Sequence
  Description of Artificial Sequence:  Enzymatic Nucleic Acid
  misc_feature (31)..(31): n stands for inosine
cauaauaccugaugaggccguuaggccgaangcaaaag

SEQ ID NO: 12109 - RNA, 38 nt, Artificial Sequence
  Description of Artificial Sequence:  Enzymatic Nucleic Acid
  misc_feature (31)..(31): n stands for inosine
cuuauauacugaugaggccguuaggccgaancauaaua

SEQ ID NO: 12110 - RNA, 38 nt, Artificial Sequence
  Description of Artificial Sequence:  Enzymatic Nucleic Acid
  misc_feature (31)..(31): n stands for inosine
gauaaaggcugaugaggccguuaggccgaanuaaacuu

SEQ ID NO: 12111 - RNA, 38 nt, Artificial Sequence
  Description of Artificial Sequence:  Enzymatic Nucleic Acid
  misc_feature (31)..(31): n stands for inosine
aagauaaacugaugaggccguuaggccgaanuguaaac

SEQ ID NO: 12112 - RNA, 38 nt, Artificial Sequence
  Description of Artificial Sequence:  Enzymatic Nucleic Acid
  misc_feature (31)..(31): n stands for inosine
aaagauaacugaugaggccguuaggccgaanguguaaa

SEQ ID NO: 12113 - RNA, 38 nt, Artificial Sequence
  Description of Artificial Sequence:  Enzymatic Nucleic Acid
  misc_feature (31)..(31): n stands for inosine
ccauggaacugaugaggccguuaggccgaanauaaagg

SEQ ID NO: 12114 - RNA, 38 nt, Artificial Sequence
  Description of Artificial Sequence:  Enzymatic Nucleic Acid
  misc_feature (31)..(31): n stands for inosine
gcucccaucugaugaggccguuaggccgaanaaagaua

SEQ ID NO: 12115 - RNA, 38 nt, Artificial Sequence
  Description of Artificial Sequence:  Enzymatic Nucleic Acid
  misc_feature (31)..(31): n stands for inosine
ggcucccacugaugaggccguuaggccgaangaaagau

SEQ ID NO: 12116 - RNA, 38 nt, Artificial Sequence
  Description of Artificial Sequence:  Enzymatic Nucleic Acid
  misc_feature (31)..(31): n stands for inosine
aagcagcucugaugaggccguuaggccgaancucccau

SEQ ID NO: 12117 - RNA, 38 nt, Artificial Sequence
  Description of Artificial Sequence:  Enzymatic Nucleic Acid
  misc_feature (31)..(31): n stands for inosine
aaagcagccugaugaggccguuaggccgaangcuccca

SEQ ID NO: 12118 - RNA, 38 nt, Artificial Sequence
  Description of Artificial Sequence:  Enzymatic Nucleic Acid
  misc_feature (31)..(31): n stands for inosine
caaaaagccugaugaggccguuaggccgaancuggcuc

SEQ ID NO: 12119 - RNA, 38 nt, Artificial Sequence
  Description of Artificial Sequence:  Enzymatic Nucleic Acid
  misc_feature (31)..(31): n stands for inosine
ucacaaaacugaugaggccguuaggccgaancagcugg

SEQ ID NO: 12120 - RNA, 38 nt, Artificial Sequence
  Description of Artificial Sequence:  Enzymatic Nucleic Acid
  misc_feature (31)..(31): n stands for inosine
aaaaaaaacugaugaggccguuaggccgaancacuauu

SEQ ID NO: 12121 - RNA, 38 nt, Artificial Sequence
  Description of Artificial Sequence:  Enzymatic Nucleic Acid
  misc_feature (31)..(31): n stands for inosine
uucuuguucugaugaggccguuaggccgaanucaaaaa

SEQ ID NO: 12122 - RNA, 38 nt, Artificial Sequence
  Description of Artificial Sequence:  Enzymatic Nucleic Acid
  misc_feature (31)..(31): n stands for inosine
uacauucucugaugaggccguuaggccgaanuuaguca

SEQ ID NO: 12123 - RNA, 38 nt, Artificial Sequence
  Description of Artificial Sequence:  Enzymatic Nucleic Acid
  misc_feature (31)..(31): n stands for inosine
cuaucuggcugaugaggccguuaggccgaanuuacauu

SEQ ID NO: 12124 - RNA, 38 nt, Artificial Sequence
  Description of Artificial Sequence:  Enzymatic Nucleic Acid
  misc_feature (31)..(31): n stands for inosine
cucuaucucugaugaggccguuaggccgaanaguuaca

SEQ ID NO: 12125 - RNA, 38 nt, Artificial Sequence
  Description of Artificial Sequence:  Enzymatic Nucleic Acid
  misc_feature (31)..(31): n stands for inosine
ucucuauccugaugaggccguuaggccgaangaguuac

SEQ ID NO: 12126 - RNA, 38 nt, Artificial Sequence
  Description of Artificial Sequence:  Enzymatic Nucleic Acid
  misc_feature (31)..(31): n stands for inosine
ucuucacucugaugaggccguuaggccgaanucacuau

SEQ ID NO: 12127 - RNA, 38 nt, Artificial Sequence
  Description of Artificial Sequence:  Enzymatic Nucleic Acid
  misc_feature (31)..(31): n stands for inosine
agcaguagcugaugaggccguuaggccgaanuucuuca

SEQ ID NO: 12128 - RNA, 38 nt, Artificial Sequence
  Description of Artificial Sequence:  Enzymatic Nucleic Acid
  misc_feature (31)..(31): n stands for inosine
uuagcagucugaugaggccguuaggccgaanuguucuu

SEQ ID NO: 12129 - RNA, 38 nt, Artificial Sequence
  Description of Artificial Sequence:  Enzymatic Nucleic Acid
  misc_feature (31)..(31): n stands for inosine
gauuuagccugaugaggccguuaggccgaanuaguguu

SEQ ID NO: 12130 - RNA, 38 nt, Artificial Sequence
  Description of Artificial Sequence:  Enzymatic Nucleic Acid
  misc_feature (31)..(31): n stands for inosine
gaggauuucugaugaggccguuaggccgaancaguagu

SEQ ID NO: 12131 - RNA, 38 nt, Artificial Sequence
  Description of Artificial Sequence:  Enzymatic Nucleic Acid
  misc_feature (31)..(31): n stands for inosine
uaacaugacugaugaggccguuaggccgaanauuuagc

SEQ ID NO: 12132 - RNA, 38 nt, Artificial Sequence
  Description of Artificial Sequence:  Enzymatic Nucleic Acid
  misc_feature (31)..(31): n stands for inosine
guaacaugcugaugaggccguuaggccgaangauuuag

SEQ ID NO: 12133 - RNA, 38 nt, Artificial Sequence
  Description of Artificial Sequence:  Enzymatic Nucleic Acid
  misc_feature (31)..(31): n stands for inosine
gaguaacacugaugaggccguuaggccgaanaggauuu

SEQ ID NO: 12134 - RNA, 38 nt, Artificial Sequence
  Description of Artificial Sequence:  Enzymatic Nucleic Acid
  misc_feature (31)..(31): n stands for inosine
uaacacugcugaugaggccguuaggccgaanuaacaug

SEQ ID NO: 12135 - RNA, 38 nt, Artificial Sequence
  Description of Artificial Sequence:  Enzymatic Nucleic Acid
  misc_feature (31)..(31): n stands for inosine
ucuaacaccugaugaggccguuaggccgaanaguaaca

SEQ ID NO: 12136 - RNA, 38 nt, Artificial Sequence
  Description of Artificial Sequence:  Enzymatic Nucleic Acid
  misc_feature (31)..(31): n stands for inosine
uuuaggaacugaugaggccguuaggccgaanauuucuc

SEQ ID NO: 12137 - RNA, 38 nt, Artificial Sequence
  Description of Artificial Sequence:  Enzymatic Nucleic Acid
  misc_feature (31)..(31): n stands for inosine
guuuaggacugaugaggccguuaggccgaangauuucu

SEQ ID NO: 12138 - RNA, 38 nt, Artificial Sequence
  Description of Artificial Sequence:  Enzymatic Nucleic Acid
  misc_feature (31)..(31): n stands for inosine
uggguuuacugaugaggccguuaggccgaanaaggauu

SEQ ID NO: 12139 - RNA, 38 nt, Artificial Sequence
  Description of Artificial Sequence:  Enzymatic Nucleic Acid
  misc_feature (31)..(31): n stands for inosine
uuggguuucugaugaggccguuaggccgaangaaggau

SEQ ID NO: 12140 - RNA, 38 nt, Artificial Sequence
  Description of Artificial Sequence:  Enzymatic Nucleic Acid
  misc_feature (31)..(31): n stands for inosine
agucauugcugaugaggccguuaggccgaanuuuagga

SEQ ID NO: 12141 - RNA, 38 nt, Artificial Sequence
  Description of Artificial Sequence:  Enzymatic Nucleic Acid
  misc_feature (31)..(31): n stands for inosine
aagucauucugaugaggccguuaggccgaanguuuagg

SEQ ID NO: 12142 - RNA, 38 nt, Artificial Sequence
  Description of Artificial Sequence:  Enzymatic Nucleic Acid
  misc_feature (31)..(31): n stands for inosine
gaagucaucugaugaggccguuaggccgaangguuuag

SEQ ID NO: 12143 - RNA, 38 nt, Artificial Sequence
  Description of Artificial Sequence:  Enzymatic Nucleic Acid
  misc_feature (31)..(31): n stands for inosine
agcagggacugaugaggccguuaggccgaanucauugg

SEQ ID NO: 12144 - RNA, 38 nt, Artificial Sequence
  Description of Artificial Sequence:  Enzymatic Nucleic Acid
  misc_feature (31)..(31): n stands for inosine
uggagcagcugaugaggccguuaggccgaanaagucau

SEQ ID NO: 12145 - RNA, 38 nt, Artificial Sequence
  Description of Artificial Sequence:  Enzymatic Nucleic Acid
  misc_feature (31)..(31): n stands for inosine
uuggagcacugaugaggccguuaggccgaangaaguca

SEQ ID NO: 12146 - RNA, 38 nt, Artificial Sequence
  Description of Artificial Sequence:  Enzymatic Nucleic Acid
  misc_feature (31)..(31): n stands for inosine
guuggagccugaugaggccguuaggccgaanggaaguc

SEQ ID NO: 12147 - RNA, 38 nt, Artificial Sequence
  Description of Artificial Sequence:  Enzymatic Nucleic Acid
  misc_feature (31)..(31): n stands for inosine
gggguuggcugaugaggccguuaggccgaancagggaa

SEQ ID NO: 12148 - RNA, 38 nt, Artificial Sequence
  Description of Artificial Sequence:  Enzymatic Nucleic Acid
  misc_feature (31)..(31): n stands for inosine
cggggguucugaugaggccguuaggccgaanagcaggg

SEQ ID NO: 12149 - RNA, 38 nt, Artificial Sequence
  Description of Artificial Sequence:  Enzymatic Nucleic Acid
  misc_feature (31)..(31): n stands for inosine
gcgggggucugaugaggccguuaggccgaangagcagg

SEQ ID NO: 12150 - RNA, 38 nt, Artificial Sequence
  Description of Artificial Sequence:  Enzymatic Nucleic Acid
  misc_feature (31)..(31): n stands for inosine
guggcgggcugaugaggccguuaggccgaanuuggagc

SEQ ID NO: 12151 - RNA, 38 nt, Artificial Sequence
  Description of Artificial Sequence:  Enzymatic Nucleic Acid
  misc_feature (31)..(31): n stands for inosine
gguggcggcugaugaggccguuaggccgaanguuggag

SEQ ID NO: 12152 - RNA, 38 nt, Artificial Sequence
  Description of Artificial Sequence:  Enzymatic Nucleic Acid
  misc_feature (31)..(31): n stands for inosine
agguggcgcugaugaggccguuaggccgaangguugga

SEQ ID NO: 12153 - RNA, 38 nt, Artificial Sequence
  Description of Artificial Sequence:  Enzymatic Nucleic Acid
  misc_feature (31)..(31): n stands for inosine
gagguggccugaugaggccguuaggccgaanggguugg

SEQ ID NO: 12154 - RNA, 38 nt, Artificial Sequence
  Description of Artificial Sequence:  Enzymatic Nucleic Acid
  misc_feature (31)..(31): n stands for inosine
ccugaggucugaugaggccguuaggccgaancgggggu

SEQ ID NO: 12155 - RNA, 38 nt, Artificial Sequence
  Description of Artificial Sequence:  Enzymatic Nucleic Acid
  misc_feature (31)..(31): n stands for inosine
cccugaggcugaugaggccguuaggccgaangcggggg

SEQ ID NO: 12156 - RNA, 38 nt, Artificial Sequence
  Description of Artificial Sequence:  Enzymatic Nucleic Acid
  misc_feature (31)..(31): n stands for inosine
ugcccugacugaugaggccguuaggccgaanuggcggg

SEQ ID NO: 12157 - RNA, 38 nt, Artificial Sequence
  Description of Artificial Sequence:  Enzymatic Nucleic Acid
  misc_feature (31)..(31): n stands for inosine
gugcccugcugaugaggccguuaggccgaanguggcgg

SEQ ID NO: 12158 - RNA, 38 nt, Artificial Sequence
  Description of Artificial Sequence:  Enzymatic Nucleic Acid
  misc_feature (31)..(31): n stands for inosine
gcgugccccugaugaggccguuaggccgaanagguggc

SEQ ID NO: 12159 - RNA, 38 nt, Artificial Sequence
  Description of Artificial Sequence:  Enzymatic Nucleic Acid
  misc_feature (31)..(31): n stands for inosine
guccugcgcugaugaggccguuaggccgaancccugag

SEQ ID NO: 12160 - RNA, 38 nt, Artificial Sequence
  Description of Artificial Sequence:  Enzymatic Nucleic Acid
  misc_feature (31)..(31): n stands for inosine
acuggucccugaugaggccguuaggccgaancgugccc

SEQ ID NO: 12161 - RNA, 38 nt, Artificial Sequence
  Description of Artificial Sequence:  Enzymatic Nucleic Acid
  misc_feature (31)..(31): n stands for inosine
aucaaacucugaugaggccguuaggccgaanuccugcg

SEQ ID NO: 12162 - RNA, 38 nt, Artificial Sequence
  Description of Artificial Sequence:  Enzymatic Nucleic Acid
  misc_feature (31)..(31): n stands for inosine
aaucaaaccugaugaggccguuaggccgaanguccugc

SEQ ID NO: 12163 - RNA, 38 nt, Artificial Sequence
  Description of Artificial Sequence:  Enzymatic Nucleic Acid
  misc_feature (31)..(31): n stands for inosine
aucagugccugaugaggccguuaggccgaancuccuca

SEQ ID NO: 12164 - RNA, 38 nt, Artificial Sequence
  Description of Artificial Sequence:  Enzymatic Nucleic Acid
  misc_feature (31)..(31): n stands for inosine
gugaucagcugaugaggccguuaggccgaancagcucc

SEQ ID NO: 12165 - RNA, 38 nt, Artificial Sequence
  Description of Artificial Sequence:  Enzymatic Nucleic Acid
  misc_feature (31)..(31): n stands for inosine
gggugauccugaugaggccguuaggccgaanugcagcu

SEQ ID NO: 12166 - RNA, 38 nt, Artificial Sequence
  Description of Artificial Sequence:  Enzymatic Nucleic Acid
  misc_feature (31)..(31): n stands for inosine
gcauugggcugaugaggccguuaggccgaanaucagug

SEQ ID NO: 12167 - RNA, 38 nt, Artificial Sequence
  Description of Artificial Sequence:  Enzymatic Nucleic Acid
  misc_feature (31)..(31): n stands for inosine
augcauugcugaugaggccguuaggccgaanugaucag

SEQ ID NO: 12168 - RNA, 38 nt, Artificial Sequence
  Description of Artificial Sequence:  Enzymatic Nucleic Acid
  misc_feature (31)..(31): n stands for inosine
gaugcauucugaugaggccguuaggccgaangugauca

SEQ ID NO: 12169 - RNA, 38 nt, Artificial Sequence
  Description of Artificial Sequence:  Enzymatic Nucleic Acid
  misc_feature (31)..(31): n stands for inosine
ugaugcaucugaugaggccguuaggccgaanggugauc

SEQ ID NO: 12170 - RNA, 38 nt, Artificial Sequence
  Description of Artificial Sequence:  Enzymatic Nucleic Acid
  misc_feature (31)..(31): n stands for inosine
guacgugacugaugaggccguuaggccgaancauuggg

SEQ ID NO: 12171 - RNA, 38 nt, Artificial Sequence
  Description of Artificial Sequence:  Enzymatic Nucleic Acid
  misc_feature (31)..(31): n stands for inosine
gggguacgcugaugaggccguuaggccgaanaugcauu

SEQ ID NO: 12172 - RNA, 38 nt, Artificial Sequence
  Description of Artificial Sequence:  Enzymatic Nucleic Acid
  misc_feature (31)..(31): n stands for inosine
cccaguggcugaugaggccguuaggccgaanuacguga

SEQ ID NO: 12173 - RNA, 38 nt, Artificial Sequence
  Description of Artificial Sequence:  Enzymatic Nucleic Acid
  misc_feature (31)..(31): n stands for inosine
gcccagugcugaugaggccguuaggccgaanguacgug

SEQ ID NO: 12174 - RNA, 38 nt, Artificial Sequence
  Description of Artificial Sequence:  Enzymatic Nucleic Acid
  misc_feature (31)..(31): n stands for inosine
ggcccagucugaugaggccguuaggccgaangguacgu

SEQ ID NO: 12175 - RNA, 38 nt, Artificial Sequence
  Description of Artificial Sequence:  Enzymatic Nucleic Acid
  misc_feature (31)..(31): n stands for inosine
uggcccagcugaugaggccguuaggccgaanggguacg

SEQ ID NO: 12176 - RNA, 38 nt, Artificial Sequence
  Description of Artificial Sequence:  Enzymatic Nucleic Acid
  misc_feature (31)..(31): n stands for inosine
gcuggccccugaugaggccguuaggccgaanuggggua

SEQ ID NO: 12177 - RNA, 38 nt, Artificial Sequence
  Description of Artificial Sequence:  Enzymatic Nucleic Acid
  misc_feature (31)..(31): n stands for inosine
gcagggcucugaugaggccguuaggccgaancccagug

SEQ ID NO: 12178 - RNA, 38 nt, Artificial Sequence
  Description of Artificial Sequence:  Enzymatic Nucleic Acid
  misc_feature (31)..(31): n stands for inosine
ugcagggccugaugaggccguuaggccgaangcccagu

SEQ ID NO: 12179 - RNA, 38 nt, Artificial Sequence
  Description of Artificial Sequence:  Enzymatic Nucleic Acid
  misc_feature (31)..(31): n stands for inosine
ggcugcagcugaugaggccguuaggccgaancuggccc

SEQ ID NO: 12180 - RNA, 38 nt, Artificial Sequence
  Description of Artificial Sequence:  Enzymatic Nucleic Acid
  misc_feature (31)..(31): n stands for inosine
gggcugcacugaugaggccguuaggccgaangcuggcc

SEQ ID NO: 12181 - RNA, 38 nt, Artificial Sequence
  Description of Artificial Sequence:  Enzymatic Nucleic Acid
  misc_feature (31)..(31): n stands for inosine
ugggcugccugaugaggccguuaggccgaanggcuggc

SEQ ID NO: 12182 - RNA, 38 nt, Artificial Sequence
  Description of Artificial Sequence:  Enzymatic Nucleic Acid
  misc_feature (31)..(31): n stands for inosine
uuuugggccugaugaggccguuaggccgaancagggcu

SEQ ID NO: 12183 - RNA, 38 nt, Artificial Sequence
  Description of Artificial Sequence:  Enzymatic Nucleic Acid
  misc_feature (31)..(31): n stands for inosine
ggguuuugcugaugaggccguuaggccgaancugcagg

SEQ ID NO: 12184 - RNA, 38 nt, Artificial Sequence
  Description of Artificial Sequence:  Enzymatic Nucleic Acid
  misc_feature (31)..(31): n stands for inosine
uggguuuucugaugaggccguuaggccgaangcugcag

SEQ ID NO: 12185 - RNA, 38 nt, Artificial Sequence
  Description of Artificial Sequence:  Enzymatic Nucleic Acid
  misc_feature (31)..(31): n stands for inosine
cuggguuucugaugaggccguuaggccgaanggcugca

SEQ ID NO: 12186 - RNA, 38 nt, Artificial Sequence
  Description of Artificial Sequence:  Enzymatic Nucleic Acid
  misc_feature (31)..(31): n stands for inosine
uugcccugcugaugaggccguuaggccgaanuuuuggg

SEQ ID NO: 12187 - RNA, 38 nt, Artificial Sequence
  Description of Artificial Sequence:  Enzymatic Nucleic Acid
  misc_feature (31)..(31): n stands for inosine
guugcccucugaugaggccguuaggccgaanguuuugg

SEQ ID NO: 12188 - RNA, 38 nt, Artificial Sequence
  Description of Artificial Sequence:  Enzymatic Nucleic Acid
  misc_feature (31)..(31): n stands for inosine
uguugccccugaugaggccguuaggccgaangguuuug

SEQ ID NO: 12189 - RNA, 38 nt, Artificial Sequence
  Description of Artificial Sequence:  Enzymatic Nucleic Acid
  misc_feature (31)..(31): n stands for inosine
gggcuugucugaugaggccguuaggccgaancccuggg

SEQ ID NO: 12190 - RNA, 38 nt, Artificial Sequence
  Description of Artificial Sequence:  Enzymatic Nucleic Acid
  misc_feature (31)..(31): n stands for inosine
aacgggcucugaugaggccguuaggccgaanuugcccu

SEQ ID NO: 12191 - RNA, 38 nt, Artificial Sequence
  Description of Artificial Sequence:  Enzymatic Nucleic Acid
  misc_feature (31)..(31): n stands for inosine
ggcuaacgcugaugaggccguuaggccgaancuuguug

SEQ ID NO: 12192 - RNA, 38 nt, Artificial Sequence
  Description of Artificial Sequence:  Enzymatic Nucleic Acid
  misc_feature (31)..(31): n stands for inosine
gggcuaaccugaugaggccguuaggccgaangcuuguu

SEQ ID NO: 12193 - RNA, 38 nt, Artificial Sequence
  Description of Artificial Sequence:  Enzymatic Nucleic Acid
  misc_feature (31)..(31): n stands for inosine
uccccuggcugaugaggccguuaggccgaancuaacgg

SEQ ID NO: 12194 - RNA, 38 nt, Artificial Sequence
  Description of Artificial Sequence:  Enzymatic Nucleic Acid
  misc_feature (31)..(31): n stands for inosine
auccccugcugaugaggccguuaggccgaangcuaacg

SEQ ID NO: 12195 - RNA, 38 nt, Artificial Sequence
  Description of Artificial Sequence:  Enzymatic Nucleic Acid
  misc_feature (31)..(31): n stands for inosine
gauccccucugaugaggccguuaggccgaanggcuaac

SEQ ID NO: 12196 - RNA, 38 nt, Artificial Sequence
  Description of Artificial Sequence:  Enzymatic Nucleic Acid
  misc_feature (31)..(31): n stands for inosine
ugaucccccugaugaggccguuaggccgaangggcuaa

SEQ ID NO: 12197 - RNA, 38 nt, Artificial Sequence
  Description of Artificial Sequence:  Enzymatic Nucleic Acid
  misc_feature (31)..(31): n stands for inosine
ccagccagcugaugaggccguuaggccgaanauccccu

SEQ ID NO: 12198 - RNA, 38 nt, Artificial Sequence
  Description of Artificial Sequence:  Enzymatic Nucleic Acid
  misc_feature (31)..(31): n stands for inosine
ggccagcccugaugaggccguuaggccgaanugauccc

SEQ ID NO: 12199 - RNA, 38 nt, Artificial Sequence
  Description of Artificial Sequence:  Enzymatic Nucleic Acid
  misc_feature (31)..(31): n stands for inosine
cucaggcccugaugaggccguuaggccgaanccaguga

SEQ ID NO: 12200 - RNA, 38 nt, Artificial Sequence
  Description of Artificial Sequence:  Enzymatic Nucleic Acid
  misc_feature (31)..(31): n stands for inosine
guugcucacugaugaggccguuaggccgaanccagcca

SEQ ID NO: 12201 - RNA, 38 nt, Artificial Sequence
  Description of Artificial Sequence:  Enzymatic Nucleic Acid
  misc_feature (31)..(31): n stands for inosine
uguugcuccugaugaggccguuaggccgaangccagcc

SEQ ID NO: 12202 - RNA, 38 nt, Artificial Sequence
  Description of Artificial Sequence:  Enzymatic Nucleic Acid
  misc_feature (31)..(31): n stands for inosine
cgagaugucugaugaggccguuaggccgaancucaggc

SEQ ID NO: 12203 - RNA, 38 nt, Artificial Sequence
  Description of Artificial Sequence:  Enzymatic Nucleic Acid
  misc_feature (31)..(31): n stands for inosine
ucccgagacugaugaggccguuaggccgaanuugcuca

SEQ ID NO: 12204 - RNA, 38 nt, Artificial Sequence
  Description of Artificial Sequence:  Enzymatic Nucleic Acid
  misc_feature (31)..(31): n stands for inosine
gacucccgcugaugaggccguuaggccgaanauguugc

SEQ ID NO: 12205 - RNA, 38 nt, Artificial Sequence
  Description of Artificial Sequence:  Enzymatic Nucleic Acid
  misc_feature (31)..(31): n stands for inosine
cugcuagacugaugaggccguuaggccgaanacucccg

SEQ ID NO: 12206 - RNA, 38 nt, Artificial Sequence
  Description of Artificial Sequence:  Enzymatic Nucleic Acid
  misc_feature (31)..(31): n stands for inosine
ccugcuagcugaugaggccguuaggccgaangacuccc

SEQ ID NO: 12207 - RNA, 38 nt, Artificial Sequence
  Description of Artificial Sequence:  Enzymatic Nucleic Acid
  misc_feature (31)..(31): n stands for inosine
ggccugcucugaugaggccguuaggccgaanaggacuc

SEQ ID NO: 12208 - RNA, 38 nt, Artificial Sequence
  Description of Artificial Sequence:  Enzymatic Nucleic Acid
  misc_feature (31)..(31): n stands for inosine
cuuaggcccugaugaggccguuaggccgaancuagagg

SEQ ID NO: 12209 - RNA, 38 nt, Artificial Sequence
  Description of Artificial Sequence:  Enzymatic Nucleic Acid
  misc_feature (31)..(31): n stands for inosine
augucuuacugaugaggccguuaggccgaanccugcua

SEQ ID NO: 12210 - RNA, 38 nt, Artificial Sequence
  Description of Artificial Sequence:  Enzymatic Nucleic Acid
  misc_feature (31)..(31): n stands for inosine
caugucuucugaugaggccguuaggccgaangccugcu

SEQ ID NO: 12211 - RNA, 38 nt, Artificial Sequence
  Description of Artificial Sequence:  Enzymatic Nucleic Acid
  misc_feature (31)..(31): n stands for inosine
uccucacacugaugaggccguuaggccgaanucuuagg

SEQ ID NO: 12212 - RNA, 38 nt, Artificial Sequence
  Description of Artificial Sequence:  Enzymatic Nucleic Acid
  misc_feature (31)..(31): n stands for inosine
uugcuuuucugaugaggccguuaggccgaancuuuuuu

SEQ ID NO: 12213 - RNA, 38 nt, Artificial Sequence
  Description of Artificial Sequence:  Enzymatic Nucleic Acid
  misc_feature (31)..(31): n stands for inosine
uucucccucugaugaggccguuaggccgaancuuuuug

SEQ ID NO: 12214 - RNA, 38 nt, Artificial Sequence
  Description of Artificial Sequence:  Enzymatic Nucleic Acid
  misc_feature (31)..(31): n stands for inosine
cuucuccccugaugaggccguuaggccgaanuuucucu

SEQ ID NO: 12215 - RNA, 38 nt, Artificial Sequence
  Description of Artificial Sequence:  Enzymatic Nucleic Acid
  misc_feature (31)..(31): n stands for inosine
cuuucucacugaugaggccguuaggccgaanccuucuc

SEQ ID NO: 12216 - RNA, 38 nt, Artificial Sequence
  Description of Artificial Sequence:  Enzymatic Nucleic Acid
  misc_feature (31)..(31): n stands for inosine
ccacauggcugaugaggccguuaggccgaancgucuca

SEQ ID NO: 12217 - RNA, 38 nt, Artificial Sequence
  Description of Artificial Sequence:  Enzymatic Nucleic Acid
  misc_feature (31)..(31): n stands for inosine
gcccacaucugaugaggccguuaggccgaanugcgucu

SEQ ID NO: 12218 - RNA, 38 nt, Artificial Sequence
  Description of Artificial Sequence:  Enzymatic Nucleic Acid
  misc_feature (31)..(31): n stands for inosine
ugcccacacugaugaggccguuaggccgaangugcguc

SEQ ID NO: 12219 - RNA, 38 nt, Artificial Sequence
  Description of Artificial Sequence:  Enzymatic Nucleic Acid
  misc_feature (31)..(31): n stands for inosine
ccccuccgcugaugaggccguuaggccgaancccacau

SEQ ID NO: 12220 - RNA, 38 nt, Artificial Sequence
  Description of Artificial Sequence:  Enzymatic Nucleic Acid
  misc_feature (31)..(31): n stands for inosine
cauugcugcugaugaggccguuaggccgaanccccguc

SEQ ID NO: 12221 - RNA, 38 nt, Artificial Sequence
  Description of Artificial Sequence:  Enzymatic Nucleic Acid
  misc_feature (31)..(31): n stands for inosine
ggcauugccugaugaggccguuaggccgaanagccccg

SEQ ID NO: 12222 - RNA, 38 nt, Artificial Sequence
  Description of Artificial Sequence:  Enzymatic Nucleic Acid
  misc_feature (31)..(31): n stands for inosine
aauggcaucugaugaggccguuaggccgaancugagcc

SEQ ID NO: 12223 - RNA, 38 nt, Artificial Sequence
  Description of Artificial Sequence:  Enzymatic Nucleic Acid
  misc_feature (31)..(31): n stands for inosine
acugaaaucugaugaggccguuaggccgaancauugcu

SEQ ID NO: 12224 - RNA, 38 nt, Artificial Sequence
  Description of Artificial Sequence:  Enzymatic Nucleic Acid
  misc_feature (31)..(31): n stands for inosine
cacugaaacugaugaggccguuaggccgaangcauugc

SEQ ID NO: 12225 - RNA, 38 nt, Artificial Sequence
  Description of Artificial Sequence:  Enzymatic Nucleic Acid
  misc_feature (31)..(31): n stands for inosine
gaagccaccugaugaggccguuaggccgaanaaauggc

SEQ ID NO: 12226 - RNA, 38 nt, Artificial Sequence
  Description of Artificial Sequence:  Enzymatic Nucleic Acid
  misc_feature (31)..(31): n stands for inosine
agcugggacugaugaggccguuaggccgaanccacuga

SEQ ID NO: 12227 - RNA, 38 nt, Artificial Sequence
  Description of Artificial Sequence:  Enzymatic Nucleic Acid
  misc_feature (31)..(31): n stands for inosine
cagagcugcugaugaggccguuaggccgaanaagccac

SEQ ID NO: 12228 - RNA, 38 nt, Artificial Sequence
  Description of Artificial Sequence:  Enzymatic Nucleic Acid
  misc_feature (31)..(31): n stands for inosine
ucagagcucugaugaggccguuaggccgaangaagcca

SEQ ID NO: 12229 - RNA, 38 nt, Artificial Sequence
  Description of Artificial Sequence:  Enzymatic Nucleic Acid
  misc_feature (31)..(31): n stands for inosine
gucagagccugaugaggccguuaggccgaanggaagcc

SEQ ID NO: 12230 - RNA, 38 nt, Artificial Sequence
  Description of Artificial Sequence:  Enzymatic Nucleic Acid
  misc_feature (31)..(31): n stands for inosine
agggucagcugaugaggccguuaggccgaancugggaa

SEQ ID NO: 12231 - RNA, 38 nt, Artificial Sequence
  Description of Artificial Sequence:  Enzymatic Nucleic Acid
  misc_feature (31)..(31): n stands for inosine
gaaggguccugaugaggccguuaggccgaanagcuggg

SEQ ID NO: 12232 - RNA, 38 nt, Artificial Sequence
  Description of Artificial Sequence:  Enzymatic Nucleic Acid
  misc_feature (31)..(31): n stands for inosine
uguagaagcugaugaggccguuaggccgaanucagagc

SEQ ID NO: 12233 - RNA, 38 nt, Artificial Sequence
  Description of Artificial Sequence:  Enzymatic Nucleic Acid
  misc_feature (31)..(31): n stands for inosine
auguagaacugaugaggccguuaggccgaangucagag

SEQ ID NO: 12234 - RNA, 38 nt, Artificial Sequence
  Description of Artificial Sequence:  Enzymatic Nucleic Acid
  misc_feature (31)..(31): n stands for inosine
aauguagacugaugaggccguuaggccgaanggucaga

SEQ ID NO: 12235 - RNA, 38 nt, Artificial Sequence
  Description of Artificial Sequence:  Enzymatic Nucleic Acid
  misc_feature (31)..(31): n stands for inosine
ucaaaugucugaugaggccguuaggccgaanaaggguc

SEQ ID NO: 12236 - RNA, 38 nt, Artificial Sequence
  Description of Artificial Sequence:  Enzymatic Nucleic Acid
  misc_feature (31)..(31): n stands for inosine
cccucaaacugaugaggccguuaggccgaanuagaagg

SEQ ID NO: 12237 - RNA, 38 nt, Artificial Sequence
  Description of Artificial Sequence:  Enzymatic Nucleic Acid
  misc_feature (31)..(31): n stands for inosine
ccuggcugcugaugaggccguuaggccgaancccucaa

SEQ ID NO: 12238 - RNA, 38 nt, Artificial Sequence
  Description of Artificial Sequence:  Enzymatic Nucleic Acid
  misc_feature (31)..(31): n stands for inosine
uccuggcucugaugaggccguuaggccgaangcccuca

SEQ ID NO: 12239 - RNA, 38 nt, Artificial Sequence
  Description of Artificial Sequence:  Enzymatic Nucleic Acid
  misc_feature (31)..(31): n stands for inosine
cuccuggccugaugaggccguuaggccgaanggcccuc

SEQ ID NO: 12240 - RNA, 38 nt, Artificial Sequence
  Description of Artificial Sequence:  Enzymatic Nucleic Acid
  misc_feature (31)..(31): n stands for inosine
cugcuccucugaugaggccguuaggccgaancugggcc

SEQ ID NO: 12241 - RNA, 38 nt, Artificial Sequence
  Description of Artificial Sequence:  Enzymatic Nucleic Acid
  misc_feature (31)..(31): n stands for inosine
ucugcucccugaugaggccguuaggccgaangcugggc

SEQ ID NO: 12242 - RNA, 38 nt, Artificial Sequence
  Description of Artificial Sequence:  Enzymatic Nucleic Acid
  misc_feature (31)..(31): n stands for inosine
uguccauccugaugaggccguuaggccgaancuccugg

SEQ ID NO: 12243 - RNA, 38 nt, Artificial Sequence
  Description of Artificial Sequence:  Enzymatic Nucleic Acid
  misc_feature (31)..(31): n stands for inosine
cucaucgccugaugaggccguuaggccgaanuccaucu

SEQ ID NO: 12244 - RNA, 38 nt, Artificial Sequence
  Description of Artificial Sequence:  Enzymatic Nucleic Acid
  misc_feature (31)..(31): n stands for inosine
ccagaaaacugaugaggccguuaggccgaanuccccuc

SEQ ID NO: 12245 - RNA, 38 nt, Artificial Sequence
  Description of Artificial Sequence:  Enzymatic Nucleic Acid
  misc_feature (31)..(31): n stands for inosine
cagaaucccugaugaggccguuaggccgaanaaaaugu

SEQ ID NO: 12246 - RNA, 38 nt, Artificial Sequence
  Description of Artificial Sequence:  Enzymatic Nucleic Acid
  misc_feature (31)..(31): n stands for inosine
ugccuccccugaugaggccguuaggccgaanaauccag

SEQ ID NO: 12247 - RNA, 38 nt, Artificial Sequence
  Description of Artificial Sequence:  Enzymatic Nucleic Acid
  misc_feature (31)..(31): n stands for inosine
ccuuuucucugaugaggccguuaggccgaanccuccca

SEQ ID NO: 12248 - RNA, 38 nt, Artificial Sequence
  Description of Artificial Sequence:  Enzymatic Nucleic Acid
  misc_feature (31)..(31): n stands for inosine
aagauauucugaugaggccguuaggccgaanuccuuuu

SEQ ID NO: 12249 - RNA, 38 nt, Artificial Sequence
  Description of Artificial Sequence:  Enzymatic Nucleic Acid
  misc_feature (31)..(31): n stands for inosine
uccaaaaacugaugaggccguuaggccgaanauauuug

SEQ ID NO: 12250 - RNA, 38 nt, Artificial Sequence
  Description of Artificial Sequence:  Enzymatic Nucleic Acid
  misc_feature (31)..(31): n stands for inosine
uuugcuuucugaugaggccguuaggccgaanuuccaaa

SEQ ID NO: 12251 - RNA, 38 nt, Artificial Sequence
  Description of Artificial Sequence:  Enzymatic Nucleic Acid
  misc_feature (31)..(31): n stands for inosine
cuaaaauucugaugaggccguuaggccgaancuuuagu

SEQ ID NO: 12252 - RNA, 38 nt, Artificial Sequence
  Description of Artificial Sequence:  Enzymatic Nucleic Acid
  misc_feature (31)..(31): n stands for inosine
uagguaaacugaugaggccguuaggccgaanucuaaaa

SEQ ID NO: 12253 - RNA, 38 nt, Artificial Sequence
  Description of Artificial Sequence:  Enzymatic Nucleic Acid
  misc_feature (31)..(31): n stands for inosine
auagguaacugaugaggccguuaggccgaangucuaaa

SEQ ID NO: 12254 - RNA, 38 nt, Artificial Sequence
  Description of Artificial Sequence:  Enzymatic Nucleic Acid
  misc_feature (31)..(31): n stands for inosine
cuuccauacugaugaggccguuaggccgaanuaaaggu

SEQ ID NO: 12255 - RNA, 38 nt, Artificial Sequence
  Description of Artificial Sequence:  Enzymatic Nucleic Acid
  misc_feature (31)..(31): n stands for inosine
acuuccaucugaugaggccguuaggccgaanguaaagg

SEQ ID NO: 12256 - RNA, 38 nt, Artificial Sequence
  Description of Artificial Sequence:  Enzymatic Nucleic Acid
  misc_feature (31)..(31): n stands for inosine
auggacaucugaugaggccguuaggccgaanaaccacu

SEQ ID NO: 12257 - RNA, 38 nt, Artificial Sequence
  Description of Artificial Sequence:  Enzymatic Nucleic Acid
  misc_feature (31)..(31): n stands for inosine
augagaaucugaugaggccguuaggccgaanacauaga

SEQ ID NO: 12258 - RNA, 38 nt, Artificial Sequence
  Description of Artificial Sequence:  Enzymatic Nucleic Acid
  misc_feature (31)..(31): n stands for inosine
aaugagaacugaugaggccguuaggccgaangacauag

SEQ ID NO: 12259 - RNA, 38 nt, Artificial Sequence
  Description of Artificial Sequence:  Enzymatic Nucleic Acid
  misc_feature (31)..(31): n stands for inosine
cacgaaugcugaugaggccguuaggccgaanaauggac

SEQ ID NO: 12260 - RNA, 38 nt, Artificial Sequence
  Description of Artificial Sequence:  Enzymatic Nucleic Acid
  misc_feature (31)..(31): n stands for inosine
gccacgaacugaugaggccguuaggccgaanagaaugg

SEQ ID NO: 12261 - RNA, 38 nt, Artificial Sequence
  Description of Artificial Sequence:  Enzymatic Nucleic Acid
  misc_feature (31)..(31): n stands for inosine
ucaaaacacugaugaggccguuaggccgaanccacgaa

SEQ ID NO: 12262 - RNA, 38 nt, Artificial Sequence
  Description of Artificial Sequence:  Enzymatic Nucleic Acid
  misc_feature (31)..(31): n stands for inosine
acccucagcugaugaggccguuaggccgaancuacaaa

SEQ ID NO: 12263 - RNA, 38 nt, Artificial Sequence
  Description of Artificial Sequence:  Enzymatic Nucleic Acid
  misc_feature (31)..(31): n stands for inosine
ccacccuccugaugaggccguuaggccgaanugcuaca

SEQ ID NO: 12264 - RNA, 38 nt, Artificial Sequence
  Description of Artificial Sequence:  Enzymatic Nucleic Acid
  misc_feature (31)..(31): n stands for inosine
gaguugagcugaugaggccguuaggccgaanccacccu

SEQ ID NO: 12265 - RNA, 38 nt, Artificial Sequence
  Description of Artificial Sequence:  Enzymatic Nucleic Acid
  misc_feature (31)..(31): n stands for inosine
cagaguugcugaugaggccguuaggccgaanugccacc

SEQ ID NO: 12266 - RNA, 38 nt, Artificial Sequence
  Description of Artificial Sequence:  Enzymatic Nucleic Acid
  misc_feature (31)..(31): n stands for inosine
cucagagucugaugaggccguuaggccgaanagugcca

SEQ ID NO: 12267 - RNA, 38 nt, Artificial Sequence
  Description of Artificial Sequence:  Enzymatic Nucleic Acid
  misc_feature (31)..(31): n stands for inosine
gggcucagcugaugaggccguuaggccgaanuugagug

SEQ ID NO: 12268 - RNA, 38 nt, Artificial Sequence
  Description of Artificial Sequence:  Enzymatic Nucleic Acid
  misc_feature (31)..(31): n stands for inosine
augggcuccugaugaggccguuaggccgaanaguugag

SEQ ID NO: 12269 - RNA, 38 nt, Artificial Sequence
  Description of Artificial Sequence:  Enzymatic Nucleic Acid
  misc_feature (31)..(31): n stands for inosine
aaaguaugcugaugaggccguuaggccgaancucagag

SEQ ID NO: 12270 - RNA, 38 nt, Artificial Sequence
  Description of Artificial Sequence:  Enzymatic Nucleic Acid
  misc_feature (31)..(31): n stands for inosine
aaaaguaucugaugaggccguuaggccgaangcucaga

SEQ ID NO: 12271 - RNA, 38 nt, Artificial Sequence
  Description of Artificial Sequence:  Enzymatic Nucleic Acid
  misc_feature (31)..(31): n stands for inosine
caaaaguacugaugaggccguuaggccgaanggcucag

SEQ ID NO: 12272 - RNA, 38 nt, Artificial Sequence
  Description of Artificial Sequence:  Enzymatic Nucleic Acid
  misc_feature (31)..(31): n stands for inosine
gagccaaacugaugaggccguuaggccgaanuaugggc

SEQ ID NO: 12273 - RNA, 38 nt, Artificial Sequence
  Description of Artificial Sequence:  Enzymatic Nucleic Acid
  misc_feature (31)..(31): n stands for inosine
acuagaggcugaugaggccguuaggccgaanccaaaag

SEQ ID NO: 12274 - RNA, 38 nt, Artificial Sequence
  Description of Artificial Sequence:  Enzymatic Nucleic Acid
  misc_feature (31)..(31): n stands for inosine
uuacuagacugaugaggccguuaggccgaanagccaaa

SEQ ID NO: 12275 - RNA, 38 nt, Artificial Sequence
  Description of Artificial Sequence:  Enzymatic Nucleic Acid
  misc_feature (31)..(31): n stands for inosine
cuuacuagcugaugaggccguuaggccgaangagccaa

SEQ ID NO: 12276 - RNA, 38 nt, Artificial Sequence
  Description of Artificial Sequence:  Enzymatic Nucleic Acid
  misc_feature (31)..(31): n stands for inosine
aucuuacucugaugaggccguuaggccgaanaggagcc

SEQ ID NO: 12277 - RNA, 38 nt, Artificial Sequence
  Description of Artificial Sequence:  Enzymatic Nucleic Acid
  misc_feature (31)..(31): n stands for inosine
guuuucagcugaugaggccguuaggccgaancaucuua

SEQ ID NO: 12278 - RNA, 38 nt, Artificial Sequence
  Description of Artificial Sequence:  Enzymatic Nucleic Acid
  misc_feature (31)..(31): n stands for inosine
aaguuuuccugaugaggccguuaggccgaanugcaucu

SEQ ID NO: 12279 - RNA, 38 nt, Artificial Sequence
  Description of Artificial Sequence:  Enzymatic Nucleic Acid
  misc_feature (31)..(31): n stands for inosine
ucuggcuacugaugaggccguuaggccgaanuuuucag

SEQ ID NO: 12280 - RNA, 38 nt, Artificial Sequence
  Description of Artificial Sequence:  Enzymatic Nucleic Acid
  misc_feature (31)..(31): n stands for inosine
cuaacucucugaugaggccguuaggccgaancuaaguu

SEQ ID NO: 12281 - RNA, 38 nt, Artificial Sequence
  Description of Artificial Sequence:  Enzymatic Nucleic Acid
  misc_feature (31)..(31): n stands for inosine
ccuaacuccugaugaggccguuaggccgaangcuaagu

SEQ ID NO: 12282 - RNA, 38 nt, Artificial Sequence
  Description of Artificial Sequence:  Enzymatic Nucleic Acid
  misc_feature (31)..(31): n stands for inosine
uggccuggcugaugaggccguuaggccgaanacaaccu

SEQ ID NO: 12283 - RNA, 38 nt, Artificial Sequence
  Description of Artificial Sequence:  Enzymatic Nucleic Acid
  misc_feature (31)..(31): n stands for inosine
cauggccucugaugaggccguuaggccgaanagacaac

SEQ ID NO: 12284 - RNA, 38 nt, Artificial Sequence
  Description of Artificial Sequence:  Enzymatic Nucleic Acid
  misc_feature (31)..(31): n stands for inosine
ucauggcccugaugaggccguuaggccgaangagacaa

SEQ ID NO: 12285 - RNA, 38 nt, Artificial Sequence
  Description of Artificial Sequence:  Enzymatic Nucleic Acid
  misc_feature (31)..(31): n stands for inosine
gccaucaucugaugaggccguuaggccgaanccuggag

SEQ ID NO: 12286 - RNA, 38 nt, Artificial Sequence
  Description of Artificial Sequence:  Enzymatic Nucleic Acid
  misc_feature (31)..(31): n stands for inosine
ggccaucacugaugaggccguuaggccgaangccugga

SEQ ID NO: 12287 - RNA, 38 nt, Artificial Sequence
  Description of Artificial Sequence:  Enzymatic Nucleic Acid
  misc_feature (31)..(31): n stands for inosine
caguguaacugaugaggccguuaggccgaanccaucau

SEQ ID NO: 12288 - RNA, 38 nt, Artificial Sequence
  Description of Artificial Sequence:  Enzymatic Nucleic Acid
  misc_feature (31)..(31): n stands for inosine
ucaguguacugaugaggccguuaggccgaangccauca

SEQ ID NO: 12289 - RNA, 38 nt, Artificial Sequence
  Description of Artificial Sequence:  Enzymatic Nucleic Acid
  misc_feature (31)..(31): n stands for inosine
auuuucagcugaugaggccguuaggccgaanuaaggcc

SEQ ID NO: 12290 - RNA, 38 nt, Artificial Sequence
  Description of Artificial Sequence:  Enzymatic Nucleic Acid
  misc_feature (31)..(31): n stands for inosine
acauuuuccugaugaggccguuaggccgaanuguaagg

SEQ ID NO: 12291 - RNA, 38 nt, Artificial Sequence
  Description of Artificial Sequence:  Enzymatic Nucleic Acid
  misc_feature (31)..(31): n stands for inosine
auagaaugcugaugaggccguuaggccgaanacauuuu

SEQ ID NO: 12292 - RNA, 38 nt, Artificial Sequence
  Description of Artificial Sequence:  Enzymatic Nucleic Acid
  misc_feature (31)..(31): n stands for inosine
aaauagaacugaugaggccguuaggccgaanugacauu

SEQ ID NO: 12293 - RNA, 38 nt, Artificial Sequence
  Description of Artificial Sequence:  Enzymatic Nucleic Acid
  misc_feature (31)..(31): n stands for inosine
cccaaaaucugaugaggccguuaggccgaanaauguga

SEQ ID NO: 12294 - RNA, 38 nt, Artificial Sequence
  Description of Artificial Sequence:  Enzymatic Nucleic Acid
  misc_feature (31)..(31): n stands for inosine
aagugucucugaugaggccguuaggccgaanacuauau

SEQ ID NO: 12295 - RNA, 38 nt, Artificial Sequence
  Description of Artificial Sequence:  Enzymatic Nucleic Acid
  misc_feature (31)..(31): n stands for inosine
uaaguguccugaugaggccguuaggccgaangacuaua

SEQ ID NO: 12296 - RNA, 38 nt, Artificial Sequence
  Description of Artificial Sequence:  Enzymatic Nucleic Acid
  misc_feature (31)..(31): n stands for inosine
gaguuaagcugaugaggccguuaggccgaanucuggac

SEQ ID NO: 12297 - RNA, 38 nt, Artificial Sequence
  Description of Artificial Sequence:  Enzymatic Nucleic Acid
  misc_feature (31)..(31): n stands for inosine
uugaguuacugaugaggccguuaggccgaanugucugg

SEQ ID NO: 12298 - RNA, 38 nt, Artificial Sequence
  Description of Artificial Sequence:  Enzymatic Nucleic Acid
  misc_feature (31)..(31): n stands for inosine
agaaauugcugaugaggccguuaggccgaanuuaagug

SEQ ID NO: 12299 - RNA, 38 nt, Artificial Sequence
  Description of Artificial Sequence:  Enzymatic Nucleic Acid
  misc_feature (31)..(31): n stands for inosine
caagaaaucugaugaggccguuaggccgaanaguuaag

SEQ ID NO: 12300 - RNA, 38 nt, Artificial Sequence
  Description of Artificial Sequence:  Enzymatic Nucleic Acid
  misc_feature (31)..(31): n stands for inosine
uaauaccacugaugaggccguuaggccgaanaaauuga

SEQ ID NO: 12301 - RNA, 38 nt, Artificial Sequence
  Description of Artificial Sequence:  Enzymatic Nucleic Acid
  misc_feature (31)..(31): n stands for inosine
ugcaaaaccugaugaggccguuaggccgaanaauaaua

SEQ ID NO: 12302 - RNA, 38 nt, Artificial Sequence
  Description of Artificial Sequence:  Enzymatic Nucleic Acid
  misc_feature (31)..(31): n stands for inosine
acuaacugcugaugaggccguuaggccgaancaaaaca

SEQ ID NO: 12303 - RNA, 38 nt, Artificial Sequence
  Description of Artificial Sequence:  Enzymatic Nucleic Acid
  misc_feature (31)..(31): n stands for inosine
caacuaaccugaugaggccguuaggccgaanugcaaaa

SEQ ID NO: 12304 - RNA, 38 nt, Artificial Sequence
  Description of Artificial Sequence:  Enzymatic Nucleic Acid
  misc_feature (31)..(31): n stands for inosine
uucuucuccugaugaggccguuaggccgaancuuucuu

SEQ ID NO: 12305 - RNA, 38 nt, Artificial Sequence
  Description of Artificial Sequence:  Enzymatic Nucleic Acid
  misc_feature (31)..(31): n stands for inosine
cucaggaccugaugaggccguuaggccgaancauuuuc

SEQ ID NO: 12306 - RNA, 38 nt, Artificial Sequence
  Description of Artificial Sequence:  Enzymatic Nucleic Acid
  misc_feature (31)..(31): n stands for inosine
ucuccucacugaugaggccguuaggccgaanacugcau

SEQ ID NO: 12307 - RNA, 38 nt, Artificial Sequence
  Description of Artificial Sequence:  Enzymatic Nucleic Acid
  misc_feature (31)..(31): n stands for inosine
cucuccuccugaugaggccguuaggccgaangacugca

SEQ ID NO: 12308 - RNA, 38 nt, Artificial Sequence
  Description of Artificial Sequence:  Enzymatic Nucleic Acid
  misc_feature (31)..(31): n stands for inosine
ugauauggcugaugaggccguuaggccgaanaaaacuc

SEQ ID NO: 12309 - RNA, 38 nt, Artificial Sequence
  Description of Artificial Sequence:  Enzymatic Nucleic Acid
  misc_feature (31)..(31): n stands for inosine
uuugauaucugaugaggccguuaggccgaanagaaaac

SEQ ID NO: 12310 - RNA, 38 nt, Artificial Sequence
  Description of Artificial Sequence:  Enzymatic Nucleic Acid
  misc_feature (31)..(31): n stands for inosine
uuuugauacugaugaggccguuaggccgaangagaaaa

SEQ ID NO: 12311 - RNA, 38 nt, Artificial Sequence
  Description of Artificial Sequence:  Enzymatic Nucleic Acid
  misc_feature (31)..(31): n stands for inosine
ccucguuucugaugaggccguuaggccgaanauaugga

SEQ ID NO: 12312 - RNA, 38 nt, Artificial Sequence
  Description of Artificial Sequence:  Enzymatic Nucleic Acid
  misc_feature (31)..(31): n stands for inosine
ccuccauccugaugaggccguuaggccgaancccucgu

SEQ ID NO: 12313 - RNA, 38 nt, Artificial Sequence
  Description of Artificial Sequence:  Enzymatic Nucleic Acid
  misc_feature (31)..(31): n stands for inosine
gaccuuaucugaugaggccguuaggccgaanaccuuuu

SEQ ID NO: 12314 - RNA, 38 nt, Artificial Sequence
  Description of Artificial Sequence:  Enzymatic Nucleic Acid
  misc_feature (31)..(31): n stands for inosine
ucuucccucugaugaggccguuaggccgaanaccuuau

SEQ ID NO: 12315 - RNA, 38 nt, Artificial Sequence
  Description of Artificial Sequence:  Enzymatic Nucleic Acid
  misc_feature (31)..(31): n stands for inosine
agagacggcugaugaggccguuaggccgaanucuuccc

SEQ ID NO: 12316 - RNA, 38 nt, Artificial Sequence
  Description of Artificial Sequence:  Enzymatic Nucleic Acid
  misc_feature (31)..(31): n stands for inosine
uagagacgcugaugaggccguuaggccgaangucuucc

SEQ ID NO: 12317 - RNA, 38 nt, Artificial Sequence
  Description of Artificial Sequence:  Enzymatic Nucleic Acid
  misc_feature (31)..(31): n stands for inosine
auagagaccugaugaggccguuaggccgaanggucuuc

SEQ ID NO: 12318 - RNA, 38 nt, Artificial Sequence
  Description of Artificial Sequence:  Enzymatic Nucleic Acid
  misc_feature (31)..(31): n stands for inosine
ugguauagcugaugaggccguuaggccgaanacggggu

SEQ ID NO: 12319 - RNA, 38 nt, Artificial Sequence
  Description of Artificial Sequence:  Enzymatic Nucleic Acid
  misc_feature (31)..(31): n stands for inosine
guugguaucugaugaggccguuaggccgaanagacggg

SEQ ID NO: 12320 - RNA, 38 nt, Artificial Sequence
  Description of Artificial Sequence:  Enzymatic Nucleic Acid
  misc_feature (31)..(31): n stands for inosine
guuugguucugaugaggccguuaggccgaanuauagag

SEQ ID NO: 12321 - RNA, 38 nt, Artificial Sequence
  Description of Artificial Sequence:  Enzymatic Nucleic Acid
  misc_feature (31)..(31): n stands for inosine
gguuuggucugaugaggccguuaggccgaanguauaga

SEQ ID NO: 12322 - RNA, 38 nt, Artificial Sequence
  Description of Artificial Sequence:  Enzymatic Nucleic Acid
  misc_feature (31)..(31): n stands for inosine
auugguuucugaugaggccguuaggccgaanuugguau

SEQ ID NO: 12323 - RNA, 38 nt, Artificial Sequence
  Description of Artificial Sequence:  Enzymatic Nucleic Acid
  misc_feature (31)..(31): n stands for inosine
aauugguucugaugaggccguuaggccgaanguuggua

SEQ ID NO: 12324 - RNA, 38 nt, Artificial Sequence
  Description of Artificial Sequence:  Enzymatic Nucleic Acid
  misc_feature (31)..(31): n stands for inosine
ggugaauucugaugaggccguuaggccgaanuuugguu

SEQ ID NO: 12325 - RNA, 38 nt, Artificial Sequence
  Description of Artificial Sequence:  Enzymatic Nucleic Acid
  misc_feature (31)..(31): n stands for inosine
uggugaaucugaugaggccguuaggccgaanguuuggu

SEQ ID NO: 12326 - RNA, 38 nt, Artificial Sequence
  Description of Artificial Sequence:  Enzymatic Nucleic Acid
  misc_feature (31)..(31): n stands for inosine
uguguuggcugaugaggccguuaggccgaanaauuggu

SEQ ID NO: 12327 - RNA, 38 nt, Artificial Sequence
  Description of Artificial Sequence:  Enzymatic Nucleic Acid
  misc_feature (31)..(31): n stands for inosine
acuguguucugaugaggccguuaggccgaanugaauug

SEQ ID NO: 12328 - RNA, 38 nt, Artificial Sequence
  Description of Artificial Sequence:  Enzymatic Nucleic Acid
  misc_feature (31)..(31): n stands for inosine
aacugugucugaugaggccguuaggccgaangugaauu

SEQ ID NO: 12329 - RNA, 38 nt, Artificial Sequence
  Description of Artificial Sequence:  Enzymatic Nucleic Acid
  misc_feature (31)..(31): n stands for inosine
cccaacugcugaugaggccguuaggccgaanuugguga

SEQ ID NO: 12330 - RNA, 38 nt, Artificial Sequence
  Description of Artificial Sequence:  Enzymatic Nucleic Acid
  misc_feature (31)..(31): n stands for inosine
gucccaaccugaugaggccguuaggccgaanuguuggu

SEQ ID NO: 12331 - RNA, 38 nt, Artificial Sequence
  Description of Artificial Sequence:  Enzymatic Nucleic Acid
  misc_feature (31)..(31): n stands for inosine
guguuuugcugaugaggccguuaggccgaanucccaac

SEQ ID NO: 12332 - RNA, 38 nt, Artificial Sequence
  Description of Artificial Sequence:  Enzymatic Nucleic Acid
  misc_feature (31)..(31): n stands for inosine
uguguuuucugaugaggccguuaggccgaangucccaa

SEQ ID NO: 12333 - RNA, 38 nt, Artificial Sequence
  Description of Artificial Sequence:  Enzymatic Nucleic Acid
  misc_feature (31)..(31): n stands for inosine
cuguguuucugaugaggccguuaggccgaangguccca

SEQ ID NO: 12334 - RNA, 38 nt, Artificial Sequence
  Description of Artificial Sequence:  Enzymatic Nucleic Acid
  misc_feature (31)..(31): n stands for inosine
acuuccugcugaugaggccguuaggccgaanuuuuggg

SEQ ID NO: 12335 - RNA, 38 nt, Artificial Sequence
  Description of Artificial Sequence:  Enzymatic Nucleic Acid
  misc_feature (31)..(31): n stands for inosine
ugacuucccugaugaggccguuaggccgaanuguuuug

SEQ ID NO: 12336 - RNA, 38 nt, Artificial Sequence
  Description of Artificial Sequence:  Enzymatic Nucleic Acid
  misc_feature (31)..(31): n stands for inosine
aacgugaccugaugaggccguuaggccgaanacuuccu

SEQ ID NO: 12337 - RNA, 38 nt, Artificial Sequence
  Description of Artificial Sequence:  Enzymatic Nucleic Acid
  misc_feature (31)..(31): n stands for inosine
aggaaacgcugaugaggccguuaggccgaanacugacu

SEQ ID NO: 12338 - RNA, 38 nt, Artificial Sequence
  Description of Artificial Sequence:  Enzymatic Nucleic Acid
  misc_feature (31)..(31): n stands for inosine
aaugaaaacugaugaggccguuaggccgaanaaacgug

SEQ ID NO: 12339 - RNA, 38 nt, Artificial Sequence
  Description of Artificial Sequence:  Enzymatic Nucleic Acid
  misc_feature (31)..(31): n stands for inosine
aaaugaaacugaugaggccguuaggccgaangaaacgu

SEQ ID NO: 12340 - RNA, 38 nt, Artificial Sequence
  Description of Artificial Sequence:  Enzymatic Nucleic Acid
  misc_feature (31)..(31): n stands for inosine
ccauuaaacugaugaggccguuaggccgaanaaaagga

SEQ ID NO: 12341 - RNA, 38 nt, Artificial Sequence
  Description of Artificial Sequence:  Enzymatic Nucleic Acid
  misc_feature (31)..(31): n stands for inosine
gagauagucugaugaggccguuaggccgaanaaucccc

SEQ ID NO: 12342 - RNA, 38 nt, Artificial Sequence
  Description of Artificial Sequence:  Enzymatic Nucleic Acid
  misc_feature (31)..(31): n stands for inosine
ugagauagcugaugaggccguuaggccgaangaauccc

SEQ ID NO: 12343 - RNA, 38 nt, Artificial Sequence
  Description of Artificial Sequence:  Enzymatic Nucleic Acid
  misc_feature (31)..(31): n stands for inosine
ugugagaucugaugaggccguuaggccgaanuggaauc

SEQ ID NO: 12344 - RNA, 38 nt, Artificial Sequence
  Description of Artificial Sequence:  Enzymatic Nucleic Acid
  misc_feature (31)..(31): n stands for inosine
uuagugugcugaugaggccguuaggccgaanauagugg

SEQ ID NO: 12345 - RNA, 38 nt, Artificial Sequence
  Description of Artificial Sequence:  Enzymatic Nucleic Acid
  misc_feature (31)..(31): n stands for inosine
gauuagugcugaugaggccguuaggccgaanagauagu

SEQ ID NO: 12346 - RNA, 38 nt, Artificial Sequence
  Description of Artificial Sequence:  Enzymatic Nucleic Acid
  misc_feature (31)..(31): n stands for inosine
cagauuagcugaugaggccguuaggccgaanugagaua

SEQ ID NO: 12347 - RNA, 38 nt, Artificial Sequence
  Description of Artificial Sequence:  Enzymatic Nucleic Acid
  misc_feature (31)..(31): n stands for inosine
uucagauucugaugaggccguuaggccgaanugugaga

SEQ ID NO: 12348 - RNA, 38 nt, Artificial Sequence
  Description of Artificial Sequence:  Enzymatic Nucleic Acid
  misc_feature (31)..(31): n stands for inosine
auccuuuccugaugaggccguuaggccgaanauuagug

SEQ ID NO: 12349 - RNA, 38 nt, Artificial Sequence
  Description of Artificial Sequence:  Enzymatic Nucleic Acid
  misc_feature (31)..(31): n stands for inosine
ccagcuaacugaugaggccguuaggccgaancucuucc

SEQ ID NO: 12350 - RNA, 38 nt, Artificial Sequence
  Description of Artificial Sequence:  Enzymatic Nucleic Acid
  misc_feature (31)..(31): n stands for inosine
uaugcgcccugaugaggccguuaggccgaancuaaugc

SEQ ID NO: 12351 - RNA, 38 nt, Artificial Sequence
  Description of Artificial Sequence:  Enzymatic Nucleic Acid
  misc_feature (31)..(31): n stands for inosine
gcuuaauacugaugaggccguuaggccgaancgccagc

SEQ ID NO: 12352 - RNA, 38 nt, Artificial Sequence
  Description of Artificial Sequence:  Enzymatic Nucleic Acid
  misc_feature (31)..(31): n stands for inosine
gcuuaaagcugaugaggccguuaggccgaancuuaaua

SEQ ID NO: 12353 - RNA, 38 nt, Artificial Sequence
  Description of Artificial Sequence:  Enzymatic Nucleic Acid
  misc_feature (31)..(31): n stands for inosine
gagcuuaacugaugaggccguuaggccgaanugcuuaa

SEQ ID NO: 12354 - RNA, 38 nt, Artificial Sequence
  Description of Artificial Sequence:  Enzymatic Nucleic Acid
  misc_feature (31)..(31): n stands for inosine
acucaaggcugaugaggccguuaggccgaancuuaaag

SEQ ID NO: 12355 - RNA, 38 nt, Artificial Sequence
  Description of Artificial Sequence:  Enzymatic Nucleic Acid
  misc_feature (31)..(31): n stands for inosine
uuacucaacugaugaggccguuaggccgaanagcuuaa

SEQ ID NO: 12356 - RNA, 38 nt, Artificial Sequence
  Description of Artificial Sequence:  Enzymatic Nucleic Acid
  misc_feature (31)..(31): n stands for inosine
uuuacucacugaugaggccguuaggccgaangagcuua

SEQ ID NO: 12357 - RNA, 38 nt, Artificial Sequence
  Description of Artificial Sequence:  Enzymatic Nucleic Acid
  misc_feature (31)..(31): n stands for inosine
aaauaccucugaugaggccguuaggccgaancauaaau

SEQ ID NO: 12358 - RNA, 38 nt, Artificial Sequence
  Description of Artificial Sequence:  Enzymatic Nucleic Acid
  misc_feature (31)..(31): n stands for inosine
ccaacuggcugaugaggccguuaggccgaanaaauacc

SEQ ID NO: 12359 - RNA, 38 nt, Artificial Sequence
  Description of Artificial Sequence:  Enzymatic Nucleic Acid
  misc_feature (31)..(31): n stands for inosine
ucccaacucugaugaggccguuaggccgaanagaaaua

SEQ ID NO: 12360 - RNA, 38 nt, Artificial Sequence
  Description of Artificial Sequence:  Enzymatic Nucleic Acid
  misc_feature (31)..(31): n stands for inosine
gucccaaccugaugaggccguuaggccgaangagaaau

SEQ ID NO: 12361 - RNA, 38 nt, Artificial Sequence
  Description of Artificial Sequence:  Enzymatic Nucleic Acid
  misc_feature (31)..(31): n stands for inosine
auauccugcugaugaggccguuaggccgaanucccaac

SEQ ID NO: 12362 - RNA, 38 nt, Artificial Sequence
  Description of Artificial Sequence:  Enzymatic Nucleic Acid
  misc_feature (31)..(31): n stands for inosine
uaauaucccugaugaggccguuaggccgaanaguccca

SEQ ID NO: 12363 - RNA, 38 nt, Artificial Sequence
  Description of Artificial Sequence:  Enzymatic Nucleic Acid
  misc_feature (31)..(31): n stands for inosine
cuagugaucugaugaggccguuaggccgaancucauua

SEQ ID NO: 12364 - RNA, 38 nt, Artificial Sequence
  Description of Artificial Sequence:  Enzymatic Nucleic Acid
  misc_feature (31)..(31): n stands for inosine
ucuagugacugaugaggccguuaggccgaangcucauu

SEQ ID NO: 12365 - RNA, 38 nt, Artificial Sequence
  Description of Artificial Sequence:  Enzymatic Nucleic Acid
  misc_feature (31)..(31): n stands for inosine
ucuucuagcugaugaggccguuaggccgaanauggcuc

SEQ ID NO: 12366 - RNA, 38 nt, Artificial Sequence
  Description of Artificial Sequence:  Enzymatic Nucleic Acid
  misc_feature (31)..(31): n stands for inosine
uuucuucucugaugaggccguuaggccgaanugauggc

SEQ ID NO: 12367 - RNA, 38 nt, Artificial Sequence
  Description of Artificial Sequence:  Enzymatic Nucleic Acid
  misc_feature (31)..(31): n stands for inosine
ugaaaaugcugaugaggccguuaggccgaancuuuucu

SEQ ID NO: 12368 - RNA, 38 nt, Artificial Sequence
  Description of Artificial Sequence:  Enzymatic Nucleic Acid
  misc_feature (31)..(31): n stands for inosine
uugaaaaucugaugaggccguuaggccgaangcuuuuc

SEQ ID NO: 12369 - RNA, 38 nt, Artificial Sequence
  Description of Artificial Sequence:  Enzymatic Nucleic Acid
  misc_feature (31)..(31): n stands for inosine
guugaaaacugaugaggccguuaggccgaanggcuuuu

SEQ ID NO: 12370 - RNA, 38 nt, Artificial Sequence
  Description of Artificial Sequence:  Enzymatic Nucleic Acid
  misc_feature (31)..(31): n stands for inosine
aaagcagucugaugaggccguuaggccgaanaaaaugg

SEQ ID NO: 12371 - RNA, 38 nt, Artificial Sequence
  Description of Artificial Sequence:  Enzymatic Nucleic Acid
  misc_feature (31)..(31): n stands for inosine
uucaaagccugaugaggccguuaggccgaanuugaaaa

SEQ ID NO: 12372 - RNA, 38 nt, Artificial Sequence
  Description of Artificial Sequence:  Enzymatic Nucleic Acid
  misc_feature (31)..(31): n stands for inosine
aguuucaacugaugaggccguuaggccgaancaguuga

SEQ ID NO: 12373 - RNA, 38 nt, Artificial Sequence
  Description of Artificial Sequence:  Enzymatic Nucleic Acid
  misc_feature (31)..(31): n stands for inosine
cccaggcacugaugaggccguuaggccgaanuuucaaa

SEQ ID NO: 12374 - RNA, 38 nt, Artificial Sequence
  Description of Artificial Sequence:  Enzymatic Nucleic Acid
  misc_feature (31)..(31): n stands for inosine
agaccccacugaugaggccguuaggccgaancaaguuu

SEQ ID NO: 12375 - RNA, 38 nt, Artificial Sequence
  Description of Artificial Sequence:  Enzymatic Nucleic Acid
  misc_feature (31)..(31): n stands for inosine
cagacccccugaugaggccguuaggccgaangcaaguu

SEQ ID NO: 12376 - RNA, 38 nt, Artificial Sequence
  Description of Artificial Sequence:  Enzymatic Nucleic Acid
  misc_feature (31)..(31): n stands for inosine
ucaugcuccugaugaggccguuaggccgaanaccccag

SEQ ID NO: 12377 - RNA, 38 nt, Artificial Sequence
  Description of Artificial Sequence:  Enzymatic Nucleic Acid
  misc_feature (31)..(31): n stands for inosine
ucccaucacugaugaggccguuaggccgaancucagac

SEQ ID NO: 12378 - RNA, 38 nt, Artificial Sequence
  Description of Artificial Sequence:  Enzymatic Nucleic Acid
  misc_feature (31)..(31): n stands for inosine
uccuaccccugaugaggccguuaggccgaanucucccu

SEQ ID NO: 12379 - RNA, 38 nt, Artificial Sequence
  Description of Artificial Sequence:  Enzymatic Nucleic Acid
  misc_feature (31)..(31): n stands for inosine
gaagaguacugaugaggccguuaggccgaancgcccuu

SEQ ID NO: 12380 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaangcgcccu

SEQ ID NO: 12381 - RNA, 38 nt, Artificial Sequence
  Description of Artificial Sequence:  Enzymatic Nucleic Acid
  misc_feature (31)..(31): n stands for inosine
cccugaagcugaugaggccguuaggccgaanuaggcgc

SEQ ID NO: 12382 - RNA, 38 nt, Artificial Sequence
  Description of Artificial Sequence:  Enzymatic Nucleic Acid
  misc_feature (31)..(31): n stands for inosine
gacccugacugaugaggccguuaggccgaanaguaggc

SEQ ID NO: 12383 - RNA, 38 nt, Artificial Sequence
  Description of Artificial Sequence:  Enzymatic Nucleic Acid
  misc_feature (31)..(31): n stands for inosine
uuagaccccugaugaggccguuaggccgaanaagagua

SEQ ID NO: 12384 - RNA, 38 nt, Artificial Sequence
  Description of Artificial Sequence:  Enzymatic Nucleic Acid
  misc_feature (31)..(31): n stands for inosine
ugaucuuucugaugaggccguuaggccgaanacccuga

SEQ ID NO: 12385 - RNA, 38 nt, Artificial Sequence
  Description of Artificial Sequence:  Enzymatic Nucleic Acid
  misc_feature (31)..(31): n stands for inosine
ggcccacucugaugaggccguuaggccgaanaucuuua

SEQ ID NO: 12386 - RNA, 38 nt, Artificial Sequence
  Description of Artificial Sequence:  Enzymatic Nucleic Acid
  misc_feature (31)..(31): n stands for inosine
cgauccaacugaugaggccguuaggccgaancccacuu

SEQ ID NO: 12387 - RNA, 38 nt, Artificial Sequence
  Description of Artificial Sequence:  Enzymatic Nucleic Acid
  misc_feature (31)..(31): n stands for inosine
gcgauccacugaugaggccguuaggccgaangcccacu

SEQ ID NO: 12388 - RNA, 38 nt, Artificial Sequence
  Description of Artificial Sequence:  Enzymatic Nucleic Acid
  misc_feature (31)..(31): n stands for inosine
gccagcuucugaugaggccguuaggccgaancgaucca

SEQ ID NO: 12389 - RNA, 38 nt, Artificial Sequence
  Description of Artificial Sequence:  Enzymatic Nucleic Acid
  misc_feature (31)..(31): n stands for inosine
acagagcccugaugaggccguuaggccgaancuuagcg

SEQ ID NO: 12390 - RNA, 38 nt, Artificial Sequence
  Description of Artificial Sequence:  Enzymatic Nucleic Acid
  misc_feature (31)..(31): n stands for inosine
ucaaacagcugaugaggccguuaggccgaanccagcuu

SEQ ID NO: 12391 - RNA, 38 nt, Artificial Sequence
  Description of Artificial Sequence:  Enzymatic Nucleic Acid
  misc_feature (31)..(31): n stands for inosine
caucaaaccugaugaggccguuaggccgaanagccagc

SEQ ID NO: 12392 - RNA, 38 nt, Artificial Sequence
  Description of Artificial Sequence:  Enzymatic Nucleic Acid
  misc_feature (31)..(31): n stands for inosine
gcauaaaucugaugaggccguuaggccgaancaucaaa

SEQ ID NO: 12393 - RNA, 38 nt, Artificial Sequence
  Description of Artificial Sequence:  Enzymatic Nucleic Acid
  misc_feature (31)..(31): n stands for inosine
cccuaacucugaugaggccguuaggccgaancauaaau

SEQ ID NO: 12394 - RNA, 38 nt, Artificial Sequence
  Description of Artificial Sequence:  Enzymatic Nucleic Acid
  misc_feature (31)..(31): n stands for inosine
aaauacaucugaugaggccguuaggccgaanacccuaa

SEQ ID NO: 12395 - RNA, 38 nt, Artificial Sequence
  Description of Artificial Sequence:  Enzymatic Nucleic Acid
  misc_feature (31)..(31): n stands for inosine
gaagaguacugaugaggccguuaggccgaancgcaucc

SEQ ID NO: 12396 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaangcgcauc

SEQ ID NO: 12397 - RNA, 38 nt, Artificial Sequence
  Description of Artificial Sequence:  Enzymatic Nucleic Acid
  misc_feature (31)..(31): n stands for inosine
gaaggugccugaugaggccguuaggccgaanacauccu

SEQ ID NO: 12398 - RNA, 38 nt, Artificial Sequence
  Description of Artificial Sequence:  Enzymatic Nucleic Acid
  misc_feature (31)..(31): n stands for inosine
gcagaaggcugaugaggccguuaggccgaancagacau

SEQ ID NO: 12399 - RNA, 38 nt, Artificial Sequence
  Description of Artificial Sequence:  Enzymatic Nucleic Acid
  misc_feature (31)..(31): n stands for inosine
cugcagaacugaugaggccguuaggccgaanugcagac

SEQ ID NO: 12400 - RNA, 38 nt, Artificial Sequence
  Description of Artificial Sequence:  Enzymatic Nucleic Acid
  misc_feature (31)..(31): n stands for inosine
gcugcagacugaugaggccguuaggccgaangugcaga

SEQ ID NO: 12401 - RNA, 38 nt, Artificial Sequence
  Description of Artificial Sequence:  Enzymatic Nucleic Acid
  misc_feature (31)..(31): n stands for inosine
cuggcugccugaugaggccguuaggccgaanaaggugc

SEQ ID NO: 12402 - RNA, 38 nt, Artificial Sequence
  Description of Artificial Sequence:  Enzymatic Nucleic Acid
  misc_feature (31)..(31): n stands for inosine
ugacuggccugaugaggccguuaggccgaancagaagg

SEQ ID NO: 12403 - RNA, 38 nt, Artificial Sequence
  Description of Artificial Sequence:  Enzymatic Nucleic Acid
  misc_feature (31)..(31): n stands for inosine
uucugacucugaugaggccguuaggccgaancugcaga

SEQ ID NO: 12404 - RNA, 38 nt, Artificial Sequence
  Description of Artificial Sequence:  Enzymatic Nucleic Acid
  misc_feature (31)..(31): n stands for inosine
cuucugaccugaugaggccguuaggccgaangcugcag

SEQ ID NO: 12405 - RNA, 38 nt, Artificial Sequence
  Description of Artificial Sequence:  Enzymatic Nucleic Acid
  misc_feature (31)..(31): n stands for inosine
ccagcuuccugaugaggccguuaggccgaanacuggcu

SEQ ID NO: 12406 - RNA, 38 nt, Artificial Sequence
  Description of Artificial Sequence:  Enzymatic Nucleic Acid
  misc_feature (31)..(31): n stands for inosine
gccucucccugaugaggccguuaggccgaancuucuga

SEQ ID NO: 12407 - RNA, 38 nt, Artificial Sequence
  Description of Artificial Sequence:  Enzymatic Nucleic Acid
  misc_feature (31)..(31): n stands for inosine
uccacugucugaugaggccguuaggccgaanccucucc

SEQ ID NO: 12408 - RNA, 38 nt, Artificial Sequence
  Description of Artificial Sequence:  Enzymatic Nucleic Acid
  misc_feature (31)..(31): n stands for inosine
caauccaccugaugaggccguuaggccgaanuugccuc

SEQ ID NO: 12409 - RNA, 38 nt, Artificial Sequence
  Description of Artificial Sequence:  Enzymatic Nucleic Acid
  misc_feature (31)..(31): n stands for inosine
caagaagccugaugaggccguuaggccgaancaaucca

SEQ ID NO: 12410 - RNA, 38 nt, Artificial Sequence
  Description of Artificial Sequence:  Enzymatic Nucleic Acid
  misc_feature (31)..(31): n stands for inosine
ccccaagacugaugaggccguuaggccgaancagcaau

SEQ ID NO: 12411 - RNA, 38 nt, Artificial Sequence
  Description of Artificial Sequence:  Enzymatic Nucleic Acid
  misc_feature (31)..(31): n stands for inosine
ucuccccacugaugaggccguuaggccgaanaagcagc

SEQ ID NO: 12412 - RNA, 38 nt, Artificial Sequence
  Description of Artificial Sequence:  Enzymatic Nucleic Acid
  misc_feature (31)..(31): n stands for inosine
uaaaaggacugaugaggccguuaggccgaancauacuc

SEQ ID NO: 12413 - RNA, 38 nt, Artificial Sequence
  Description of Artificial Sequence:  Enzymatic Nucleic Acid
  misc_feature (31)..(31): n stands for inosine
ggauaaaacugaugaggccguuaggccgaanaagcaua

SEQ ID NO: 12414 - RNA, 38 nt, Artificial Sequence
  Description of Artificial Sequence:  Enzymatic Nucleic Acid
  misc_feature (31)..(31): n stands for inosine
uggauaaacugaugaggccguuaggccgaangaagcau

SEQ ID NO: 12415 - RNA, 38 nt, Artificial Sequence
  Description of Artificial Sequence:  Enzymatic Nucleic Acid
  misc_feature (31)..(31): n stands for inosine
aauuacaucugaugaggccguuaggccgaanauaaaag

SEQ ID NO: 12416 - RNA, 38 nt, Artificial Sequence
  Description of Artificial Sequence:  Enzymatic Nucleic Acid
  misc_feature (31)..(31): n stands for inosine
aaauuacacugaugaggccguuaggccgaangauaaaa

SEQ ID NO: 12417 - RNA, 38 nt, Artificial Sequence
  Description of Artificial Sequence:  Enzymatic Nucleic Acid
  misc_feature (31)..(31): n stands for inosine
gguucuaccugaugaggccguuaggccgaanuuaaauu

SEQ ID NO: 12418 - RNA, 38 nt, Artificial Sequence
  Description of Artificial Sequence:  Enzymatic Nucleic Acid
  misc_feature (31)..(31): n stands for inosine
agagcucacugaugaggccguuaggccgaanuucuaca

SEQ ID NO: 12419 - RNA, 38 nt, Artificial Sequence
  Description of Artificial Sequence:  Enzymatic Nucleic Acid
  misc_feature (31)..(31): n stands for inosine
uagagcuccugaugaggccguuaggccgaanguucuac

SEQ ID NO: 12420 - RNA, 38 nt, Artificial Sequence
  Description of Artificial Sequence:  Enzymatic Nucleic Acid
  misc_feature (31)..(31): n stands for inosine
uuacuuagcugaugaggccguuaggccgaancucaggu

SEQ ID NO: 12421 - RNA, 38 nt, Artificial Sequence
  Description of Artificial Sequence:  Enzymatic Nucleic Acid
  misc_feature (31)..(31): n stands for inosine
gguuacuucugaugaggccguuaggccgaanagcucag

SEQ ID NO: 12422 - RNA, 38 nt, Artificial Sequence
  Description of Artificial Sequence:  Enzymatic Nucleic Acid
  misc_feature (31)..(31): n stands for inosine
cauucuuccugaugaggccguuaggccgaanuuacuua

SEQ ID NO: 12423 - RNA, 38 nt, Artificial Sequence
  Description of Artificial Sequence:  Enzymatic Nucleic Acid
  misc_feature (31)..(31): n stands for inosine
agaacagacugaugaggccguuaggccgaancauacau

SEQ ID NO: 12424 - RNA, 38 nt, Artificial Sequence
  Description of Artificial Sequence:  Enzymatic Nucleic Acid
  misc_feature (31)..(31): n stands for inosine
aagaacagcugaugaggccguuaggccgaangcauaca

SEQ ID NO: 12425 - RNA, 38 nt, Artificial Sequence
  Description of Artificial Sequence:  Enzymatic Nucleic Acid
  misc_feature (31)..(31): n stands for inosine
auaagaaccugaugaggccguuaggccgaanaggcaua

SEQ ID NO: 12426 - RNA, 38 nt, Artificial Sequence
  Description of Artificial Sequence:  Enzymatic Nucleic Acid
  misc_feature (31)..(31): n stands for inosine
ggcacauacugaugaggccguuaggccgaanaacagag

SEQ ID NO: 12427 - RNA, 38 nt, Artificial Sequence
  Description of Artificial Sequence:  Enzymatic Nucleic Acid
  misc_feature (31)..(31): n stands for inosine
aaggaugucugaugaggccguuaggccgaancacauaa

SEQ ID NO: 12428 - RNA, 38 nt, Artificial Sequence
  Description of Artificial Sequence:  Enzymatic Nucleic Acid
  misc_feature (31)..(31): n stands for inosine
caaggaugcugaugaggccguuaggccgaangcacaua

SEQ ID NO: 12429 - RNA, 38 nt, Artificial Sequence
  Description of Artificial Sequence:  Enzymatic Nucleic Acid
  misc_feature (31)..(31): n stands for inosine
aacaaggacugaugaggccguuaggccgaanuggcaca

SEQ ID NO: 12430 - RNA, 38 nt, Artificial Sequence
  Description of Artificial Sequence:  Enzymatic Nucleic Acid
  misc_feature (31)..(31): n stands for inosine
uuaaacaacugaugaggccguuaggccgaanauguggc

SEQ ID NO: 12431 - RNA, 38 nt, Artificial Sequence
  Description of Artificial Sequence:  Enzymatic Nucleic Acid
  misc_feature (31)..(31): n stands for inosine
uuuaaacacugaugaggccguuaggccgaangaugugg

SEQ ID NO: 12432 - RNA, 38 nt, Artificial Sequence
  Description of Artificial Sequence:  Enzymatic Nucleic Acid
  misc_feature (31)..(31): n stands for inosine
auacagagcugaugaggccguuaggccgaanccuuuaa

SEQ ID NO: 12433 - RNA, 38 nt, Artificial Sequence
  Description of Artificial Sequence:  Enzymatic Nucleic Acid
  misc_feature (31)..(31): n stands for inosine
ucauacagcugaugaggccguuaggccgaanagccuuu

SEQ ID NO: 12434 - RNA, 38 nt, Artificial Sequence
  Description of Artificial Sequence:  Enzymatic Nucleic Acid
  misc_feature (31)..(31): n stands for inosine
cuucauaccugaugaggccguuaggccgaanagagccu

SEQ ID NO: 12435 - RNA, 38 nt, Artificial Sequence
  Description of Artificial Sequence:  Enzymatic Nucleic Acid
  misc_feature (31)..(31): n stands for inosine
cugaugaccugaugaggccguuaggccgaanucccauc

SEQ ID NO: 12436 - RNA, 38 nt, Artificial Sequence
  Description of Artificial Sequence:  Enzymatic Nucleic Acid
  misc_feature (31)..(31): n stands for inosine
ugugcugacugaugaggccguuaggccgaanacggucc

SEQ ID NO: 12437 - RNA, 38 nt, Artificial Sequence
  Description of Artificial Sequence:  Enzymatic Nucleic Acid
  misc_feature (31)..(31): n stands for inosine
gaaugugccugaugaggccguuaggccgaanaugacgg

SEQ ID NO: 12438 - RNA, 38 nt, Artificial Sequence
  Description of Artificial Sequence:  Enzymatic Nucleic Acid
  misc_feature (31)..(31): n stands for inosine
agggaaugcugaugaggccguuaggccgaancugauga

SEQ ID NO: 12439 - RNA, 38 nt, Artificial Sequence
  Description of Artificial Sequence:  Enzymatic Nucleic Acid
  misc_feature (31)..(31): n stands for inosine
cuagggaacugaugaggccguuaggccgaanugcugau

SEQ ID NO: 12440 - RNA, 38 nt, Artificial Sequence
  Description of Artificial Sequence:  Enzymatic Nucleic Acid
  misc_feature (31)..(31): n stands for inosine
cucacuagcugaugaggccguuaggccgaanaaugugc

SEQ ID NO: 12441 - RNA, 38 nt, Artificial Sequence
  Description of Artificial Sequence:  Enzymatic Nucleic Acid
  misc_feature (31)..(31): n stands for inosine
gcucacuacugaugaggccguuaggccgaangaaugug

SEQ ID NO: 12442 - RNA, 38 nt, Artificial Sequence
  Description of Artificial Sequence:  Enzymatic Nucleic Acid
  misc_feature (31)..(31): n stands for inosine
ggcucacucugaugaggccguuaggccgaanggaaugu

SEQ ID NO: 12443 - RNA, 38 nt, Artificial Sequence
  Description of Artificial Sequence:  Enzymatic Nucleic Acid
  misc_feature (31)..(31): n stands for inosine
agccaguacugaugaggccguuaggccgaancucacua

SEQ ID NO: 12444 - RNA, 38 nt, Artificial Sequence
  Description of Artificial Sequence:  Enzymatic Nucleic Acid
  misc_feature (31)..(31): n stands for inosine
gagccagucugaugaggccguuaggccgaangcucacu

SEQ ID NO: 12445 - RNA, 38 nt, Artificial Sequence
  Description of Artificial Sequence:  Enzymatic Nucleic Acid
  misc_feature (31)..(31): n stands for inosine
caggagcccugaugaggccguuaggccgaanuaggcuc

SEQ ID NO: 12446 - RNA, 38 nt, Artificial Sequence
  Description of Artificial Sequence:  Enzymatic Nucleic Acid
  misc_feature (31)..(31): n stands for inosine
cugccaggcugaugaggccguuaggccgaanccaguag

SEQ ID NO: 12447 - RNA, 38 nt, Artificial Sequence
  Description of Artificial Sequence:  Enzymatic Nucleic Acid
  misc_feature (31)..(31): n stands for inosine
cgcugccacugaugaggccguuaggccgaanagccagu

SEQ ID NO: 12448 - RNA, 38 nt, Artificial Sequence
  Description of Artificial Sequence:  Enzymatic Nucleic Acid
  misc_feature (31)..(31): n stands for inosine
ccgcugcccugaugaggccguuaggccgaangagccag

SEQ ID NO: 12449 - RNA, 38 nt, Artificial Sequence
  Description of Artificial Sequence:  Enzymatic Nucleic Acid
  misc_feature (31)..(31): n stands for inosine
aaagccgccugaugaggccguuaggccgaanccaggag

SEQ ID NO: 12450 - RNA, 38 nt, Artificial Sequence
  Description of Artificial Sequence:  Enzymatic Nucleic Acid
  misc_feature (31)..(31): n stands for inosine
uccacaaacugaugaggccguuaggccgaanccgcugc

SEQ ID NO: 12451 - RNA, 38 nt, Artificial Sequence
  Description of Artificial Sequence:  Enzymatic Nucleic Acid
  misc_feature (31)..(31): n stands for inosine
ggcuagugcugaugaggccguuaggccgaanucuucca

SEQ ID NO: 12452 - RNA, 38 nt, Artificial Sequence
  Description of Artificial Sequence:  Enzymatic Nucleic Acid
  misc_feature (31)..(31): n stands for inosine
cuggcuagcugaugaggccguuaggccgaanagucuuc

SEQ ID NO: 12453 - RNA, 38 nt, Artificial Sequence
  Description of Artificial Sequence:  Enzymatic Nucleic Acid
  misc_feature (31)..(31): n stands for inosine
uucuggcucugaugaggccguuaggccgaanugagucu

SEQ ID NO: 12454 - RNA, 38 nt, Artificial Sequence
  Description of Artificial Sequence:  Enzymatic Nucleic Acid
  misc_feature (31)..(31): n stands for inosine
ucucuucucugaugaggccguuaggccgaancuaguga

SEQ ID NO: 12455 - RNA, 38 nt, Artificial Sequence
  Description of Artificial Sequence:  Enzymatic Nucleic Acid
  misc_feature (31)..(31): n stands for inosine
cucucuuccugaugaggccguuaggccgaangcuagug

SEQ ID NO: 12456 - RNA, 38 nt, Artificial Sequence
  Description of Artificial Sequence:  Enzymatic Nucleic Acid
  misc_feature (31)..(31): n stands for inosine
gagaggaccugaugaggccguuaggccgaanucccacu

SEQ ID NO: 12457 - RNA, 38 nt, Artificial Sequence
  Description of Artificial Sequence:  Enzymatic Nucleic Acid
  misc_feature (31)..(31): n stands for inosine
gguggagacugaugaggccguuaggccgaanacugucc

SEQ ID NO: 12458 - RNA, 38 nt, Artificial Sequence
  Description of Artificial Sequence:  Enzymatic Nucleic Acid
  misc_feature (31)..(31): n stands for inosine
ugguggagcugaugaggccguuaggccgaangacuguc

SEQ ID NO: 12459 - RNA, 38 nt, Artificial Sequence
  Description of Artificial Sequence:  Enzymatic Nucleic Acid
  misc_feature (31)..(31): n stands for inosine
cuugguggcugaugaggccguuaggccgaanaggacug

SEQ ID NO: 12460 - RNA, 38 nt, Artificial Sequence
  Description of Artificial Sequence:  Enzymatic Nucleic Acid
  misc_feature (31)..(31): n stands for inosine
aucuuggucugaugaggccguuaggccgaanagaggac

SEQ ID NO: 12461 - RNA, 38 nt, Artificial Sequence
  Description of Artificial Sequence:  Enzymatic Nucleic Acid
  misc_feature (31)..(31): n stands for inosine
gaucuuggcugaugaggccguuaggccgaangagagga

SEQ ID NO: 12462 - RNA, 38 nt, Artificial Sequence
  Description of Artificial Sequence:  Enzymatic Nucleic Acid
  misc_feature (31)..(31): n stands for inosine
uagaucuucugaugaggccguuaggccgaanuggagag

SEQ ID NO: 12463 - RNA, 38 nt, Artificial Sequence
  Description of Artificial Sequence:  Enzymatic Nucleic Acid
  misc_feature (31)..(31): n stands for inosine
uuagaucucugaugaggccguuaggccgaanguggaga

SEQ ID NO: 12464 - RNA, 38 nt, Artificial Sequence
  Description of Artificial Sequence:  Enzymatic Nucleic Acid
  misc_feature (31)..(31): n stands for inosine
uuggauuucugaugaggccguuaggccgaanaucuugg

SEQ ID NO: 12465 - RNA, 38 nt, Artificial Sequence
  Description of Artificial Sequence:  Enzymatic Nucleic Acid
  misc_feature (31)..(31): n stands for inosine
uuuuguuucugaugaggccguuaggccgaanauuuaga

SEQ ID NO: 12466 - RNA, 38 nt, Artificial Sequence
  Description of Artificial Sequence:  Enzymatic Nucleic Acid
  misc_feature (31)..(31): n stands for inosine
cuuuuguucugaugaggccguuaggccgaangauuuag

SEQ ID NO: 12467 - RNA, 38 nt, Artificial Sequence
  Description of Artificial Sequence:  Enzymatic Nucleic Acid
  misc_feature (31)..(31): n stands for inosine
ccugcuuucugaugaggccguuaggccgaanuuuggau

SEQ ID NO: 12468 - RNA, 38 nt, Artificial Sequence
  Description of Artificial Sequence:  Enzymatic Nucleic Acid
  misc_feature (31)..(31): n stands for inosine
cucuagcccugaugaggccguuaggccgaancuuuugu

SEQ ID NO: 12469 - RNA, 38 nt, Artificial Sequence
  Description of Artificial Sequence:  Enzymatic Nucleic Acid
  misc_feature (31)..(31): n stands for inosine
cuggcucucugaugaggccguuaggccgaanccugcuu

SEQ ID NO: 12470 - RNA, 38 nt, Artificial Sequence
  Description of Artificial Sequence:  Enzymatic Nucleic Acid
  misc_feature (31)..(31): n stands for inosine
ucucuucucugaugaggccguuaggccgaancucuagc

SEQ ID NO: 12471 - RNA, 38 nt, Artificial Sequence
  Description of Artificial Sequence:  Enzymatic Nucleic Acid
  misc_feature (31)..(31): n stands for inosine
cucucuuccugaugaggccguuaggccgaangcucuag

SEQ ID NO: 12472 - RNA, 38 nt, Artificial Sequence
  Description of Artificial Sequence:  Enzymatic Nucleic Acid
  misc_feature (31)..(31): n stands for inosine
caaagauucugaugaggccguuaggccgaanuccucuc

SEQ ID NO: 12473 - RNA, 38 nt, Artificial Sequence
  Description of Artificial Sequence:  Enzymatic Nucleic Acid
  misc_feature (31)..(31): n stands for inosine
aacaacaacugaugaggccguuaggccgaanauuuguc

SEQ ID NO: 12474 - RNA, 38 nt, Artificial Sequence
  Description of Artificial Sequence:  Enzymatic Nucleic Acid
  misc_feature (31)..(31): n stands for inosine
aaagaagacugaugaggccguuaggccgaanaacaaca

SEQ ID NO: 12475 - RNA, 38 nt, Artificial Sequence
  Description of Artificial Sequence:  Enzymatic Nucleic Acid
  misc_feature (31)..(31): n stands for inosine
uaaagaagcugaugaggccguuaggccgaangaacaac

SEQ ID NO: 12476 - RNA, 38 nt, Artificial Sequence
  Description of Artificial Sequence:  Enzymatic Nucleic Acid
  misc_feature (31)..(31): n stands for inosine
uguaaagacugaugaggccguuaggccgaanaggaaca

SEQ ID NO: 12477 - RNA, 38 nt, Artificial Sequence
  Description of Artificial Sequence:  Enzymatic Nucleic Acid
  misc_feature (31)..(31): n stands for inosine
auguguaacugaugaggccguuaggccgaanaagagga

SEQ ID NO: 12478 - RNA, 38 nt, Artificial Sequence
  Description of Artificial Sequence:  Enzymatic Nucleic Acid
  misc_feature (31)..(31): n stands for inosine
ugcguaugcugaugaggccguuaggccgaanuaaagaa

SEQ ID NO: 12479 - RNA, 38 nt, Artificial Sequence
  Description of Artificial Sequence:  Enzymatic Nucleic Acid
  misc_feature (31)..(31): n stands for inosine
uuugcguacugaugaggccguuaggccgaanuguaaag

SEQ ID NO: 12480 - RNA, 38 nt, Artificial Sequence
  Description of Artificial Sequence:  Enzymatic Nucleic Acid
  misc_feature (31)..(31): n stands for inosine
aggugguucugaugaggccguuaggccgaancguaugu

SEQ ID NO: 12481 - RNA, 38 nt, Artificial Sequence
  Description of Artificial Sequence:  Enzymatic Nucleic Acid
  misc_feature (31)..(31): n stands for inosine
ucacaggucugaugaggccguuaggccgaanuuugcgu

SEQ ID NO: 12482 - RNA, 38 nt, Artificial Sequence
  Description of Artificial Sequence:  Enzymatic Nucleic Acid
  misc_feature (31)..(31): n stands for inosine
gucacaggcugaugaggccguuaggccgaanguuugcg

SEQ ID NO: 12483 - RNA, 38 nt, Artificial Sequence
  Description of Artificial Sequence:  Enzymatic Nucleic Acid
  misc_feature (31)..(31): n stands for inosine
cugucacacugaugaggccguuaggccgaanugguuug

SEQ ID NO: 12484 - RNA, 38 nt, Artificial Sequence
  Description of Artificial Sequence:  Enzymatic Nucleic Acid
  misc_feature (31)..(31): n stands for inosine
gcugucaccugaugaggccguuaggccgaangugguuu

SEQ ID NO: 12485 - RNA, 38 nt, Artificial Sequence
  Description of Artificial Sequence:  Enzymatic Nucleic Acid
  misc_feature (31)..(31): n stands for inosine
uugccagccugaugaggccguuaggccgaanucacagg

SEQ ID NO: 12486 - RNA, 38 nt, Artificial Sequence
  Description of Artificial Sequence:  Enzymatic Nucleic Acid
  misc_feature (31)..(31): n stands for inosine
aaauugcccugaugaggccguuaggccgaancugucac

SEQ ID NO: 12487 - RNA, 38 nt, Artificial Sequence
  Description of Artificial Sequence:  Enzymatic Nucleic Acid
  misc_feature (31)..(31): n stands for inosine
uauaaaaucugaugaggccguuaggccgaanccagcug

SEQ ID NO: 12488 - RNA, 38 nt, Artificial Sequence
  Description of Artificial Sequence:  Enzymatic Nucleic Acid
  misc_feature (31)..(31): n stands for inosine
caguuacccugaugaggccguuaggccgaanauuuaua

SEQ ID NO: 12489 - RNA, 38 nt, Artificial Sequence
  Description of Artificial Sequence:  Enzymatic Nucleic Acid
  misc_feature (31)..(31): n stands for inosine
cuccuucccugaugaggccguuaggccgaanuuaccug

SEQ ID NO: 12490 - RNA, 38 nt, Artificial Sequence
  Description of Artificial Sequence:  Enzymatic Nucleic Acid
  misc_feature (31)..(31): n stands for inosine
uuuuucugcugaugaggccguuaggccgaanuuuaacc

SEQ ID NO: 12491 - RNA, 38 nt, Artificial Sequence
  Description of Artificial Sequence:  Enzymatic Nucleic Acid
  misc_feature (31)..(31): n stands for inosine
cuuuuuuccugaugaggccguuaggccgaanaguuuaa

SEQ ID NO: 12492 - RNA, 38 nt, Artificial Sequence
  Description of Artificial Sequence:  Enzymatic Nucleic Acid
  misc_feature (31)..(31): n stands for inosine
uugacugacugaugaggccguuaggccgaanucuucuu

SEQ ID NO: 12493 - RNA, 38 nt, Artificial Sequence
  Description of Artificial Sequence:  Enzymatic Nucleic Acid
  misc_feature (31)..(31): n stands for inosine
auugacugcugaugaggccguuaggccgaangucuucu

SEQ ID NO: 12494 - RNA, 38 nt, Artificial Sequence
  Description of Artificial Sequence:  Enzymatic Nucleic Acid
  misc_feature (31)..(31): n stands for inosine
gaauugaccugaugaggccguuaggccgaanaggucuu

SEQ ID NO: 12495 - RNA, 38 nt, Artificial Sequence
  Description of Artificial Sequence:  Enzymatic Nucleic Acid
  misc_feature (31)..(31): n stands for inosine
uagagaaucugaugaggccguuaggccgaanacugagg

SEQ ID NO: 12496 - RNA, 38 nt, Artificial Sequence
  Description of Artificial Sequence:  Enzymatic Nucleic Acid
  misc_feature (31)..(31): n stands for inosine
aaaaguagcugaugaggccguuaggccgaanaauugac

SEQ ID NO: 12497 - RNA, 38 nt, Artificial Sequence
  Description of Artificial Sequence:  Enzymatic Nucleic Acid
  misc_feature (31)..(31): n stands for inosine
aaaaaagucugaugaggccguuaggccgaanagaauug

SEQ ID NO: 12498 - RNA, 38 nt, Artificial Sequence
  Description of Artificial Sequence:  Enzymatic Nucleic Acid
  misc_feature (31)..(31): n stands for inosine
aaaaaaaacugaugaggccguuaggccgaanuagagaa

SEQ ID NO: 12499 - RNA, 38 nt, Artificial Sequence
  Description of Artificial Sequence:  Enzymatic Nucleic Acid
  misc_feature (31)..(31): n stands for inosine
ucugauuucugaugaggccguuaggccgaanaaaaaaa

SEQ ID NO: 12500 - RNA, 38 nt, Artificial Sequence
  Description of Artificial Sequence:  Enzymatic Nucleic Acid
  misc_feature (31)..(31): n stands for inosine
aucugauucugaugaggccguuaggccgaangaaaaaa

SEQ ID NO: 12501 - RNA, 38 nt, Artificial Sequence
  Description of Artificial Sequence:  Enzymatic Nucleic Acid
  misc_feature (31)..(31): n stands for inosine
cuauuauccugaugaggccguuaggccgaanauuugga

SEQ ID NO: 12502 - RNA, 38 nt, Artificial Sequence
  Description of Artificial Sequence:  Enzymatic Nucleic Acid
  misc_feature (31)..(31): n stands for inosine
auuugcugcugaugaggccguuaggccgaancuauuau

SEQ ID NO: 12503 - RNA, 38 nt, Artificial Sequence
  Description of Artificial Sequence:  Enzymatic Nucleic Acid
  misc_feature (31)..(31): n stands for inosine
uauuugcucugaugaggccguuaggccgaangcuauua

SEQ ID NO: 12504 - RNA, 38 nt, Artificial Sequence
  Description of Artificial Sequence:  Enzymatic Nucleic Acid
  misc_feature (31)..(31): n stands for inosine
cuauuugccugaugaggccguuaggccgaanggcuauu

SEQ ID NO: 12505 - RNA, 38 nt, Artificial Sequence
  Description of Artificial Sequence:  Enzymatic Nucleic Acid
  misc_feature (31)..(31): n stands for inosine
ucacuauucugaugaggccguuaggccgaancugggcu

SEQ ID NO: 12506 - RNA, 38 nt, Artificial Sequence
  Description of Artificial Sequence:  Enzymatic Nucleic Acid
  misc_feature (31)..(31): n stands for inosine
guuuuauucugaugaggccguuaggccgaanuuaucac

SEQ ID NO: 12507 - RNA, 38 nt, Artificial Sequence
  Description of Artificial Sequence:  Enzymatic Nucleic Acid
  misc_feature (31)..(31): n stands for inosine
acagcuaacugaugaggccguuaggccgaanuuuuauu

SEQ ID NO: 12508 - RNA, 38 nt, Artificial Sequence
  Description of Artificial Sequence:  Enzymatic Nucleic Acid
  misc_feature (31)..(31): n stands for inosine
aacagcuacugaugaggccguuaggccgaanguuuuau

SEQ ID NO: 12509 - RNA, 38 nt, Artificial Sequence
  Description of Artificial Sequence:  Enzymatic Nucleic Acid
  misc_feature (31)..(31): n stands for inosine
acaugaaccugaugaggccguuaggccgaancuaaggu

SEQ ID NO: 12510 - RNA, 38 nt, Artificial Sequence
  Description of Artificial Sequence:  Enzymatic Nucleic Acid
  misc_feature (31)..(31): n stands for inosine
ucaagacacugaugaggccguuaggccgaanaacagcu

SEQ ID NO: 12511 - RNA, 38 nt, Artificial Sequence
  Description of Artificial Sequence:  Enzymatic Nucleic Acid
  misc_feature (31)..(31): n stands for inosine
ugaaaucacugaugaggccguuaggccgaanacaugaa

SEQ ID NO: 12512 - RNA, 38 nt, Artificial Sequence
  Description of Artificial Sequence:  Enzymatic Nucleic Acid
  misc_feature (31)..(31): n stands for inosine
uuaauuaucugaugaggccguuaggccgaanaaaucaa

SEQ ID NO: 12513 - RNA, 38 nt, Artificial Sequence
  Description of Artificial Sequence:  Enzymatic Nucleic Acid
  misc_feature (31)..(31): n stands for inosine
aaugauuacugaugaggccguuaggccgaanaauuaau

SEQ ID NO: 12514 - RNA, 38 nt, Artificial Sequence
  Description of Artificial Sequence:  Enzymatic Nucleic Acid
  misc_feature (31)..(31): n stands for inosine
ucucuuaacugaugaggccguuaggccgaanauuaaga

SEQ ID NO: 12515 - RNA, 38 nt, Artificial Sequence
  Description of Artificial Sequence:  Enzymatic Nucleic Acid
  misc_feature (31)..(31): n stands for inosine
uuuauuaucugaugaggccguuaggccgaanucucuua

SEQ ID NO: 12516 - RNA, 38 nt, Artificial Sequence
  Description of Artificial Sequence:  Enzymatic Nucleic Acid
  misc_feature (31)..(31): n stands for inosine
auuuauuacugaugaggccguuaggccgaangucucuu

SEQ ID NO: 12517 - RNA, 38 nt, Artificial Sequence
  Description of Artificial Sequence:  Enzymatic Nucleic Acid
  misc_feature (31)..(31): n stands for inosine
ugaaaaggcugaugaggccguuaggccgaanuauuuau

SEQ ID NO: 12518 - RNA, 38 nt, Artificial Sequence
  Description of Artificial Sequence:  Enzymatic Nucleic Acid
  misc_feature (31)..(31): n stands for inosine
cuugaaaacugaugaggccguuaggccgaanaguauuu

SEQ ID NO: 12519 - RNA, 38 nt, Artificial Sequence
  Description of Artificial Sequence:  Enzymatic Nucleic Acid
  misc_feature (31)..(31): n stands for inosine
ucuugaaacugaugaggccguuaggccgaangaguauu

SEQ ID NO: 12520 - RNA, 38 nt, Artificial Sequence
  Description of Artificial Sequence:  Enzymatic Nucleic Acid
  misc_feature (31)..(31): n stands for inosine
uuuucucucugaugaggccguuaggccgaanaaaagga

SEQ ID NO: 12521 - RNA, 38 nt, Artificial Sequence
  Description of Artificial Sequence:  Enzymatic Nucleic Acid
  misc_feature (31)..(31): n stands for inosine
aaugguuucugaugaggccguuaggccgaancuuuucu

SEQ ID NO: 12522 - RNA, 38 nt, Artificial Sequence
  Description of Artificial Sequence:  Enzymatic Nucleic Acid
  misc_feature (31)..(31): n stands for inosine
auucuaaucugaugaggccguuaggccgaanuuuugcu

SEQ ID NO: 12523 - RNA, 38 nt, Artificial Sequence
  Description of Artificial Sequence:  Enzymatic Nucleic Acid
  misc_feature (31)..(31): n stands for inosine
aauucuaacugaugaggccguuaggccgaanguuuugc

SEQ ID NO: 12524 - RNA, 38 nt, Artificial Sequence
  Description of Artificial Sequence:  Enzymatic Nucleic Acid
  misc_feature (31)..(31): n stands for inosine
aggagcugcugaugaggccguuaggccgaanuaacaau

SEQ ID NO: 12525 - RNA, 38 nt, Artificial Sequence
  Description of Artificial Sequence:  Enzymatic Nucleic Acid
  misc_feature (31)..(31): n stands for inosine
gaaggagccugaugaggccguuaggccgaanaguaaca

SEQ ID NO: 12526 - RNA, 38 nt, Artificial Sequence
  Description of Artificial Sequence:  Enzymatic Nucleic Acid
  misc_feature (31)..(31): n stands for inosine
uuugaaggcugaugaggccguuaggccgaancugagua

SEQ ID NO: 12527 - RNA, 38 nt, Artificial Sequence
  Description of Artificial Sequence:  Enzymatic Nucleic Acid
  misc_feature (31)..(31): n stands for inosine
aguuugaacugaugaggccguuaggccgaanagcugag

SEQ ID NO: 12528 - RNA, 38 nt, Artificial Sequence
  Description of Artificial Sequence:  Enzymatic Nucleic Acid
  misc_feature (31)..(31): n stands for inosine
gaguuugacugaugaggccguuaggccgaangagcuga

SEQ ID NO: 12529 - RNA, 38 nt, Artificial Sequence
  Description of Artificial Sequence:  Enzymatic Nucleic Acid
  misc_feature (31)..(31): n stands for inosine
ccugaguucugaugaggccguuaggccgaanaaggagc

SEQ ID NO: 12530 - RNA, 38 nt, Artificial Sequence
  Description of Artificial Sequence:  Enzymatic Nucleic Acid
  misc_feature (31)..(31): n stands for inosine
caaaccugcugaugaggccguuaggccgaanuuugaag

SEQ ID NO: 12531 - RNA, 38 nt, Artificial Sequence
  Description of Artificial Sequence:  Enzymatic Nucleic Acid
  misc_feature (31)..(31): n stands for inosine
uacaaacccugaugaggccguuaggccgaanaguuuga

SEQ ID NO: 12532 - RNA, 38 nt, Artificial Sequence
  Description of Artificial Sequence:  Enzymatic Nucleic Acid
  misc_feature (31)..(31): n stands for inosine
cucauguacugaugaggccguuaggccgaancuacaaa

SEQ ID NO: 12533 - RNA, 38 nt, Artificial Sequence
  Description of Artificial Sequence:  Enzymatic Nucleic Acid
  misc_feature (31)..(31): n stands for inosine
uggacucacugaugaggccguuaggccgaanuaugcua

SEQ ID NO: 12534 - RNA, 38 nt, Artificial Sequence
  Description of Artificial Sequence:  Enzymatic Nucleic Acid
  misc_feature (31)..(31): n stands for inosine
ugauggaucugaugaggccguuaggccgaanacucaug

SEQ ID NO: 12535 - RNA, 38 nt, Artificial Sequence
  Description of Artificial Sequence:  Enzymatic Nucleic Acid
  misc_feature (31)..(31): n stands for inosine
cugauggacugaugaggccguuaggccgaangacucau

SEQ ID NO: 12536 - RNA, 38 nt, Artificial Sequence
  Description of Artificial Sequence:  Enzymatic Nucleic Acid
  misc_feature (31)..(31): n stands for inosine
ugacugaucugaugaggccguuaggccgaanauggacu

SEQ ID NO: 12537 - RNA, 38 nt, Artificial Sequence
  Description of Artificial Sequence:  Enzymatic Nucleic Acid
  misc_feature (31)..(31): n stands for inosine
uugacugacugaugaggccguuaggccgaangauggac

SEQ ID NO: 12538 - RNA, 38 nt, Artificial Sequence
  Description of Artificial Sequence:  Enzymatic Nucleic Acid
  misc_feature (31)..(31): n stands for inosine
ucuuugaccugaugaggccguuaggccgaanauggaug

SEQ ID NO: 12539 - RNA, 38 nt, Artificial Sequence
  Description of Artificial Sequence:  Enzymatic Nucleic Acid
  misc_feature (31)..(31): n stands for inosine
ccauucuucugaugaggccguuaggccgaanacugaug

SEQ ID NO: 12540 - RNA, 38 nt, Artificial Sequence
  Description of Artificial Sequence:  Enzymatic Nucleic Acid
  misc_feature (31)..(31): n stands for inosine
cuccagaucugaugaggccguuaggccgaanaaccauu

SEQ ID NO: 12541 - RNA, 38 nt, Artificial Sequence
  Description of Artificial Sequence:  Enzymatic Nucleic Acid
  misc_feature (31)..(31): n stands for inosine
acuccagacugaugaggccguuaggccgaangaaccau

SEQ ID NO: 12542 - RNA, 38 nt, Artificial Sequence
  Description of Artificial Sequence:  Enzymatic Nucleic Acid
  misc_feature (31)..(31): n stands for inosine
aagacucccugaugaggccguuaggccgaanauggaac

SEQ ID NO: 12543 - RNA, 38 nt, Artificial Sequence
  Description of Artificial Sequence:  Enzymatic Nucleic Acid
  misc_feature (31)..(31): n stands for inosine
cuacauuacugaugaggccguuaggccgaanacuccag

SEQ ID NO: 12544 - RNA, 38 nt, Artificial Sequence
  Description of Artificial Sequence:  Enzymatic Nucleic Acid
  misc_feature (31)..(31): n stands for inosine
uuauuacacugaugaggccguuaggccgaanucuccau

SEQ ID NO: 12545 - RNA, 38 nt, Artificial Sequence
  Description of Artificial Sequence:  Enzymatic Nucleic Acid
  misc_feature (31)..(31): n stands for inosine
uuguaacucugaugaggccguuaggccgaancucauua

SEQ ID NO: 12546 - RNA, 38 nt, Artificial Sequence
  Description of Artificial Sequence:  Enzymatic Nucleic Acid
  misc_feature (31)..(31): n stands for inosine
aagcacuucugaugaggccguuaggccgaanuaacuag

SEQ ID NO: 12547 - RNA, 38 nt, Artificial Sequence
  Description of Artificial Sequence:  Enzymatic Nucleic Acid
  misc_feature (31)..(31): n stands for inosine
aaugaacacugaugaggccguuaggccgaancacuuug

SEQ ID NO: 12548 - RNA, 38 nt, Artificial Sequence
  Description of Artificial Sequence:  Enzymatic Nucleic Acid
  misc_feature (31)..(31): n stands for inosine
uauuuuaacugaugaggccguuaggccgaanaacaagc

SEQ ID NO: 12549 - RNA, 38 nt, Artificial Sequence
  Description of Artificial Sequence:  Enzymatic Nucleic Acid
  misc_feature (31)..(31): n stands for inosine
auuuucagcugaugaggccguuaggccgaancuauuuu

SEQ ID NO: 12550 - RNA, 38 nt, Artificial Sequence
  Description of Artificial Sequence:  Enzymatic Nucleic Acid
  misc_feature (31)..(31): n stands for inosine
caauuuuccugaugaggccguuaggccgaanugcuauu

SEQ ID NO: 12551 - RNA, 38 nt, Artificial Sequence
  Description of Artificial Sequence:  Enzymatic Nucleic Acid
  misc_feature (31)..(31): n stands for inosine
uuaauucacugaugaggccguuaggccgaanuuucaau

SEQ ID NO: 12552 - RNA, 38 nt, Artificial Sequence
  Description of Artificial Sequence:  Enzymatic Nucleic Acid
  misc_feature (31)..(31): n stands for inosine
auauuauccugaugaggccguuaggccgaanuuaauuc

SEQ ID NO: 12553 - RNA, 38 nt, Artificial Sequence
  Description of Artificial Sequence:  Enzymatic Nucleic Acid
  misc_feature (31)..(31): n stands for inosine
aaaugauucugaugaggccguuaggccgaanaauauua

SEQ ID NO: 12554 - RNA, 38 nt, Artificial Sequence
  Description of Artificial Sequence:  Enzymatic Nucleic Acid
  misc_feature (31)..(31): n stands for inosine
caaaugaucugaugaggccguuaggccgaangaauauu

SEQ ID NO: 12555 - RNA, 38 nt, Artificial Sequence
  Description of Artificial Sequence:  Enzymatic Nucleic Acid
  misc_feature (31)..(31): n stands for inosine
auggcaaacugaugaggccguuaggccgaanauuggaa

SEQ ID NO: 12556 - RNA, 38 nt, Artificial Sequence
  Description of Artificial Sequence:  Enzymatic Nucleic Acid
  misc_feature (31)..(31): n stands for inosine
ucauaaaucugaugaggccguuaggccgaancaaauga

SEQ ID NO: 12557 - RNA, 38 nt, Artificial Sequence
  Description of Artificial Sequence:  Enzymatic Nucleic Acid
  misc_feature (31)..(31): n stands for inosine
gucauaaacugaugaggccguuaggccgaangcaaaug

SEQ ID NO: 12558 - RNA, 38 nt, Artificial Sequence
  Description of Artificial Sequence:  Enzymatic Nucleic Acid
  misc_feature (31)..(31): n stands for inosine
accauuuucugaugaggccguuaggccgaanucauaaa

SEQ ID NO: 12559 - RNA, 38 nt, Artificial Sequence
  Description of Artificial Sequence:  Enzymatic Nucleic Acid
  misc_feature (31)..(31): n stands for inosine
uuuguuagcugaugaggccguuaggccgaanccaacca

SEQ ID NO: 12560 - RNA, 38 nt, Artificial Sequence
  Description of Artificial Sequence:  Enzymatic Nucleic Acid
  misc_feature (31)..(31): n stands for inosine
ucuuuguucugaugaggccguuaggccgaanugccaac

SEQ ID NO: 12561 - RNA, 38 nt, Artificial Sequence
  Description of Artificial Sequence:  Enzymatic Nucleic Acid
  misc_feature (31)..(31): n stands for inosine
ucguucuucugaugaggccguuaggccgaanuuagugc

SEQ ID NO: 12562 - RNA, 38 nt, Artificial Sequence
  Description of Artificial Sequence:  Enzymatic Nucleic Acid
  misc_feature (31)..(31): n stands for inosine
aaaggaagcugaugaggccguuaggccgaancucguuc

SEQ ID NO: 12563 - RNA, 38 nt, Artificial Sequence
  Description of Artificial Sequence:  Enzymatic Nucleic Acid
  misc_feature (31)..(31): n stands for inosine
ugaaaggacugaugaggccguuaggccgaanugcucgu

SEQ ID NO: 12564 - RNA, 38 nt, Artificial Sequence
  Description of Artificial Sequence:  Enzymatic Nucleic Acid
  misc_feature (31)..(31): n stands for inosine
cucugaaacugaugaggccguuaggccgaanaagugcu

SEQ ID NO: 12565 - RNA, 38 nt, Artificial Sequence
  Description of Artificial Sequence:  Enzymatic Nucleic Acid
  misc_feature (31)..(31): n stands for inosine
acucugaacugaugaggccguuaggccgaangaagugc

SEQ ID NO: 12566 - RNA, 38 nt, Artificial Sequence
  Description of Artificial Sequence:  Enzymatic Nucleic Acid
  misc_feature (31)..(31): n stands for inosine
agaaacuccugaugaggccguuaggccgaanaaaggaa

SEQ ID NO: 12567 - RNA, 38 nt, Artificial Sequence
  Description of Artificial Sequence:  Enzymatic Nucleic Acid
  misc_feature (31)..(31): n stands for inosine
auuaucuccugaugaggccguuaggccgaanaaacucu

SEQ ID NO: 12568 - RNA, 38 nt, Artificial Sequence
  Description of Artificial Sequence:  Enzymatic Nucleic Acid
  misc_feature (31)..(31): n stands for inosine
acccagaccugaugaggccguuaggccgaanuuccacg

SEQ ID NO: 12569 - RNA, 38 nt, Artificial Sequence
  Description of Artificial Sequence:  Enzymatic Nucleic Acid
  misc_feature (31)..(31): n stands for inosine
uuccaccccugaugaggccguuaggccgaanacuguuc

SEQ ID NO: 12570 - RNA, 38 nt, Artificial Sequence
  Description of Artificial Sequence:  Enzymatic Nucleic Acid
  misc_feature (31)..(31): n stands for inosine
augguuuccugaugaggccguuaggccgaanccccauu

SEQ ID NO: 12571 - RNA, 38 nt, Artificial Sequence
  Description of Artificial Sequence:  Enzymatic Nucleic Acid
  misc_feature (31)..(31): n stands for inosine
uugcacaucugaugaggccguuaggccgaanuuucagc

SEQ ID NO: 12572 - RNA, 38 nt, Artificial Sequence
  Description of Artificial Sequence:  Enzymatic Nucleic Acid
  misc_feature (31)..(31): n stands for inosine
cuugcacacugaugaggccguuaggccgaanguuucag

SEQ ID NO: 12573 - RNA, 38 nt, Artificial Sequence
  Description of Artificial Sequence:  Enzymatic Nucleic Acid
  misc_feature (31)..(31): n stands for inosine
cacagacucugaugaggccguuaggccgaancacaugg

SEQ ID NO: 12574 - RNA, 38 nt, Artificial Sequence
  Description of Artificial Sequence:  Enzymatic Nucleic Acid
  misc_feature (31)..(31): n stands for inosine
caagacaccugaugaggccguuaggccgaanacuugca

SEQ ID NO: 12575 - RNA, 38 nt, Artificial Sequence
  Description of Artificial Sequence:  Enzymatic Nucleic Acid
  misc_feature (31)..(31): n stands for inosine
gacugacacugaugaggccguuaggccgaanacacaga

SEQ ID NO: 12576 - RNA, 38 nt, Artificial Sequence
  Description of Artificial Sequence:  Enzymatic Nucleic Acid
  misc_feature (31)..(31): n stands for inosine
ucuuggaccugaugaggccguuaggccgaanacaagac

SEQ ID NO: 12577 - RNA, 38 nt, Artificial Sequence
  Description of Artificial Sequence:  Enzymatic Nucleic Acid
  misc_feature (31)..(31): n stands for inosine
cacuucuucugaugaggccguuaggccgaanacugaca

SEQ ID NO: 12578 - RNA, 38 nt, Artificial Sequence
  Description of Artificial Sequence:  Enzymatic Nucleic Acid
  misc_feature (31)..(31): n stands for inosine
ucacuucucugaugaggccguuaggccgaangacugac

SEQ ID NO: 12579 - RNA, 38 nt, Artificial Sequence
  Description of Artificial Sequence:  Enzymatic Nucleic Acid
  misc_feature (31)..(31): n stands for inosine
caucucggcugaugaggccguuaggccgaanucacuuc

SEQ ID NO: 12580 - RNA, 38 nt, Artificial Sequence
  Description of Artificial Sequence:  Enzymatic Nucleic Acid
  misc_feature (31)..(31): n stands for inosine
aacaucuccugaugaggccguuaggccgaanugucacu

SEQ ID NO: 12581 - RNA, 38 nt, Artificial Sequence
  Description of Artificial Sequence:  Enzymatic Nucleic Acid
  misc_feature (31)..(31): n stands for inosine
aaggcacgcugaugaggccguuaggccgaanucccuaa

SEQ ID NO: 12582 - RNA, 38 nt, Artificial Sequence
  Description of Artificial Sequence:  Enzymatic Nucleic Acid
  misc_feature (31)..(31): n stands for inosine
caaggcaccugaugaggccguuaggccgaangucccua

SEQ ID NO: 12583 - RNA, 38 nt, Artificial Sequence
  Description of Artificial Sequence:  Enzymatic Nucleic Acid
  misc_feature (31)..(31): n stands for inosine
ggaaacaacugaugaggccguuaggccgaancacgggu

SEQ ID NO: 12584 - RNA, 38 nt, Artificial Sequence
  Description of Artificial Sequence:  Enzymatic Nucleic Acid
  misc_feature (31)..(31): n stands for inosine
aggaaacacugaugaggccguuaggccgaangcacggg

SEQ ID NO: 12585 - RNA, 38 nt, Artificial Sequence
  Description of Artificial Sequence:  Enzymatic Nucleic Acid
  misc_feature (31)..(31): n stands for inosine
gugggcuacugaugaggccguuaggccgaanaaacaag

SEQ ID NO: 12586 - RNA, 38 nt, Artificial Sequence
  Description of Artificial Sequence:  Enzymatic Nucleic Acid
  misc_feature (31)..(31): n stands for inosine
ugugggcucugaugaggccguuaggccgaangaaacaa

SEQ ID NO: 12587 - RNA, 38 nt, Artificial Sequence
  Description of Artificial Sequence:  Enzymatic Nucleic Acid
  misc_feature (31)..(31): n stands for inosine
uucuugugcugaugaggccguuaggccgaancuaggaa

SEQ ID NO: 12588 - RNA, 38 nt, Artificial Sequence
  Description of Artificial Sequence:  Enzymatic Nucleic Acid
  misc_feature (31)..(31): n stands for inosine
auucuugucugaugaggccguuaggccgaangcuagga

SEQ ID NO: 12589 - RNA, 38 nt, Artificial Sequence
  Description of Artificial Sequence:  Enzymatic Nucleic Acid
  misc_feature (31)..(31): n stands for inosine
cauucuugcugaugaggccguuaggccgaanggcuagg

SEQ ID NO: 12590 - RNA, 38 nt, Artificial Sequence
  Description of Artificial Sequence:  Enzymatic Nucleic Acid
  misc_feature (31)..(31): n stands for inosine
ugcauucucugaugaggccguuaggccgaanugggcua

SEQ ID NO: 12591 - RNA, 38 nt, Artificial Sequence
  Description of Artificial Sequence:  Enzymatic Nucleic Acid
  misc_feature (31)..(31): n stands for inosine
uugauguucugaugaggccguuaggccgaancauucuu

SEQ ID NO: 12592 - RNA, 38 nt, Artificial Sequence
  Description of Artificial Sequence:  Enzymatic Nucleic Acid
  misc_feature (31)..(31): n stands for inosine
cuguuugacugaugaggccguuaggccgaanuuugcau

SEQ ID NO: 12593 - RNA, 38 nt, Artificial Sequence
  Description of Artificial Sequence:  Enzymatic Nucleic Acid
  misc_feature (31)..(31): n stands for inosine
uaucuguucugaugaggccguuaggccgaanauguuug

SEQ ID NO: 12594 - RNA, 38 nt, Artificial Sequence
  Description of Artificial Sequence:  Enzymatic Nucleic Acid
  misc_feature (31)..(31): n stands for inosine
cgaguauccugaugaggccguuaggccgaanuuugaug

SEQ ID NO: 12595 - RNA, 38 nt, Artificial Sequence
  Description of Artificial Sequence:  Enzymatic Nucleic Acid
  misc_feature (31)..(31): n stands for inosine
ggcuagcgcugaugaggccguuaggccgaanuaucugu

SEQ ID NO: 12596 - RNA, 38 nt, Artificial Sequence
  Description of Artificial Sequence:  Enzymatic Nucleic Acid
  misc_feature (31)..(31): n stands for inosine
augaggcucugaugaggccguuaggccgaancgaguau

SEQ ID NO: 12597 - RNA, 38 nt, Artificial Sequence
  Description of Artificial Sequence:  Enzymatic Nucleic Acid
  misc_feature (31)..(31): n stands for inosine
uuaaaugacugaugaggccguuaggccgaancuagcga

SEQ ID NO: 12598 - RNA, 38 nt, Artificial Sequence
  Description of Artificial Sequence:  Enzymatic Nucleic Acid
  misc_feature (31)..(31): n stands for inosine
uuuaaaugcugaugaggccguuaggccgaangcuagcg

SEQ ID NO: 12599 - RNA, 38 nt, Artificial Sequence
  Description of Artificial Sequence:  Enzymatic Nucleic Acid
  misc_feature (31)..(31): n stands for inosine
aauuuaaacugaugaggccguuaggccgaanaggcuag

SEQ ID NO: 12600 - RNA, 38 nt, Artificial Sequence
  Description of Artificial Sequence:  Enzymatic Nucleic Acid
  misc_feature (31)..(31): n stands for inosine
gccaaagacugaugaggccguuaggccgaancacuccu

SEQ ID NO: 12601 - RNA, 38 nt, Artificial Sequence
  Description of Artificial Sequence:  Enzymatic Nucleic Acid
  misc_feature (31)..(31): n stands for inosine
ucggccaacugaugaggccguuaggccgaanaugcacu

SEQ ID NO: 12602 - RNA, 38 nt, Artificial Sequence
  Description of Artificial Sequence:  Enzymatic Nucleic Acid
  misc_feature (31)..(31): n stands for inosine
ccacuguccugaugaggccguuaggccgaanccaaaga

SEQ ID NO: 12603 - RNA, 38 nt, Artificial Sequence
  Description of Artificial Sequence:  Enzymatic Nucleic Acid
  misc_feature (31)..(31): n stands for inosine
uacaccaccugaugaggccguuaggccgaanucggcca

SEQ ID NO: 12604 - RNA, 38 nt, Artificial Sequence
  Description of Artificial Sequence:  Enzymatic Nucleic Acid
  misc_feature (31)..(31): n stands for inosine
acacacaccugaugaggccguuaggccgaanuuacacc

SEQ ID NO: 12605 - RNA, 38 nt, Artificial Sequence
  Description of Artificial Sequence:  Enzymatic Nucleic Acid
  misc_feature (31)..(31): n stands for inosine
aauaguuacugaugaggccguuaggccgaancacaaaa

SEQ ID NO: 12606 - RNA, 38 nt, Artificial Sequence
  Description of Artificial Sequence:  Enzymatic Nucleic Acid
  misc_feature (31)..(31): n stands for inosine
ccuuaaaucugaugaggccguuaggccgaanuuaugca

SEQ ID NO: 12607 - RNA, 38 nt, Artificial Sequence
  Description of Artificial Sequence:  Enzymatic Nucleic Acid
  misc_feature (31)..(31): n stands for inosine
aaaauucccugaugaggccguuaggccgaanuuuccuu

SEQ ID NO: 12608 - RNA, 38 nt, Artificial Sequence
  Description of Artificial Sequence:  Enzymatic Nucleic Acid
  misc_feature (31)..(31): n stands for inosine
uguauaaacugaugaggccguuaggccgaanuaacuuu

SEQ ID NO: 12609 - RNA, 38 nt, Artificial Sequence
  Description of Artificial Sequence:  Enzymatic Nucleic Acid
  misc_feature (31)..(31): n stands for inosine
ucuugguucugaugaggccguuaggccgaanuauaaaa

SEQ ID NO: 12610 - RNA, 38 nt, Artificial Sequence
  Description of Artificial Sequence:  Enzymatic Nucleic Acid
  misc_feature (31)..(31): n stands for inosine
auauucuucugaugaggccguuaggccgaanuuuguau

SEQ ID NO: 12611 - RNA, 38 nt, Artificial Sequence
  Description of Artificial Sequence:  Enzymatic Nucleic Acid
  misc_feature (31)..(31): n stands for inosine
uauauucucugaugaggccguuaggccgaanguuugua

SEQ ID NO: 12612 - RNA, 38 nt, Artificial Sequence
  Description of Artificial Sequence:  Enzymatic Nucleic Acid
  misc_feature (31)..(31): n stands for inosine
auaucugucugaugaggccguuaggccgaancauauau

SEQ ID NO: 12613 - RNA, 38 nt, Artificial Sequence
  Description of Artificial Sequence:  Enzymatic Nucleic Acid
  misc_feature (31)..(31): n stands for inosine
cuuauauccugaugaggccguuaggccgaanuagcaua

SEQ ID NO: 12614 - RNA, 38 nt, Artificial Sequence
  Description of Artificial Sequence:  Enzymatic Nucleic Acid
  misc_feature (31)..(31): n stands for inosine
accauguccugaugaggccguuaggccgaanucuuaua

SEQ ID NO: 12615 - RNA, 38 nt, Artificial Sequence
  Description of Artificial Sequence:  Enzymatic Nucleic Acid
  misc_feature (31)..(31): n stands for inosine
ccaaaccacugaugaggccguuaggccgaanucugucu

SEQ ID NO: 12616 - RNA, 38 nt, Artificial Sequence
  Description of Artificial Sequence:  Enzymatic Nucleic Acid
  misc_feature (31)..(31): n stands for inosine
gaaauauacugaugaggccguuaggccgaanaccaaac

SEQ ID NO: 12617 - RNA, 38 nt, Artificial Sequence
  Description of Artificial Sequence:  Enzymatic Nucleic Acid
  misc_feature (31)..(31): n stands for inosine
agaaauaucugaugaggccguuaggccgaangaccaaa

SEQ ID NO: 12618 - RNA, 38 nt, Artificial Sequence
  Description of Artificial Sequence:  Enzymatic Nucleic Acid
  misc_feature (31)..(31): n stands for inosine
ucaugacucugaugaggccguuaggccgaanaaauaua

SEQ ID NO: 12619 - RNA, 38 nt, Artificial Sequence
  Description of Artificial Sequence:  Enzymatic Nucleic Acid
  misc_feature (31)..(31): n stands for inosine
auucaucacugaugaggccguuaggccgaanacuagaa

SEQ ID NO: 12620 - RNA, 38 nt, Artificial Sequence
  Description of Artificial Sequence:  Enzymatic Nucleic Acid
  misc_feature (31)..(31): n stands for inosine
augaagaucugaugaggccguuaggccgaanuauacaa

SEQ ID NO: 12621 - RNA, 38 nt, Artificial Sequence
  Description of Artificial Sequence:  Enzymatic Nucleic Acid
  misc_feature (31)..(31): n stands for inosine
uaugaagacugaugaggccguuaggccgaanguauaca

SEQ ID NO: 12622 - RNA, 38 nt, Artificial Sequence
  Description of Artificial Sequence:  Enzymatic Nucleic Acid
  misc_feature (31)..(31): n stands for inosine
uuauaugacugaugaggccguuaggccgaanaugguau

SEQ ID NO: 12623 - RNA, 38 nt, Artificial Sequence
  Description of Artificial Sequence:  Enzymatic Nucleic Acid
  misc_feature (31)..(31): n stands for inosine
auauuauacugaugaggccguuaggccgaanaagaugg

SEQ ID NO: 12624 - RNA, 38 nt, Artificial Sequence
  Description of Artificial Sequence:  Enzymatic Nucleic Acid
  misc_feature (31)..(31): n stands for inosine
uauuuuuacugaugaggccguuaggccgaanuauauua

SEQ ID NO: 12625 - RNA, 38 nt, Artificial Sequence
  Description of Artificial Sequence:  Enzymatic Nucleic Acid
  misc_feature (31)..(31): n stands for inosine
cccaauuacugaugaggccguuaggccgaanaaauauu

SEQ ID NO: 12626 - RNA, 38 nt, Artificial Sequence
  Description of Artificial Sequence:  Enzymatic Nucleic Acid
  misc_feature (31)..(31): n stands for inosine
auuaaguucugaugaggccguuaggccgaanuacgauu

SEQ ID NO: 12627 - RNA, 38 nt, Artificial Sequence
  Description of Artificial Sequence:  Enzymatic Nucleic Acid
  misc_feature (31)..(31): n stands for inosine
aauuaagucugaugaggccguuaggccgaanguacgau

SEQ ID NO: 12628 - RNA, 38 nt, Artificial Sequence
  Description of Artificial Sequence:  Enzymatic Nucleic Acid
  misc_feature (31)..(31): n stands for inosine
aucaauuacugaugaggccguuaggccgaanuugguac

SEQ ID NO: 12629 - RNA, 38 nt, Artificial Sequence
  Description of Artificial Sequence:  Enzymatic Nucleic Acid
  misc_feature (31)..(31): n stands for inosine
aguugccacugaugaggccguuaggccgaanuuuauca

SEQ ID NO: 12630 - RNA, 38 nt, Artificial Sequence
  Description of Artificial Sequence:  Enzymatic Nucleic Acid
  misc_feature (31)..(31): n stands for inosine
aaagcagucugaugaggccguuaggccgaanccaaguu

SEQ ID NO: 12631 - RNA, 38 nt, Artificial Sequence
  Description of Artificial Sequence:  Enzymatic Nucleic Acid
  misc_feature (31)..(31): n stands for inosine
auaaaagccugaugaggccguuaggccgaanuugccaa

SEQ ID NO: 12632 - RNA, 38 nt, Artificial Sequence
  Description of Artificial Sequence:  Enzymatic Nucleic Acid
  misc_feature (31)..(31): n stands for inosine
aacauaaacugaugaggccguuaggccgaancaguugc

SEQ ID NO: 12633 - RNA, 38 nt, Artificial Sequence
  Description of Artificial Sequence:  Enzymatic Nucleic Acid
  misc_feature (31)..(31): n stands for inosine
aaggagaccugaugaggccguuaggccgaanaacauaa

SEQ ID NO: 12634 - RNA, 38 nt, Artificial Sequence
  Description of Artificial Sequence:  Enzymatic Nucleic Acid
  misc_feature (31)..(31): n stands for inosine
auggaaggcugaugaggccguuaggccgaanacagaac

SEQ ID NO: 12635 - RNA, 38 nt, Artificial Sequence
  Description of Artificial Sequence:  Enzymatic Nucleic Acid
  misc_feature (31)..(31): n stands for inosine
uuauggaacugaugaggccguuaggccgaanagacaga

SEQ ID NO: 12636 - RNA, 38 nt, Artificial Sequence
  Description of Artificial Sequence:  Enzymatic Nucleic Acid
  misc_feature (31)..(31): n stands for inosine
uuuauggacugaugaggccguuaggccgaangagacag

SEQ ID NO: 12637 - RNA, 38 nt, Artificial Sequence
  Description of Artificial Sequence:  Enzymatic Nucleic Acid
  misc_feature (31)..(31): n stands for inosine
aaauuuaucugaugaggccguuaggccgaanaaggaga

SEQ ID NO: 12638 - RNA, 38 nt, Artificial Sequence
  Description of Artificial Sequence:  Enzymatic Nucleic Acid
  misc_feature (31)..(31): n stands for inosine
aaaauuuacugaugaggccguuaggccgaangaaggag

SEQ ID NO: 12639 - RNA, 38 nt, Artificial Sequence
  Description of Artificial Sequence:  Enzymatic Nucleic Acid
  misc_feature (31)..(31): n stands for inosine
uaguauuucugaugaggccguuaggccgaanaaaaauu

SEQ ID NO: 12640 - RNA, 38 nt, Artificial Sequence
  Description of Artificial Sequence:  Enzymatic Nucleic Acid
  misc_feature (31)..(31): n stands for inosine
guugaauucugaugaggccguuaggccgaanuauuuug

SEQ ID NO: 12641 - RNA, 38 nt, Artificial Sequence
  Description of Artificial Sequence:  Enzymatic Nucleic Acid
  misc_feature (31)..(31): n stands for inosine
uucuuugucugaugaggccguuaggccgaanaauuagu

SEQ ID NO: 12642 - RNA, 38 nt, Artificial Sequence
  Description of Artificial Sequence:  Enzymatic Nucleic Acid
  misc_feature (31)..(31): n stands for inosine
uuuuucuucugaugaggccguuaggccgaanuugaauu

SEQ ID NO: 12643 - RNA, 38 nt, Artificial Sequence
  Description of Artificial Sequence:  Enzymatic Nucleic Acid
  misc_feature (31)..(31): n stands for inosine
aaaaaaagcugaugaggccguuaggccgaancuuuuuc

SEQ ID NO: 12644 - RNA, 38 nt, Artificial Sequence
  Description of Artificial Sequence:  Enzymatic Nucleic Acid
  misc_feature (31)..(31): n stands for inosine
gaaaaaaacugaugaggccguuaggccgaanagcuuuu

SEQ ID NO: 12645 - RNA, 38 nt, Artificial Sequence
  Description of Artificial Sequence:  Enzymatic Nucleic Acid
  misc_feature (31)..(31): n stands for inosine
uuauuuuacugaugaggccguuaggccgaanaaaaaaa

SEQ ID NO: 12646 - RNA, 38 nt, Artificial Sequence
  Description of Artificial Sequence:  Enzymatic Nucleic Acid
  misc_feature (31)..(31): n stands for inosine
uuuauuuucugaugaggccguuaggccgaangaaaaaa

SEQ ID NO: 12647 - RNA, 38 nt, Artificial Sequence
  Description of Artificial Sequence:  Enzymatic Nucleic Acid
  misc_feature (31)..(31): n stands for inosine
uaaauuugcugaugaggccguuaggccgaanuuuauuu

SEQ ID NO: 12648 - RNA, 38 nt, Artificial Sequence
  Description of Artificial Sequence:  Enzymatic Nucleic Acid
  misc_feature (31)..(31): n stands for inosine
gauaaauucugaugaggccguuaggccgaanaguuuau

SEQ ID NO: 12649 - RNA, 38 nt, Artificial Sequence
  Description of Artificial Sequence:  Enzymatic Nucleic Acid
  misc_feature (31)..(31): n stands for inosine
cuaaacaacugaugaggccguuaggccgaanauaaauu

SEQ ID NO: 12650 - RNA, 38 nt, Artificial Sequence
  Description of Artificial Sequence:  Enzymatic Nucleic Acid
  misc_feature (31)..(31): n stands for inosine
ucuaaacacugaugaggccguuaggccgaangauaaau

SEQ ID NO: 12651 - RNA, 38 nt, Artificial Sequence
  Description of Artificial Sequence:  Enzymatic Nucleic Acid
  misc_feature (31)..(31): n stands for inosine
uuuuucuccugaugaggccguuaggccgaancucuaaa

SEQ ID NO: 12652 - RNA, 38 nt, Artificial Sequence
  Description of Artificial Sequence:  Enzymatic Nucleic Acid
  misc_feature (31)..(31): n stands for inosine
cauuucaacugaugaggccguuaggccgaanuuuuucu

SEQ ID NO: 12653 - RNA, 38 nt, Artificial Sequence
  Description of Artificial Sequence:  Enzymatic Nucleic Acid
  misc_feature (31)..(31): n stands for inosine
auuuuuugcugaugaggccguuaggccgaanaccauuu

SEQ ID NO: 12654 - RNA, 38 nt, Artificial Sequence
  Description of Artificial Sequence:  Enzymatic Nucleic Acid
  misc_feature (31)..(31): n stands for inosine
caauuuuucugaugaggccguuaggccgaanagaccau

SEQ ID NO: 12655 - RNA, 38 nt, Artificial Sequence
  Description of Artificial Sequence:  Enzymatic Nucleic Acid
  misc_feature (31)..(31): n stands for inosine
aaauauuucugaugaggccguuaggccgaancaauuuu

SEQ ID NO: 12656 - RNA, 38 nt, Artificial Sequence
  Description of Artificial Sequence:  Enzymatic Nucleic Acid
  misc_feature (31)..(31): n stands for inosine
uuuuccaucugaugaggccguuaggccgaanaaaauau

SEQ ID NO: 12657 - RNA, 38 nt, Artificial Sequence
  Description of Artificial Sequence:  Enzymatic Nucleic Acid
  misc_feature (31)..(31): n stands for inosine
uaacauuucugaugaggccguuaggccgaanuuuucca

SEQ ID NO: 12658 - RNA, 38 nt, Artificial Sequence
  Description of Artificial Sequence:  Enzymatic Nucleic Acid
  misc_feature (31)..(31): n stands for inosine
auacaauccugaugaggccguuaggccgaancuaaacu

SEQ ID NO: 12659 - RNA, 38 nt, Artificial Sequence
  Description of Artificial Sequence:  Enzymatic Nucleic Acid
  misc_feature (31)..(31): n stands for inosine
aagugaaacugaugaggccguuaggccgaanuucgaaa

SEQ ID NO: 12660 - RNA, 38 nt, Artificial Sequence
  Description of Artificial Sequence:  Enzymatic Nucleic Acid
  misc_feature (31)..(31): n stands for inosine
aaagugaacugaugaggccguuaggccgaanguucgaa

SEQ ID NO: 12661 - RNA, 38 nt, Artificial Sequence
  Description of Artificial Sequence:  Enzymatic Nucleic Acid
  misc_feature (31)..(31): n stands for inosine
acaaaaagcugaugaggccguuaggccgaanaaagguu

SEQ ID NO: 12662 - RNA, 38 nt, Artificial Sequence
  Description of Artificial Sequence:  Enzymatic Nucleic Acid
  misc_feature (31)..(31): n stands for inosine
aaacaaaacugaugaggccguuaggccgaanugaaagg

SEQ ID NO: 12663 - RNA, 38 nt, Artificial Sequence
  Description of Artificial Sequence:  Enzymatic Nucleic Acid
  misc_feature (31)..(31): n stands for inosine
gugaaauacugaugaggccguuaggccgaanuaaaaca

SEQ ID NO: 12664 - RNA, 38 nt, Artificial Sequence
  Description of Artificial Sequence:  Enzymatic Nucleic Acid
  misc_feature (31)..(31): n stands for inosine
ugugaaaucugaugaggccguuaggccgaanguaaaac

SEQ ID NO: 12665 - RNA, 38 nt, Artificial Sequence
  Description of Artificial Sequence:  Enzymatic Nucleic Acid
  misc_feature (31)..(31): n stands for inosine
cacaguugcugaugaggccguuaggccgaanaaauagg

SEQ ID NO: 12666 - RNA, 38 nt, Artificial Sequence
  Description of Artificial Sequence:  Enzymatic Nucleic Acid
  misc_feature (31)..(31): n stands for inosine
uacacagucugaugaggccguuaggccgaanugaaaua

SEQ ID NO: 12667 - RNA, 38 nt, Artificial Sequence
  Description of Artificial Sequence:  Enzymatic Nucleic Acid
  misc_feature (31)..(31): n stands for inosine
auuuacaccugaugaggccguuaggccgaanuugugaa

SEQ ID NO: 12668 - RNA, 38 nt, Artificial Sequence
  Description of Artificial Sequence:  Enzymatic Nucleic Acid
  misc_feature (31)..(31): n stands for inosine
gaauuauucugaugaggccguuaggccgaancaauuua

SEQ ID NO: 12669 - RNA, 38 nt, Artificial Sequence
  Description of Artificial Sequence:  Enzymatic Nucleic Acid
  misc_feature (31)..(31): n stands for inosine
ggaauuaucugaugaggccguuaggccgaangcaauuu

SEQ ID NO: 12670 - RNA, 38 nt, Artificial Sequence
  Description of Artificial Sequence:  Enzymatic Nucleic Acid
  misc_feature (31)..(31): n stands for inosine
cauggacacugaugaggccguuaggccgaanaauuauu

SEQ ID NO: 12671 - RNA, 38 nt, Artificial Sequence
  Description of Artificial Sequence:  Enzymatic Nucleic Acid
  misc_feature (31)..(31): n stands for inosine
ucauggaccugaugaggccguuaggccgaangaauuau

SEQ ID NO: 12672 - RNA, 38 nt, Artificial Sequence
  Description of Artificial Sequence:  Enzymatic Nucleic Acid
  misc_feature (31)..(31): n stands for inosine
auuuucaucugaugaggccguuaggccgaanacaggaa

SEQ ID NO: 12673 - RNA, 38 nt, Artificial Sequence
  Description of Artificial Sequence:  Enzymatic Nucleic Acid
  misc_feature (31)..(31): n stands for inosine
cauuuucacugaugaggccguuaggccgaangacagga

SEQ ID NO: 12674 - RNA, 38 nt, Artificial Sequence
  Description of Artificial Sequence:  Enzymatic Nucleic Acid
  misc_feature (31)..(31): n stands for inosine
ggauaauucugaugaggccguuaggccgaancauuuuc

SEQ ID NO: 12675 - RNA, 38 nt, Artificial Sequence
  Description of Artificial Sequence:  Enzymatic Nucleic Acid
  misc_feature (31)..(31): n stands for inosine
ucuacacucugaugaggccguuaggccgaanauaauuu

SEQ ID NO: 12676 - RNA, 38 nt, Artificial Sequence
  Description of Artificial Sequence:  Enzymatic Nucleic Acid
  misc_feature (31)..(31): n stands for inosine
aucuacaccugaugaggccguuaggccgaangauaauu

SEQ ID NO: 12677 - RNA, 38 nt, Artificial Sequence
  Description of Artificial Sequence:  Enzymatic Nucleic Acid
  misc_feature (31)..(31): n stands for inosine
agggugaucugaugaggccguuaggccgaanucaaaua

SEQ ID NO: 12678 - RNA, 38 nt, Artificial Sequence
  Description of Artificial Sequence:  Enzymatic Nucleic Acid
  misc_feature (31)..(31): n stands for inosine
uagggugacugaugaggccguuaggccgaangucaaau

SEQ ID NO: 12679 - RNA, 38 nt, Artificial Sequence
  Description of Artificial Sequence:  Enzymatic Nucleic Acid
  misc_feature (31)..(31): n stands for inosine
ccauagggcugaugaggccguuaggccgaanaugguca

SEQ ID NO: 12680 - RNA, 38 nt, Artificial Sequence
  Description of Artificial Sequence:  Enzymatic Nucleic Acid
  misc_feature (31)..(31): n stands for inosine
auccauagcugaugaggccguuaggccgaanugauggu

SEQ ID NO: 12681 - RNA, 38 nt, Artificial Sequence
  Description of Artificial Sequence:  Enzymatic Nucleic Acid
  misc_feature (31)..(31): n stands for inosine
uauccauacugaugaggccguuaggccgaangugaugg

SEQ ID NO: 12682 - RNA, 38 nt, Artificial Sequence
  Description of Artificial Sequence:  Enzymatic Nucleic Acid
  misc_feature (31)..(31): n stands for inosine
auauccaucugaugaggccguuaggccgaanggugaug

SEQ ID NO: 12683 - RNA, 38 nt, Artificial Sequence
  Description of Artificial Sequence:  Enzymatic Nucleic Acid
  misc_feature (31)..(31): n stands for inosine
gcaaaacucugaugaggccguuaggccgaanccaauau

SEQ ID NO: 12684 - RNA, 38 nt, Artificial Sequence
  Description of Artificial Sequence:  Enzymatic Nucleic Acid
  misc_feature (31)..(31): n stands for inosine
uuaauaaacugaugaggccguuaggccgaancaaaacu

SEQ ID NO: 12685 - RNA, 38 nt, Artificial Sequence
  Description of Artificial Sequence:  Enzymatic Nucleic Acid
  misc_feature (31)..(31): n stands for inosine
cuuaauaacugaugaggccguuaggccgaangcaaaac

SEQ ID NO: 12686 - RNA, 38 nt, Artificial Sequence
  Description of Artificial Sequence:  Enzymatic Nucleic Acid
  misc_feature (31)..(31): n stands for inosine
aaugaauucugaugaggccguuaggccgaancuuaaua

SEQ ID NO: 12687 - RNA, 38 nt, Artificial Sequence
  Description of Artificial Sequence:  Enzymatic Nucleic Acid
  misc_feature (31)..(31): n stands for inosine
ggcugaaacugaugaggccguuaggccgaanaauuugc

SEQ ID NO: 12688 - RNA, 38 nt, Artificial Sequence
  Description of Artificial Sequence:  Enzymatic Nucleic Acid
  misc_feature (31)..(31): n stands for inosine
auucaggccugaugaggccguuaggccgaanaaaugaa

SEQ ID NO: 12689 - RNA, 38 nt, Artificial Sequence
  Description of Artificial Sequence:  Enzymatic Nucleic Acid
  misc_feature (31)..(31): n stands for inosine
gacauucacugaugaggccguuaggccgaancugaaau

SEQ ID NO: 12690 - RNA, 38 nt, Artificial Sequence
  Description of Artificial Sequence:  Enzymatic Nucleic Acid
  misc_feature (31)..(31): n stands for inosine
agacauuccugaugaggccguuaggccgaangcugaaa

SEQ ID NO: 12691 - RNA, 38 nt, Artificial Sequence
  Description of Artificial Sequence:  Enzymatic Nucleic Acid
  misc_feature (31)..(31): n stands for inosine
auauaggccugaugaggccguuaggccgaanacauuca

SEQ ID NO: 12692 - RNA, 38 nt, Artificial Sequence
  Description of Artificial Sequence:  Enzymatic Nucleic Acid
  misc_feature (31)..(31): n stands for inosine
aauauauacugaugaggccguuaggccgaancagacau

SEQ ID NO: 12693 - RNA, 38 nt, Artificial Sequence
  Description of Artificial Sequence:  Enzymatic Nucleic Acid
  misc_feature (31)..(31): n stands for inosine
gaauauaucugaugaggccguuaggccgaangcagaca

SEQ ID NO: 12694 - RNA, 38 nt, Artificial Sequence
  Description of Artificial Sequence:  Enzymatic Nucleic Acid
  misc_feature (31)..(31): n stands for inosine
aagagcagcugaugaggccguuaggccgaanaauauau

SEQ ID NO: 12695 - RNA, 38 nt, Artificial Sequence
  Description of Artificial Sequence:  Enzymatic Nucleic Acid
  misc_feature (31)..(31): n stands for inosine
caaagagccugaugaggccguuaggccgaanagaauau

SEQ ID NO: 12696 - RNA, 38 nt, Artificial Sequence
  Description of Artificial Sequence:  Enzymatic Nucleic Acid
  misc_feature (31)..(31): n stands for inosine
auacaaagcugaugaggccguuaggccgaancagagaa

SEQ ID NO: 12697 - RNA, 38 nt, Artificial Sequence
  Description of Artificial Sequence:  Enzymatic Nucleic Acid
  misc_feature (31)..(31): n stands for inosine
gaauacaacugaugaggccguuaggccgaanagcagag

SEQ ID NO: 12698 - RNA, 38 nt, Artificial Sequence
  Description of Artificial Sequence:  Enzymatic Nucleic Acid
  misc_feature (31)..(31): n stands for inosine
uucaaaggcugaugaggccguuaggccgaanaauacaa

SEQ ID NO: 12699 - RNA, 38 nt, Artificial Sequence
  Description of Artificial Sequence:  Enzymatic Nucleic Acid
  misc_feature (31)..(31): n stands for inosine
gguucaaacugaugaggccguuaggccgaanagaauac

SEQ ID NO: 12700 - RNA, 38 nt, Artificial Sequence
  Description of Artificial Sequence:  Enzymatic Nucleic Acid
  misc_feature (31)..(31): n stands for inosine
ggguucaacugaugaggccguuaggccgaangagaaua

SEQ ID NO: 12701 - RNA, 38 nt, Artificial Sequence
  Description of Artificial Sequence:  Enzymatic Nucleic Acid
  misc_feature (31)..(31): n stands for inosine
uuuuaacgcugaugaggccguuaggccgaanuucaaag

SEQ ID NO: 12702 - RNA, 38 nt, Artificial Sequence
  Description of Artificial Sequence:  Enzymatic Nucleic Acid
  misc_feature (31)..(31): n stands for inosine
guuuuaaccugaugaggccguuaggccgaanguucaaa

SEQ ID NO: 12703 - RNA, 38 nt, Artificial Sequence
  Description of Artificial Sequence:  Enzymatic Nucleic Acid
  misc_feature (31)..(31): n stands for inosine
ccacaggacugaugaggccguuaggccgaanuuuuaac

SEQ ID NO: 12704 - RNA, 38 nt, Artificial Sequence
  Description of Artificial Sequence:  Enzymatic Nucleic Acid
  misc_feature (31)..(31): n stands for inosine
gugccacacugaugaggccguuaggccgaanauguuuu

SEQ ID NO: 12705 - RNA, 38 nt, Artificial Sequence
  Description of Artificial Sequence:  Enzymatic Nucleic Acid
  misc_feature (31)..(31): n stands for inosine
agugccaccugaugaggccguuaggccgaangauguuu

SEQ ID NO: 12706 - RNA, 36 nt, Artificial Sequence
  Description of Artificial Sequence:  Enzymatic Nucleic Acid
cgcugugauggcaugcacuaugcgcgacccgagccc

SEQ ID NO: 12707 - RNA, 36 nt, Artificial Sequence
  Description of Artificial Sequence:  Enzymatic Nucleic Acid
auccuugauggcaugcacuaugcgcggccgccaggc

SEQ ID NO: 12708 - RNA, 36 nt, Artificial Sequence
  Description of Artificial Sequence:  Enzymatic Nucleic Acid
ggagaugauggcaugcacuaugcgcgaaccacuucc

SEQ ID NO: 12709 - RNA, 36 nt, Artificial Sequence
  Description of Artificial Sequence:  Enzymatic Nucleic Acid
ucucgugauggcaugcacuaugcgcgggcuccagcc

SEQ ID NO: 12710 - RNA, 36 nt, Artificial Sequence
  Description of Artificial Sequence:  Enzymatic Nucleic Acid
cgucuugauggcaugcacuaugcgcggcggcuccag

SEQ ID NO: 12711 - RNA, 36 nt, Artificial Sequence
  Description of Artificial Sequence:  Enzymatic Nucleic Acid
cugagugauggcaugcacuaugcgcggcccgucucg

SEQ ID NO: 12712 - RNA, 36 nt, Artificial Sequence
  Description of Artificial Sequence:  Enzymatic Nucleic Acid
ccccgugauggcaugcacuaugcgcggcccugagcg

SEQ ID NO: 12713 - RNA, 36 nt, Artificial Sequence
  Description of Artificial Sequence:  Enzymatic Nucleic Acid
ucguuugauggcaugcacuaugcgcggccgccgccg

SEQ ID NO: 12714 - RNA, 36 nt, Artificial Sequence
  Description of Artificial Sequence:  Enzymatic Nucleic Acid
ccucuugauggcaugcacuaugcgcgguucgccgcc

SEQ ID NO: 12715 - RNA, 36 nt, Artificial Sequence
  Description of Artificial Sequence:  Enzymatic Nucleic Acid
gcccgugauggcaugcacuaugcgcggcucccccgg

SEQ ID NO: 12716 - RNA, 36 nt, Artificial Sequence
  Description of Artificial Sequence:  Enzymatic Nucleic Acid
cugcuugauggcaugcacuaugcgcggcccggugcc

SEQ ID NO: 12717 - RNA, 36 nt, Artificial Sequence
  Description of Artificial Sequence:  Enzymatic Nucleic Acid
cgacgugauggcaugcacuaugcgcgggccugcucg

SEQ ID NO: 12718 - RNA, 36 nt, Artificial Sequence
  Description of Artificial Sequence:  Enzymatic Nucleic Acid
gagcgugauggcaugcacuaugcgcggacgcggccu

SEQ ID NO: 12719 - RNA, 36 nt, Artificial Sequence
  Description of Artificial Sequence:  Enzymatic Nucleic Acid
gugagugauggcaugcacuaugcgcggcgacgcggc

SEQ ID NO: 12720 - RNA, 36 nt, Artificial Sequence
  Description of Artificial Sequence:  Enzymatic Nucleic Acid
cacagugauggcaugcacuaugcgcgaggaccccgg

SEQ ID NO: 12721 - RNA, 36 nt, Artificial Sequence
  Description of Artificial Sequence:  Enzymatic Nucleic Acid
gcgcaugauggcaugcacuaugcgcgagcaggaccc

SEQ ID NO: 12722 - RNA, 36 nt, Artificial Sequence
  Description of Artificial Sequence:  Enzymatic Nucleic Acid
gcgcgugauggcaugcacuaugcgcgacagcaggac

SEQ ID NO: 12723 - RNA, 36 nt, Artificial Sequence
  Description of Artificial Sequence:  Enzymatic Nucleic Acid
cagcgugauggcaugcacuaugcgcggcacagcagg

SEQ ID NO: 12724 - RNA, 36 nt, Artificial Sequence
  Description of Artificial Sequence:  Enzymatic Nucleic Acid
agcagugauggcaugcacuaugcgcggcgcacagca

SEQ ID NO: 12725 - RNA, 36 nt, Artificial Sequence
  Description of Artificial Sequence:  Enzymatic Nucleic Acid
cugagugauggcaugcacuaugcgcgagcgcgcaca

SEQ ID NO: 12726 - RNA, 36 nt, Artificial Sequence
  Description of Artificial Sequence:  Enzymatic Nucleic Acid
gcagaugauggcaugcacuaugcgcgagcugagcag

SEQ ID NO: 12727 - RNA, 36 nt, Artificial Sequence
  Description of Artificial Sequence:  Enzymatic Nucleic Acid
agaagugauggcaugcacuaugcgcgagacagcuga

SEQ ID NO: 12728 - RNA, 36 nt, Artificial Sequence
  Description of Artificial Sequence:  Enzymatic Nucleic Acid
caguuugauggcaugcacuaugcgcgaggaucuuuu

SEQ ID NO: 12729 - RNA, 36 nt, Artificial Sequence
  Description of Artificial Sequence:  Enzymatic Nucleic Acid
aaacuugauggcaugcacuaugcgcgaguucaggau

SEQ ID NO: 12730 - RNA, 36 nt, Artificial Sequence
  Description of Artificial Sequence:  Enzymatic Nucleic Acid
gcuugugauggcaugcacuaugcgcgaugaugugcu

SEQ ID NO: 12731 - RNA, 36 nt, Artificial Sequence
  Description of Artificial Sequence:  Enzymatic Nucleic Acid
agaugugauggcaugcacuaugcgcgagugucuggc

SEQ ID NO: 12732 - RNA, 36 nt, Artificial Sequence
  Description of Artificial Sequence:  Enzymatic Nucleic Acid
cccugugauggcaugcacuaugcgcgauuggagaug

SEQ ID NO: 12733 - RNA, 36 nt, Artificial Sequence
  Description of Artificial Sequence:  Enzymatic Nucleic Acid
ucaggugauggcaugcacuaugcgcgaaagaccauu

SEQ ID NO: 12734 - RNA, 36 nt, Artificial Sequence
  Description of Artificial Sequence:  Enzymatic Nucleic Acid
cauuuugauggcaugcacuaugcgcgaggcaaagac

SEQ ID NO: 12735 - RNA, 36 nt, Artificial Sequence
  Description of Artificial Sequence:  Enzymatic Nucleic Acid
uuacuugauggcaugcacuaugcgcgaccauuucag

SEQ ID NO: 12736 - RNA, 36 nt, Artificial Sequence
  Description of Artificial Sequence:  Enzymatic Nucleic Acid
ccuuuugauggcaugcacuaugcgcggcuuuccuua

SEQ ID NO: 12737 - RNA, 36 nt, Artificial Sequence
  Description of Artificial Sequence:  Enzymatic Nucleic Acid
augcuugauggcaugcacuaugcgcgagccuuucgc

SEQ ID NO: 12738 - RNA, 36 nt, Artificial Sequence
  Description of Artificial Sequence:  Enzymatic Nucleic Acid
acaggugauggcaugcacuaugcgcgagauuuaguu

SEQ ID NO: 12739 - RNA, 36 nt, Artificial Sequence
  Description of Artificial Sequence:  Enzymatic Nucleic Acid
uuccaugauggcaugcacuaugcgcgaggcagauuu

SEQ ID NO: 12740 - RNA, 36 nt, Artificial Sequence
  Description of Artificial Sequence:  Enzymatic Nucleic Acid
uacugugauggcaugcacuaugcgcgagaauuguuu

SEQ ID NO: 12741 - RNA, 36 nt, Artificial Sequence
  Description of Artificial Sequence:  Enzymatic Nucleic Acid
guguuugauggcaugcacuaugcgcgaagguuaaag

SEQ ID NO: 12742 - RNA, 36 nt, Artificial Sequence
  Description of Artificial Sequence:  Enzymatic Nucleic Acid
auuugugauggcaugcacuaugcgcgagcuguagaa

SEQ ID NO: 12743 - RNA, 36 nt, Artificial Sequence
  Description of Artificial Sequence:  Enzymatic Nucleic Acid
agguaugauggcaugcacuaugcgcgagcuagauau

SEQ ID NO: 12744 - RNA, 36 nt, Artificial Sequence
  Description of Artificial Sequence:  Enzymatic Nucleic Acid
gauugugauggcaugcacuaugcgcgagauucuguu

SEQ ID NO: 12745 - RNA, 36 nt, Artificial Sequence
  Description of Artificial Sequence:  Enzymatic Nucleic Acid
uguauugauggcaugcacuaugcgcgacuaauaaau

SEQ ID NO: 12746 - RNA, 36 nt, Artificial Sequence
  Description of Artificial Sequence:  Enzymatic Nucleic Acid
cuguaugauggcaugcacuaugcgcgaucucuacga

SEQ ID NO: 12747 - RNA, 36 nt, Artificial Sequence
  Description of Artificial Sequence:  Enzymatic Nucleic Acid
gauuuugauggcaugcacuaugcgcgacuguacauc

SEQ ID NO: 12748 - RNA, 36 nt, Artificial Sequence
  Description of Artificial Sequence:  Enzymatic Nucleic Acid
aauuuugauggcaugcacuaugcgcgggggauuuca

SEQ ID NO: 12749 - RNA, 36 nt, Artificial Sequence
  Description of Artificial Sequence:  Enzymatic Nucleic Acid
ucaguugauggcaugcacuaugcgcgauguguauaa

SEQ ID NO: 12750 - RNA, 36 nt, Artificial Sequence
  Description of Artificial Sequence:  Enzymatic Nucleic Acid
uccuuugauggcaugcacuaugcgcgagucaugugu

SEQ ID NO: 12751 - RNA, 36 nt, Artificial Sequence
  Description of Artificial Sequence:  Enzymatic Nucleic Acid
cccggugauggcaugcacuaugcgcgagggaaugac

SEQ ID NO: 12752 - RNA, 36 nt, Artificial Sequence
  Description of Artificial Sequence:  Enzymatic Nucleic Acid
aguaaugauggcaugcacuaugcgcgagugauguua

SEQ ID NO: 12753 - RNA, 36 nt, Artificial Sequence
  Description of Artificial Sequence:  Enzymatic Nucleic Acid
aguguugauggcaugcacuaugcgcgaaguggaaac

SEQ ID NO: 12754 - RNA, 36 nt, Artificial Sequence
  Description of Artificial Sequence:  Enzymatic Nucleic Acid
gggauugauggcaugcacuaugcgcgaaagugucaa

SEQ ID NO: 12755 - RNA, 36 nt, Artificial Sequence
  Description of Artificial Sequence:  Enzymatic Nucleic Acid
uccauugauggcaugcacuaugcgcgagggaucaaa

SEQ ID NO: 12756 - RNA, 36 nt, Artificial Sequence
  Description of Artificial Sequence:  Enzymatic Nucleic Acid
uuaugugauggcaugcacuaugcgcgguuuuccauc

SEQ ID NO: 12757 - RNA, 36 nt, Artificial Sequence
  Description of Artificial Sequence:  Enzymatic Nucleic Acid
cguugugauggcaugcacuaugcgcgauuugauaug

SEQ ID NO: 12758 - RNA, 36 nt, Artificial Sequence
  Description of Artificial Sequence:  Enzymatic Nucleic Acid
cagguugauggcaugcacuaugcgcgagaagcccua

SEQ ID NO: 12759 - RNA, 36 nt, Artificial Sequence
  Description of Artificial Sequence:  Enzymatic Nucleic Acid
cuucaugauggcaugcacuaugcgcgaggucagaag

SEQ ID NO: 12760 - RNA, 36 nt, Artificial Sequence
  Description of Artificial Sequence:  Enzymatic Nucleic Acid
ugcuuugauggcaugcacuaugcgcgacaggucaga

SEQ ID NO: 12761 - RNA, 36 nt, Artificial Sequence
  Description of Artificial Sequence:  Enzymatic Nucleic Acid
uuauaugauggcaugcacuaugcgcgaaaugcccau

SEQ ID NO: 12762 - RNA, 36 nt, Artificial Sequence
  Description of Artificial Sequence:  Enzymatic Nucleic Acid
uuuguugauggcaugcacuaugcgcggaugugugag

SEQ ID NO: 12763 - RNA, 36 nt, Artificial Sequence
  Description of Artificial Sequence:  Enzymatic Nucleic Acid
uuggaugauggcaugcacuaugcgcgaucuaugauu

SEQ ID NO: 12764 - RNA, 36 nt, Artificial Sequence
  Description of Artificial Sequence:  Enzymatic Nucleic Acid
cugggugauggcaugcacuaugcgcgguggugugcu

SEQ ID NO: 12765 - RNA, 36 nt, Artificial Sequence
  Description of Artificial Sequence:  Enzymatic Nucleic Acid
gaggaugauggcaugcacuaugcgcgaagaguaugg

SEQ ID NO: 12766 - RNA, 36 nt, Artificial Sequence
  Description of Artificial Sequence:  Enzymatic Nucleic Acid
caguaugauggcaugcacuaugcgcgaauugaggac

SEQ ID NO: 12767 - RNA, 36 nt, Artificial Sequence
  Description of Artificial Sequence:  Enzymatic Nucleic Acid
gguagugauggcaugcacuaugcgcgaguacaauug

SEQ ID NO: 12768 - RNA, 36 nt, Artificial Sequence
  Description of Artificial Sequence:  Enzymatic Nucleic Acid
guguuugauggcaugcacuaugcgcgaagggagugg

SEQ ID NO: 12769 - RNA, 36 nt, Artificial Sequence
  Description of Artificial Sequence:  Enzymatic Nucleic Acid
acucuugauggcaugcacuaugcgcgguguucaagg

SEQ ID NO: 12770 - RNA, 36 nt, Artificial Sequence
  Description of Artificial Sequence:  Enzymatic Nucleic Acid
cagguugauggcaugcacuaugcgcgauuugaacuc

SEQ ID NO: 12771 - RNA, 36 nt, Artificial Sequence
  Description of Artificial Sequence:  Enzymatic Nucleic Acid
uucauugauggcaugcacuaugcgcgaggguaacuc

SEQ ID NO: 12772 - RNA, 36 nt, Artificial Sequence
  Description of Artificial Sequence:  Enzymatic Nucleic Acid
uuuuuugauggcaugcacuaugcgcgaucaggguaa

SEQ ID NO: 12773 - RNA, 36 nt, Artificial Sequence
  Description of Artificial Sequence:  Enzymatic Nucleic Acid
uucguugauggcaugcacuaugcgcggccuuacgga

SEQ ID NO: 12774 - RNA, 36 nt, Artificial Sequence
  Description of Artificial Sequence:  Enzymatic Nucleic Acid
caauuugauggcaugcacuaugcgcggucgccuuac

SEQ ID NO: 12775 - RNA, 36 nt, Artificial Sequence
  Description of Artificial Sequence:  Enzymatic Nucleic Acid
uugguugauggcaugcacuaugcgcgaauucgucgc

SEQ ID NO: 12776 - RNA, 36 nt, Artificial Sequence
  Description of Artificial Sequence:  Enzymatic Nucleic Acid
guuggugauggcaugcacuaugcgcgaugggaauug

SEQ ID NO: 12777 - RNA, 36 nt, Artificial Sequence
  Description of Artificial Sequence:  Enzymatic Nucleic Acid
aagaaugauggcaugcacuaugcgcgacuguagaau

SEQ ID NO: 12778 - RNA, 36 nt, Artificial Sequence
  Description of Artificial Sequence:  Enzymatic Nucleic Acid
uuuguugauggcaugcacuaugcgcgaauaguaaga

SEQ ID NO: 12779 - RNA, 36 nt, Artificial Sequence
  Description of Artificial Sequence:  Enzymatic Nucleic Acid
uucugugauggcaugcacuaugcgcgauuuugucaa

SEQ ID NO: 12780 - RNA, 36 nt, Artificial Sequence
  Description of Artificial Sequence:  Enzymatic Nucleic Acid
cacgaugauggcaugcacuaugcgcgaaguauaaag

SEQ ID NO: 12781 - RNA, 36 nt, Artificial Sequence
  Description of Artificial Sequence:  Enzymatic Nucleic Acid
ccuuaugauggcaugcacuaugcgcgacgacaagua

SEQ ID NO: 12782 - RNA, 36 nt, Artificial Sequence
  Description of Artificial Sequence:  Enzymatic Nucleic Acid
guuaaugauggcaugcacuaugcgcgagauuugaau

SEQ ID NO: 12783 - RNA, 36 nt, Artificial Sequence
  Description of Artificial Sequence:  Enzymatic Nucleic Acid
auaugugauggcaugcacuaugcgcgacugaggugu

SEQ ID NO: 12784 - RNA, 36 nt, Artificial Sequence
  Description of Artificial Sequence:  Enzymatic Nucleic Acid
uuuauugauggcaugcacuaugcgcgauauauaugc

SEQ ID NO: 12785 - RNA, 36 nt, Artificial Sequence
  Description of Artificial Sequence:  Enzymatic Nucleic Acid
uuucaugauggcaugcacuaugcgcgagugaugaau

SEQ ID NO: 12786 - RNA, 36 nt, Artificial Sequence
  Description of Artificial Sequence:  Enzymatic Nucleic Acid
uguuuugauggcaugcacuaugcgcgacagugauga

SEQ ID NO: 12787 - RNA, 36 nt, Artificial Sequence
  Description of Artificial Sequence:  Enzymatic Nucleic Acid
guuuuugauggcaugcacuaugcgcggauguuucac

SEQ ID NO: 12788 - RNA, 36 nt, Artificial Sequence
  Description of Artificial Sequence:  Enzymatic Nucleic Acid
ucaagugauggcaugcacuaugcgcgaccugcuguu

SEQ ID NO: 12789 - RNA, 36 nt, Artificial Sequence
  Description of Artificial Sequence:  Enzymatic Nucleic Acid
gguuuugauggcaugcacuaugcgcgaagcaccugc

SEQ ID NO: 12790 - RNA, 36 nt, Artificial Sequence
  Description of Artificial Sequence:  Enzymatic Nucleic Acid
acuuuugauggcaugcacuaugcgcgauagagagcc

SEQ ID NO: 12791 - RNA, 36 nt, Artificial Sequence
  Description of Artificial Sequence:  Enzymatic Nucleic Acid
gccuuugauggcaugcacuaugcgcgacuuucauag

SEQ ID NO: 12792 - RNA, 36 nt, Artificial Sequence
  Description of Artificial Sequence:  Enzymatic Nucleic Acid
uccggugauggcaugcacuaugcgcggagggaaaug

SEQ ID NO: 12793 - RNA, 36 nt, Artificial Sequence
  Description of Artificial Sequence:  Enzymatic Nucleic Acid
ccauaugauggcaugcacuaugcgcgaacuuccggc

SEQ ID NO: 12794 - RNA, 36 nt, Artificial Sequence
  Description of Artificial Sequence:  Enzymatic Nucleic Acid
agucgugauggcaugcacuaugcgcgagguaaccca

SEQ ID NO: 12795 - RNA, 36 nt, Artificial Sequence
  Description of Artificial Sequence:  Enzymatic Nucleic Acid
ucaguugauggcaugcacuaugcgcggcagguaacc

SEQ ID NO: 12796 - RNA, 36 nt, Artificial Sequence
  Description of Artificial Sequence:  Enzymatic Nucleic Acid
uuucuugauggcaugcacuaugcgcgagucgcaggu

SEQ ID NO: 12797 - RNA, 36 nt, Artificial Sequence
  Description of Artificial Sequence:  Enzymatic Nucleic Acid
gcgagugauggcaugcacuaugcgcgagauuucuca

SEQ ID NO: 12798 - RNA, 36 nt, Artificial Sequence
  Description of Artificial Sequence:  Enzymatic Nucleic Acid
aauagugauggcaugcacuaugcgcggagcagauuu

SEQ ID NO: 12799 - RNA, 36 nt, Artificial Sequence
  Description of Artificial Sequence:  Enzymatic Nucleic Acid
cgaguugauggcaugcacuaugcgcgaaauagcgag

SEQ ID NO: 12800 - RNA, 36 nt, Artificial Sequence
  Description of Artificial Sequence:  Enzymatic Nucleic Acid
cucuuugauggcaugcacuaugcgcgaguuacgucc

SEQ ID NO: 12801 - RNA, 36 nt, Artificial Sequence
  Description of Artificial Sequence:  Enzymatic Nucleic Acid
cccugugauggcaugcacuaugcgcgauccucuuca

SEQ ID NO: 12802 - RNA, 36 nt, Artificial Sequence
  Description of Artificial Sequence:  Enzymatic Nucleic Acid
cucagugauggcaugcacuaugcgcgaagauuguau

SEQ ID NO: 12803 - RNA, 36 nt, Artificial Sequence
  Description of Artificial Sequence:  Enzymatic Nucleic Acid
augcuugauggcaugcacuaugcgcgagcaagauug

SEQ ID NO: 12804 - RNA, 36 nt, Artificial Sequence
  Description of Artificial Sequence:  Enzymatic Nucleic Acid
aaacaugauggcaugcacuaugcgcgauuugacugu

SEQ ID NO: 12805 - RNA, 36 nt, Artificial Sequence
  Description of Artificial Sequence:  Enzymatic Nucleic Acid
uuaaaugauggcaugcacuaugcgcgacauuugacu

SEQ ID NO: 12806 - RNA, 36 nt, Artificial Sequence
  Description of Artificial Sequence:  Enzymatic Nucleic Acid
aguggugauggcaugcacuaugcgcgagugagguuu

SEQ ID NO: 12807 - RNA, 36 nt, Artificial Sequence
  Description of Artificial Sequence:  Enzymatic Nucleic Acid
auugaugauggcaugcacuaugcgcgaauuagagug

SEQ ID NO: 12808 - RNA, 36 nt, Artificial Sequence
  Description of Artificial Sequence:  Enzymatic Nucleic Acid
uuucaugauggcaugcacuaugcgcgauugacaauu

SEQ ID NO: 12809 - RNA, 36 nt, Artificial Sequence
  Description of Artificial Sequence:  Enzymatic Nucleic Acid
gguuuugauggcaugcacuaugcgcgacauugacaa

SEQ ID NO: 12810 - RNA, 36 nt, Artificial Sequence
  Description of Artificial Sequence:  Enzymatic Nucleic Acid
cuuuuugauggcaugcacuaugcgcgguaaaucugg

SEQ ID NO: 12811 - RNA, 36 nt, Artificial Sequence
  Description of Artificial Sequence:  Enzymatic Nucleic Acid
gaugaugauggcaugcacuaugcgcgacggccuuuu

SEQ ID NO: 12812 - RNA, 36 nt, Artificial Sequence
  Description of Artificial Sequence:  Enzymatic Nucleic Acid
caaguugauggcaugcacuaugcgcgaggauuuguc

SEQ ID NO: 12813 - RNA, 36 nt, Artificial Sequence
  Description of Artificial Sequence:  Enzymatic Nucleic Acid
cgguaugauggcaugcacuaugcgcgaagucaggau

SEQ ID NO: 12814 - RNA, 36 nt, Artificial Sequence
  Description of Artificial Sequence:  Enzymatic Nucleic Acid
auaugugauggcaugcacuaugcgcggguacaaguc

SEQ ID NO: 12815 - RNA, 36 nt, Artificial Sequence
  Description of Artificial Sequence:  Enzymatic Nucleic Acid
gguuaugauggcaugcacuaugcgcgaggggugcca

SEQ ID NO: 12816 - RNA, 36 nt, Artificial Sequence
  Description of Artificial Sequence:  Enzymatic Nucleic Acid
ugcuuugauggcaugcacuaugcgcgggaaugauua

SEQ ID NO: 12817 - RNA, 36 nt, Artificial Sequence
  Description of Artificial Sequence:  Enzymatic Nucleic Acid
agucaugauggcaugcacuaugcgcgaccuugcuuc

SEQ ID NO: 12818 - RNA, 36 nt, Artificial Sequence
  Description of Artificial Sequence:  Enzymatic Nucleic Acid
aaaguugauggcaugcacuaugcgcgacaccuugcu

SEQ ID NO: 12819 - RNA, 36 nt, Artificial Sequence
  Description of Artificial Sequence:  Enzymatic Nucleic Acid
uggaaugauggcaugcacuaugcgcgaaaagucaca

SEQ ID NO: 12820 - RNA, 36 nt, Artificial Sequence
  Description of Artificial Sequence:  Enzymatic Nucleic Acid
cucuuugauggcaugcacuaugcgcgauuauuggaa

SEQ ID NO: 12821 - RNA, 36 nt, Artificial Sequence
  Description of Artificial Sequence:  Enzymatic Nucleic Acid
gucagugauggcaugcacuaugcgcgauccaggaua

SEQ ID NO: 12822 - RNA, 36 nt, Artificial Sequence
  Description of Artificial Sequence:  Enzymatic Nucleic Acid
gcuguugauggcaugcacuaugcgcgagcauccagg

SEQ ID NO: 12823 - RNA, 36 nt, Artificial Sequence
  Description of Artificial Sequence:  Enzymatic Nucleic Acid
gcucuugauggcaugcacuaugcgcgaauucuguuu

SEQ ID NO: 12824 - RNA, 36 nt, Artificial Sequence
  Description of Artificial Sequence:  Enzymatic Nucleic Acid
ccaugugauggcaugcacuaugcgcggcugagugau

SEQ ID NO: 12825 - RNA, 36 nt, Artificial Sequence
  Description of Artificial Sequence:  Enzymatic Nucleic Acid
agccaugauggcaugcacuaugcgcgaaccaaggug

SEQ ID NO: 12826 - RNA, 36 nt, Artificial Sequence
  Description of Artificial Sequence:  Enzymatic Nucleic Acid
agaguugauggcaugcacuaugcgcgagccacaacc

SEQ ID NO: 12827 - RNA, 36 nt, Artificial Sequence
  Description of Artificial Sequence:  Enzymatic Nucleic Acid
cuaugugauggcaugcacuaugcgcgaaauguagau

SEQ ID NO: 12828 - RNA, 36 nt, Artificial Sequence
  Description of Artificial Sequence:  Enzymatic Nucleic Acid
ucccaugauggcaugcacuaugcgcgagucccaacu

SEQ ID NO: 12829 - RNA, 36 nt, Artificial Sequence
  Description of Artificial Sequence:  Enzymatic Nucleic Acid
uggcaugauggcaugcacuaugcgcgaucugugaua

SEQ ID NO: 12830 - RNA, 36 nt, Artificial Sequence
  Description of Artificial Sequence:  Enzymatic Nucleic Acid
uuuggugauggcaugcacuaugcgcgacaucuguga

SEQ ID NO: 12831 - RNA, 36 nt, Artificial Sequence
  Description of Artificial Sequence:  Enzymatic Nucleic Acid
guuaaugauggcaugcacuaugcgcgaugaaaccca

SEQ ID NO: 12832 - RNA, 36 nt, Artificial Sequence
  Description of Artificial Sequence:  Enzymatic Nucleic Acid
gucggugauggcaugcacuaugcgcgauuuuuucca

SEQ ID NO: 12833 - RNA, 36 nt, Artificial Sequence
  Description of Artificial Sequence:  Enzymatic Nucleic Acid
uccguugauggcaugcacuaugcgcgggcauuuuuu

SEQ ID NO: 12834 - RNA, 36 nt, Artificial Sequence
  Description of Artificial Sequence:  Enzymatic Nucleic Acid
aguuuugauggcaugcacuaugcgcgagguccucuc

SEQ ID NO: 12835 - RNA, 36 nt, Artificial Sequence
  Description of Artificial Sequence:  Enzymatic Nucleic Acid
caagaugauggcaugcacuaugcgcgaguuucaggu

SEQ ID NO: 12836 - RNA, 36 nt, Artificial Sequence
  Description of Artificial Sequence:  Enzymatic Nucleic Acid
cugugugauggcaugcacuaugcgcgaagacaguuu

SEQ ID NO: 12837 - RNA, 36 nt, Artificial Sequence
  Description of Artificial Sequence:  Enzymatic Nucleic Acid
guccgugauggcaugcacuaugcgcgaguaaaaucc

SEQ ID NO: 12838 - RNA, 36 nt, Artificial Sequence
  Description of Artificial Sequence:  Enzymatic Nucleic Acid
uagugugauggcaugcacuaugcgcgauuguucugu

SEQ ID NO: 12839 - RNA, 36 nt, Artificial Sequence
  Description of Artificial Sequence:  Enzymatic Nucleic Acid
acauuugauggcaugcacuaugcgcgaugaugguaa

SEQ ID NO: 12840 - RNA, 36 nt, Artificial Sequence
  Description of Artificial Sequence:  Enzymatic Nucleic Acid
ggaaaugauggcaugcacuaugcgcgauucaugaug

SEQ ID NO: 12841 - RNA, 36 nt, Artificial Sequence
  Description of Artificial Sequence:  Enzymatic Nucleic Acid
ucuugugauggcaugcacuaugcgcgagggaaacau

SEQ ID NO: 12842 - RNA, 36 nt, Artificial Sequence
  Description of Artificial Sequence:  Enzymatic Nucleic Acid
gcaggugauggcaugcacuaugcgcgauaggugccu

SEQ ID NO: 12843 - RNA, 36 nt, Artificial Sequence
  Description of Artificial Sequence:  Enzymatic Nucleic Acid
cucugugauggcaugcacuaugcgcgaggcauaggu

SEQ ID NO: 12844 - RNA, 36 nt, Artificial Sequence
  Description of Artificial Sequence:  Enzymatic Nucleic Acid
guauaugauggcaugcacuaugcgcgauuccuggcu

SEQ ID NO: 12845 - RNA, 36 nt, Artificial Sequence
  Description of Artificial Sequence:  Enzymatic Nucleic Acid
uuucgugauggcaugcacuaugcgcgaggagguaug

SEQ ID NO: 12846 - RNA, 36 nt, Artificial Sequence
  Description of Artificial Sequence:  Enzymatic Nucleic Acid
gguuuugauggcaugcacuaugcgcggcaggaggua

SEQ ID NO: 12847 - RNA, 36 nt, Artificial Sequence
  Description of Artificial Sequence:  Enzymatic Nucleic Acid
gugauugauggcaugcacuaugcgcgacugagguuu

SEQ ID NO: 12848 - RNA, 36 nt, Artificial Sequence
  Description of Artificial Sequence:  Enzymatic Nucleic Acid
caugaugauggcaugcacuaugcgcgagucuaaagu

SEQ ID NO: 12849 - RNA, 36 nt, Artificial Sequence
  Description of Artificial Sequence:  Enzymatic Nucleic Acid
auuagugauggcaugcacuaugcgcgaugacagucu

SEQ ID NO: 12850 - RNA, 36 nt, Artificial Sequence
  Description of Artificial Sequence:  Enzymatic Nucleic Acid
ggggaugauggcaugcacuaugcgcgaccauuagca

SEQ ID NO: 12851 - RNA, 36 nt, Artificial Sequence
  Description of Artificial Sequence:  Enzymatic Nucleic Acid
aggcuugauggcaugcacuaugcgcgggggacacca

SEQ ID NO: 12852 - RNA, 36 nt, Artificial Sequence
  Description of Artificial Sequence:  Enzymatic Nucleic Acid
aacagugauggcaugcacuaugcgcggugcugcuuc

SEQ ID NO: 12853 - RNA, 36 nt, Artificial Sequence
  Description of Artificial Sequence:  Enzymatic Nucleic Acid
auaaaugauggcaugcacuaugcgcgagcgugcugc

SEQ ID NO: 12854 - RNA, 36 nt, Artificial Sequence
  Description of Artificial Sequence:  Enzymatic Nucleic Acid
ucuuuugauggcaugcacuaugcgcgaauaaacagc

SEQ ID NO: 12855 - RNA, 36 nt, Artificial Sequence
  Description of Artificial Sequence:  Enzymatic Nucleic Acid
accuuugauggcaugcacuaugcgcgauccucuucu

SEQ ID NO: 12856 - RNA, 36 nt, Artificial Sequence
  Description of Artificial Sequence:  Enzymatic Nucleic Acid
auagaugauggcaugcacuaugcgcgaccuucaucc

SEQ ID NO: 12857 - RNA, 36 nt, Artificial Sequence
  Description of Artificial Sequence:  Enzymatic Nucleic Acid
cuuugugauggcaugcacuaugcgcgagugauagac

SEQ ID NO: 12858 - RNA, 36 nt, Artificial Sequence
  Description of Artificial Sequence:  Enzymatic Nucleic Acid
uuccaugauggcaugcacuaugcgcgagagcccuuc

SEQ ID NO: 12859 - RNA, 36 nt, Artificial Sequence
  Description of Artificial Sequence:  Enzymatic Nucleic Acid
uugaaugauggcaugcacuaugcgcgagugagguau

SEQ ID NO: 12860 - RNA, 36 nt, Artificial Sequence
  Description of Artificial Sequence:  Enzymatic Nucleic Acid
gugauugauggcaugcacuaugcgcgagcuccagau

SEQ ID NO: 12861 - RNA, 36 nt, Artificial Sequence
  Description of Artificial Sequence:  Enzymatic Nucleic Acid
aggugugauggcaugcacuaugcgcgauguuagagu

SEQ ID NO: 12862 - RNA, 36 nt, Artificial Sequence
  Description of Artificial Sequence:  Enzymatic Nucleic Acid
ccacaugauggcaugcacuaugcgcgaggugcaugu

SEQ ID NO: 12863 - RNA, 36 nt, Artificial Sequence
  Description of Artificial Sequence:  Enzymatic Nucleic Acid
agccaugauggcaugcacuaugcgcgacaggugcau

SEQ ID NO: 12864 - RNA, 36 nt, Artificial Sequence
  Description of Artificial Sequence:  Enzymatic Nucleic Acid
agucgugauggcaugcacuaugcgcgagccacacag

SEQ ID NO: 12865 - RNA, 36 nt, Artificial Sequence
  Description of Artificial Sequence:  Enzymatic Nucleic Acid
agaguugauggcaugcacuaugcgcggcagccacac

SEQ ID NO: 12866 - RNA, 36 nt, Artificial Sequence
  Description of Artificial Sequence:  Enzymatic Nucleic Acid
uuuuuugauggcaugcacuaugcgcgggauaaggag

SEQ ID NO: 12867 - RNA, 36 nt, Artificial Sequence
  Description of Artificial Sequence:  Enzymatic Nucleic Acid
cuuuuugauggcaugcacuaugcgcgauuuuucgga

SEQ ID NO: 12868 - RNA, 36 nt, Artificial Sequence
  Description of Artificial Sequence:  Enzymatic Nucleic Acid
uauuuugauggcaugcacuaugcgcgagaagaagac

SEQ ID NO: 12869 - RNA, 36 nt, Artificial Sequence
  Description of Artificial Sequence:  Enzymatic Nucleic Acid
guaguugauggcaugcacuaugcgcgagucuuuauu

SEQ ID NO: 12870 - RNA, 36 nt, Artificial Sequence
  Description of Artificial Sequence:  Enzymatic Nucleic Acid
aacuuugauggcaugcacuaugcgcgaucugggucc

SEQ ID NO: 12871 - RNA, 36 nt, Artificial Sequence
  Description of Artificial Sequence:  Enzymatic Nucleic Acid
cugcuugauggcaugcacuaugcgcgauccaaagga

SEQ ID NO: 12872 - RNA, 36 nt, Artificial Sequence
  Description of Artificial Sequence:  Enzymatic Nucleic Acid
gcucaugauggcaugcacuaugcgcgacugcucauc

SEQ ID NO: 12873 - RNA, 36 nt, Artificial Sequence
  Description of Artificial Sequence:  Enzymatic Nucleic Acid
ccgcuugauggcaugcacuaugcgcgacacugcuca

SEQ ID NO: 12874 - RNA, 36 nt, Artificial Sequence
  Description of Artificial Sequence:  Enzymatic Nucleic Acid
ggcauugauggcaugcacuaugcgcgauaagggagc

SEQ ID NO: 12875 - RNA, 36 nt, Artificial Sequence
  Description of Artificial Sequence:  Enzymatic Nucleic Acid
gcuggugauggcaugcacuaugcgcgaucauaaggg

SEQ ID NO: 12876 - RNA, 36 nt, Artificial Sequence
  Description of Artificial Sequence:  Enzymatic Nucleic Acid
ccgggugauggcaugcacuaugcgcgaaacucccac

SEQ ID NO: 12877 - RNA, 36 nt, Artificial Sequence
  Description of Artificial Sequence:  Enzymatic Nucleic Acid
uccggugauggcaugcacuaugcgcgacguagguga

SEQ ID NO: 12878 - RNA, 36 nt, Artificial Sequence
  Description of Artificial Sequence:  Enzymatic Nucleic Acid
agccaugauggcaugcacuaugcgcgaguccggcac

SEQ ID NO: 12879 - RNA, 36 nt, Artificial Sequence
  Description of Artificial Sequence:  Enzymatic Nucleic Acid
uuucaugauggcaugcacuaugcgcgagccacaguc

SEQ ID NO: 12880 - RNA, 36 nt, Artificial Sequence
  Description of Artificial Sequence:  Enzymatic Nucleic Acid
auuuuugauggcaugcacuaugcgcgacagccacag

SEQ ID NO: 12881 - RNA, 36 nt, Artificial Sequence
  Description of Artificial Sequence:  Enzymatic Nucleic Acid
uucagugauggcaugcacuaugcgcgauuuucacag

SEQ ID NO: 12882 - RNA, 36 nt, Artificial Sequence
  Description of Artificial Sequence:  Enzymatic Nucleic Acid
ucuuuugauggcaugcacuaugcgcgagcauuuuca

SEQ ID NO: 12883 - RNA, 36 nt, Artificial Sequence
  Description of Artificial Sequence:  Enzymatic Nucleic Acid
guacuugauggcaugcacuaugcgcggcuggccgug

SEQ ID NO: 12884 - RNA, 36 nt, Artificial Sequence
  Description of Artificial Sequence:  Enzymatic Nucleic Acid
gucauugauggcaugcacuaugcgcgagagcuuugu

SEQ ID NO: 12885 - RNA, 36 nt, Artificial Sequence
  Description of Artificial Sequence:  Enzymatic Nucleic Acid
ucaguugauggcaugcacuaugcgcgaucagagcuu

SEQ ID NO: 12886 - RNA, 36 nt, Artificial Sequence
  Description of Artificial Sequence:  Enzymatic Nucleic Acid
uagcuugauggcaugcacuaugcgcgagucaucaga

SEQ ID NO: 12887 - RNA, 36 nt, Artificial Sequence
  Description of Artificial Sequence:  Enzymatic Nucleic Acid
uggguugauggcaugcacuaugcgcgaagauuuuua

SEQ ID NO: 12888 - RNA, 36 nt, Artificial Sequence
  Description of Artificial Sequence:  Enzymatic Nucleic Acid
acguuugauggcaugcacuaugcgcgagaugguggc

SEQ ID NO: 12889 - RNA, 36 nt, Artificial Sequence
  Description of Artificial Sequence:  Enzymatic Nucleic Acid
cccagugauggcaugcacuaugcgcgagguuaacca

SEQ ID NO: 12890 - RNA, 36 nt, Artificial Sequence
  Description of Artificial Sequence:  Enzymatic Nucleic Acid
uggugugauggcaugcacuaugcgcgaggcucccag

SEQ ID NO: 12891 - RNA, 36 nt, Artificial Sequence
  Description of Artificial Sequence:  Enzymatic Nucleic Acid
accauugauggcaugcacuaugcgcgagaggcccuc

SEQ ID NO: 12892 - RNA, 36 nt, Artificial Sequence
  Description of Artificial Sequence:  Enzymatic Nucleic Acid
acaauugauggcaugcacuaugcgcgaccaucagag

SEQ ID NO: 12893 - RNA, 36 nt, Artificial Sequence
  Description of Artificial Sequence:  Enzymatic Nucleic Acid
uucaaugauggcaugcacuaugcgcgaaucaccauc

SEQ ID NO: 12894 - RNA, 36 nt, Artificial Sequence
  Description of Artificial Sequence:  Enzymatic Nucleic Acid
guauuugauggcaugcacuaugcgcgaacaaucacc

SEQ ID NO: 12895 - RNA, 36 nt, Artificial Sequence
  Description of Artificial Sequence:  Enzymatic Nucleic Acid
auuugugauggcaugcacuaugcgcgaguauucaac

SEQ ID NO: 12896 - RNA, 36 nt, Artificial Sequence
  Description of Artificial Sequence:  Enzymatic Nucleic Acid
uaaguugauggcaugcacuaugcgcgacguuugcuc

SEQ ID NO: 12897 - RNA, 36 nt, Artificial Sequence
  Description of Artificial Sequence:  Enzymatic Nucleic Acid
ugcugugauggcaugcacuaugcgcgauccuuguug

SEQ ID NO: 12898 - RNA, 36 nt, Artificial Sequence
  Description of Artificial Sequence:  Enzymatic Nucleic Acid
gcuuuugauggcaugcacuaugcgcggcugcuggug

SEQ ID NO: 12899 - RNA, 36 nt, Artificial Sequence
  Description of Artificial Sequence:  Enzymatic Nucleic Acid
gcucgugauggcaugcacuaugcgcgaaagcuuucg

SEQ ID NO: 12900 - RNA, 36 nt, Artificial Sequence
  Description of Artificial Sequence:  Enzymatic Nucleic Acid
gagcuugauggcaugcacuaugcgcggcaaagcuuu

SEQ ID NO: 12901 - RNA, 36 nt, Artificial Sequence
  Description of Artificial Sequence:  Enzymatic Nucleic Acid
ucacuugauggcaugcacuaugcgcgagacuuuuau

SEQ ID NO: 12902 - RNA, 36 nt, Artificial Sequence
  Description of Artificial Sequence:  Enzymatic Nucleic Acid
aacauugauggcaugcacuaugcgcgacucagacuu

SEQ ID NO: 12903 - RNA, 36 nt, Artificial Sequence
  Description of Artificial Sequence:  Enzymatic Nucleic Acid
cucaaugauggcaugcacuaugcgcgaucacucaga

SEQ ID NO: 12904 - RNA, 36 nt, Artificial Sequence
  Description of Artificial Sequence:  Enzymatic Nucleic Acid
uuccuugauggcaugcacuaugcgcgaacaucacuc

SEQ ID NO: 12905 - RNA, 36 nt, Artificial Sequence
  Description of Artificial Sequence:  Enzymatic Nucleic Acid
accguugauggcaugcacuaugcgcgagaauccucc

SEQ ID NO: 12906 - RNA, 36 nt, Artificial Sequence
  Description of Artificial Sequence:  Enzymatic Nucleic Acid
gaaauugauggcaugcacuaugcgcgagaucuucca

SEQ ID NO: 12907 - RNA, 36 nt, Artificial Sequence
  Description of Artificial Sequence:  Enzymatic Nucleic Acid
gaagaugauggcaugcacuaugcgcgaggaacucca

SEQ ID NO: 12908 - RNA, 36 nt, Artificial Sequence
  Description of Artificial Sequence:  Enzymatic Nucleic Acid
gaaugugauggcaugcacuaugcgcgacuuucugga

SEQ ID NO: 12909 - RNA, 36 nt, Artificial Sequence
  Description of Artificial Sequence:  Enzymatic Nucleic Acid
uuucuugauggcaugcacuaugcgcggcugccaggu

SEQ ID NO: 12910 - RNA, 36 nt, Artificial Sequence
  Description of Artificial Sequence:  Enzymatic Nucleic Acid
guucuugauggcaugcacuaugcgcgagauaaaaga

SEQ ID NO: 12911 - RNA, 36 nt, Artificial Sequence
  Description of Artificial Sequence:  Enzymatic Nucleic Acid
aucuuugauggcaugcacuaugcgcgaccacguugu

SEQ ID NO: 12912 - RNA, 36 nt, Artificial Sequence
  Description of Artificial Sequence:  Enzymatic Nucleic Acid
aaucaugauggcaugcacuaugcgcgaaaucuucac

SEQ ID NO: 12913 - RNA, 36 nt, Artificial Sequence
  Description of Artificial Sequence:  Enzymatic Nucleic Acid
aaaauugauggcaugcacuaugcgcgacaaaucuuc

SEQ ID NO: 12914 - RNA, 36 nt, Artificial Sequence
  Description of Artificial Sequence:  Enzymatic Nucleic Acid
ccgggugauggcaugcacuaugcgcgaaggccaaaa

SEQ ID NO: 12915 - RNA, 36 nt, Artificial Sequence
  Description of Artificial Sequence:  Enzymatic Nucleic Acid
auaauugauggcaugcacuaugcgcggggguucuua

SEQ ID NO: 12916 - RNA, 36 nt, Artificial Sequence
  Description of Artificial Sequence:  Enzymatic Nucleic Acid
ucucaugauggcaugcacuaugcgcgauaaucgggg

SEQ ID NO: 12917 - RNA, 36 nt, Artificial Sequence
  Description of Artificial Sequence:  Enzymatic Nucleic Acid
uuucuugauggcaugcacuaugcgcgacauaaucgg

SEQ ID NO: 12918 - RNA, 36 nt, Artificial Sequence
  Description of Artificial Sequence:  Enzymatic Nucleic Acid
gaaguugauggcaugcacuaugcgcggaguaucucc

SEQ ID NO: 12919 - RNA, 36 nt, Artificial Sequence
  Description of Artificial Sequence:  Enzymatic Nucleic Acid
cauuuugauggcaugcacuaugcgcgagaggaaguc

SEQ ID NO: 12920 - RNA, 36 nt, Artificial Sequence
  Description of Artificial Sequence:  Enzymatic Nucleic Acid
agauuugauggcaugcacuaugcgcggggagccauc

SEQ ID NO: 12921 - RNA, 36 nt, Artificial Sequence
  Description of Artificial Sequence:  Enzymatic Nucleic Acid
uuuguugauggcaugcacuaugcgcgaaagauagau

SEQ ID NO: 12922 - RNA, 36 nt, Artificial Sequence
  Description of Artificial Sequence:  Enzymatic Nucleic Acid
cacguugauggcaugcacuaugcgcggcucuuggug

SEQ ID NO: 12923 - RNA, 36 nt, Artificial Sequence
  Description of Artificial Sequence:  Enzymatic Nucleic Acid
gaccaugauggcaugcacuaugcgcgacgucgcucu

SEQ ID NO: 12924 - RNA, 36 nt, Artificial Sequence
  Description of Artificial Sequence:  Enzymatic Nucleic Acid
cacagugauggcaugcacuaugcgcgaauacuccgu

SEQ ID NO: 12925 - RNA, 36 nt, Artificial Sequence
  Description of Artificial Sequence:  Enzymatic Nucleic Acid
ucccaugauggcaugcacuaugcgcgagcaauacuc

SEQ ID NO: 12926 - RNA, 36 nt, Artificial Sequence
  Description of Artificial Sequence:  Enzymatic Nucleic Acid
guccuugauggcaugcacuaugcgcgauccauuugu

SEQ ID NO: 12927 - RNA, 36 nt, Artificial Sequence
  Description of Artificial Sequence:  Enzymatic Nucleic Acid
gacugugauggcaugcacuaugcgcgaaaaguccuc

SEQ ID NO: 12928 - RNA, 36 nt, Artificial Sequence
  Description of Artificial Sequence:  Enzymatic Nucleic Acid
ucaggugauggcaugcacuaugcgcggacugcaaaa

SEQ ID NO: 12929 - RNA, 36 nt, Artificial Sequence
  Description of Artificial Sequence:  Enzymatic Nucleic Acid
ucccuugauggcaugcacuaugcgcgaggcgacugc

SEQ ID NO: 12930 - RNA, 36 nt, Artificial Sequence
  Description of Artificial Sequence:  Enzymatic Nucleic Acid
auccuugauggcaugcacuaugcgcgaugccuuccc

SEQ ID NO: 12931 - RNA, 36 nt, Artificial Sequence
  Description of Artificial Sequence:  Enzymatic Nucleic Acid
gcucuugauggcaugcacuaugcgcgauccucaugc

SEQ ID NO: 12932 - RNA, 36 nt, Artificial Sequence
  Description of Artificial Sequence:  Enzymatic Nucleic Acid
guacuugauggcaugcacuaugcgcgaggagcucuc

SEQ ID NO: 12933 - RNA, 36 nt, Artificial Sequence
  Description of Artificial Sequence:  Enzymatic Nucleic Acid
gauuuugauggcaugcacuaugcgcgaggaguagag

SEQ ID NO: 12934 - RNA, 36 nt, Artificial Sequence
  Description of Artificial Sequence:  Enzymatic Nucleic Acid
uccagugauggcaugcacuaugcgcgaugaucugau

SEQ ID NO: 12935 - RNA, 36 nt, Artificial Sequence
  Description of Artificial Sequence:  Enzymatic Nucleic Acid
gccagugauggcaugcacuaugcgcgaguccagcau

SEQ ID NO: 12936 - RNA, 36 nt, Artificial Sequence
  Description of Artificial Sequence:  Enzymatic Nucleic Acid
uucugugauggcaugcacuaugcgcgaaaucuuggc

SEQ ID NO: 12937 - RNA, 36 nt, Artificial Sequence
  Description of Artificial Sequence:  Enzymatic Nucleic Acid
uuccaugauggcaugcacuaugcgcgaaguucugca

SEQ ID NO: 12938 - RNA, 36 nt, Artificial Sequence
  Description of Artificial Sequence:  Enzymatic Nucleic Acid
caaauugauggcaugcacuaugcgcgaccuaguuuu

SEQ ID NO: 12939 - RNA, 36 nt, Artificial Sequence
  Description of Artificial Sequence:  Enzymatic Nucleic Acid
ugaagugauggcaugcacuaugcgcgaaaucaccua

SEQ ID NO: 12940 - RNA, 36 nt, Artificial Sequence
  Description of Artificial Sequence:  Enzymatic Nucleic Acid
uuguaugauggcaugcacuaugcgcgauuugcuuga

SEQ ID NO: 12941 - RNA, 36 nt, Artificial Sequence
  Description of Artificial Sequence:  Enzymatic Nucleic Acid
uauggugauggcaugcacuaugcgcgauugauuggg

SEQ ID NO: 12942 - RNA, 36 nt, Artificial Sequence
  Description of Artificial Sequence:  Enzymatic Nucleic Acid
ccuguugauggcaugcacuaugcgcgaguauggcau

SEQ ID NO: 12943 - RNA, 36 nt, Artificial Sequence
  Description of Artificial Sequence:  Enzymatic Nucleic Acid
gaaggugauggcaugcacuaugcgcgaggaguugag

SEQ ID NO: 12944 - RNA, 36 nt, Artificial Sequence
  Description of Artificial Sequence:  Enzymatic Nucleic Acid
guccuugauggcaugcacuaugcgcgagagaaggca

SEQ ID NO: 12945 - RNA, 36 nt, Artificial Sequence
  Description of Artificial Sequence:  Enzymatic Nucleic Acid
aacuuugauggcaugcacuaugcgcgggagcugaaa

SEQ ID NO: 12946 - RNA, 36 nt, Artificial Sequence
  Description of Artificial Sequence:  Enzymatic Nucleic Acid
aucauugauggcaugcacuaugcgcgagagcuuccu

SEQ ID NO: 12947 - RNA, 36 nt, Artificial Sequence
  Description of Artificial Sequence:  Enzymatic Nucleic Acid
gacauugauggcaugcacuaugcgcgaucagagcuu

SEQ ID NO: 12948 - RNA, 36 nt, Artificial Sequence
  Description of Artificial Sequence:  Enzymatic Nucleic Acid
ucugaugauggcaugcacuaugcgcgaucaucagag

SEQ ID NO: 12949 - RNA, 36 nt, Artificial Sequence
  Description of Artificial Sequence:  Enzymatic Nucleic Acid
auuuaugauggcaugcacuaugcgcgauaucugaca

SEQ ID NO: 12950 - RNA, 36 nt, Artificial Sequence
  Description of Artificial Sequence:  Enzymatic Nucleic Acid
gaaagugauggcaugcacuaugcgcgauuuacauau

SEQ ID NO: 12951 - RNA, 36 nt, Artificial Sequence
  Description of Artificial Sequence:  Enzymatic Nucleic Acid
aggcuugauggcaugcacuaugcgcgaugaacuuga

SEQ ID NO: 12952 - RNA, 36 nt, Artificial Sequence
  Description of Artificial Sequence:  Enzymatic Nucleic Acid
uucuuugauggcaugcacuaugcgcgaaagguuuug

SEQ ID NO: 12953 - RNA, 36 nt, Artificial Sequence
  Description of Artificial Sequence:  Enzymatic Nucleic Acid
gcauuugauggcaugcacuaugcgcggguaaaaguu

SEQ ID NO: 12954 - RNA, 36 nt, Artificial Sequence
  Description of Artificial Sequence:  Enzymatic Nucleic Acid
gguggugauggcaugcacuaugcgcgauucgguaaa

SEQ ID NO: 12955 - RNA, 36 nt, Artificial Sequence
  Description of Artificial Sequence:  Enzymatic Nucleic Acid
ucaaaugauggcaugcacuaugcgcgauggaggugg

SEQ ID NO: 12956 - RNA, 36 nt, Artificial Sequence
  Description of Artificial Sequence:  Enzymatic Nucleic Acid
gucauugauggcaugcacuaugcgcgaaacauggag

SEQ ID NO: 12957 - RNA, 36 nt, Artificial Sequence
  Description of Artificial Sequence:  Enzymatic Nucleic Acid
guaguugauggcaugcacuaugcgcgaucaaacaug

SEQ ID NO: 12958 - RNA, 36 nt, Artificial Sequence
  Description of Artificial Sequence:  Enzymatic Nucleic Acid
gcuguugauggcaugcacuaugcgcggcccugguag

SEQ ID NO: 12959 - RNA, 36 nt, Artificial Sequence
  Description of Artificial Sequence:  Enzymatic Nucleic Acid
gccaaugauggcaugcacuaugcgcgagagugcugc

SEQ ID NO: 12960 - RNA, 36 nt, Artificial Sequence
  Description of Artificial Sequence:  Enzymatic Nucleic Acid
uucagugauggcaugcacuaugcgcgaugggagagg

SEQ ID NO: 12961 - RNA, 36 nt, Artificial Sequence
  Description of Artificial Sequence:  Enzymatic Nucleic Acid
cgcuuugauggcaugcacuaugcgcgagcaugggag

SEQ ID NO: 12962 - RNA, 36 nt, Artificial Sequence
  Description of Artificial Sequence:  Enzymatic Nucleic Acid
ugaagugauggcaugcacuaugcgcggcuucagcau

SEQ ID NO: 12963 - RNA, 36 nt, Artificial Sequence
  Description of Artificial Sequence:  Enzymatic Nucleic Acid
gcuguugauggcaugcacuaugcgcgaguccaggug

SEQ ID NO: 12964 - RNA, 36 nt, Artificial Sequence
  Description of Artificial Sequence:  Enzymatic Nucleic Acid
uugagugauggcaugcacuaugcgcggaggccuugg

SEQ ID NO: 12965 - RNA, 36 nt, Artificial Sequence
  Description of Artificial Sequence:  Enzymatic Nucleic Acid
caaguugauggcaugcacuaugcgcgaaucuugagc

SEQ ID NO: 12966 - RNA, 36 nt, Artificial Sequence
  Description of Artificial Sequence:  Enzymatic Nucleic Acid
acucuugauggcaugcacuaugcgcgaagucaaucu

SEQ ID NO: 12967 - RNA, 36 nt, Artificial Sequence
  Description of Artificial Sequence:  Enzymatic Nucleic Acid
ucagaugauggcaugcacuaugcgcgagccccgacu

SEQ ID NO: 12968 - RNA, 36 nt, Artificial Sequence
  Description of Artificial Sequence:  Enzymatic Nucleic Acid
gacauugauggcaugcacuaugcgcgagacagcccc

SEQ ID NO: 12969 - RNA, 36 nt, Artificial Sequence
  Description of Artificial Sequence:  Enzymatic Nucleic Acid
gcugaugauggcaugcacuaugcgcgaucagacagc

SEQ ID NO: 12970 - RNA, 36 nt, Artificial Sequence
  Description of Artificial Sequence:  Enzymatic Nucleic Acid
aauggugauggcaugcacuaugcgcgagaaacuggg

SEQ ID NO: 12971 - RNA, 36 nt, Artificial Sequence
  Description of Artificial Sequence:  Enzymatic Nucleic Acid
gcccaugauggcaugcacuaugcgcgagcuggaaug

SEQ ID NO: 12972 - RNA, 36 nt, Artificial Sequence
  Description of Artificial Sequence:  Enzymatic Nucleic Acid
gccuuugauggcaugcacuaugcgcggcugacgugc

SEQ ID NO: 12973 - RNA, 36 nt, Artificial Sequence
  Description of Artificial Sequence:  Enzymatic Nucleic Acid
accugugauggcaugcacuaugcgcggcuugccuuc

SEQ ID NO: 12974 - RNA, 36 nt, Artificial Sequence
  Description of Artificial Sequence:  Enzymatic Nucleic Acid
gugguugauggcaugcacuaugcgcgguaggugaac

SEQ ID NO: 12975 - RNA, 36 nt, Artificial Sequence
  Description of Artificial Sequence:  Enzymatic Nucleic Acid
cucagugauggcaugcacuaugcgcgguggucguag

SEQ ID NO: 12976 - RNA, 36 nt, Artificial Sequence
  Description of Artificial Sequence:  Enzymatic Nucleic Acid
cagcuugauggcaugcacuaugcgcgagcguggucg

SEQ ID NO: 12977 - RNA, 36 nt, Artificial Sequence
  Description of Artificial Sequence:  Enzymatic Nucleic Acid
gcacgugauggcaugcacuaugcgcggauuuuccuu

SEQ ID NO: 12978 - RNA, 36 nt, Artificial Sequence
  Description of Artificial Sequence:  Enzymatic Nucleic Acid
agcagugauggcaugcacuaugcgcgacgcgauuuu

SEQ ID NO: 12979 - RNA, 36 nt, Artificial Sequence
  Description of Artificial Sequence:  Enzymatic Nucleic Acid
gggagugauggcaugcacuaugcgcgagcacgcgau

SEQ ID NO: 12980 - RNA, 36 nt, Artificial Sequence
  Description of Artificial Sequence:  Enzymatic Nucleic Acid
gggggugauggcaugcacuaugcgcgggggagcagc

SEQ ID NO: 12981 - RNA, 36 nt, Artificial Sequence
  Description of Artificial Sequence:  Enzymatic Nucleic Acid
gaguaugauggcaugcacuaugcgcgaggaccaccg

SEQ ID NO: 12982 - RNA, 36 nt, Artificial Sequence
  Description of Artificial Sequence:  Enzymatic Nucleic Acid
cguguugauggcaugcacuaugcgcgaaacucuaga

SEQ ID NO: 12983 - RNA, 36 nt, Artificial Sequence
  Description of Artificial Sequence:  Enzymatic Nucleic Acid
ggcuuugauggcaugcacuaugcgcggugucaaacu

SEQ ID NO: 12984 - RNA, 36 nt, Artificial Sequence
  Description of Artificial Sequence:  Enzymatic Nucleic Acid
auacaugauggcaugcacuaugcgcgaugugcuucu

SEQ ID NO: 12985 - RNA, 36 nt, Artificial Sequence
  Description of Artificial Sequence:  Enzymatic Nucleic Acid
aaauaugauggcaugcacuaugcgcgacaugugcuu

SEQ ID NO: 12986 - RNA, 36 nt, Artificial Sequence
  Description of Artificial Sequence:  Enzymatic Nucleic Acid
acuggugauggcaugcacuaugcgcgaaaagcuagu

SEQ ID NO: 12987 - RNA, 36 nt, Artificial Sequence
  Description of Artificial Sequence:  Enzymatic Nucleic Acid
auaugugauggcaugcacuaugcgcgauaauacugg

SEQ ID NO: 12988 - RNA, 36 nt, Artificial Sequence
  Description of Artificial Sequence:  Enzymatic Nucleic Acid
aaaagugauggcaugcacuaugcgcgagcuggcucc

SEQ ID NO: 12989 - RNA, 36 nt, Artificial Sequence
  Description of Artificial Sequence:  Enzymatic Nucleic Acid
aaucaugauggcaugcacuaugcgcgaaaaagcagc

SEQ ID NO: 12990 - RNA, 36 nt, Artificial Sequence
  Description of Artificial Sequence:  Enzymatic Nucleic Acid
aaaauugauggcaugcacuaugcgcgacaaaaagca

SEQ ID NO: 12991 - RNA, 36 nt, Artificial Sequence
  Description of Artificial Sequence:  Enzymatic Nucleic Acid
aaaagugauggcaugcacuaugcgcgacuauuaaaa

SEQ ID NO: 12992 - RNA, 36 nt, Artificial Sequence
  Description of Artificial Sequence:  Enzymatic Nucleic Acid
uuaguugauggcaugcacuaugcgcgaaaaaaaaaa

SEQ ID NO: 12993 - RNA, 36 nt, Artificial Sequence
  Description of Artificial Sequence:  Enzymatic Nucleic Acid
aguuaugauggcaugcacuaugcgcgauucuuguua

SEQ ID NO: 12994 - RNA, 36 nt, Artificial Sequence
  Description of Artificial Sequence:  Enzymatic Nucleic Acid
cuuguugauggcaugcacuaugcgcgacuauuucuc

SEQ ID NO: 12995 - RNA, 36 nt, Artificial Sequence
  Description of Artificial Sequence:  Enzymatic Nucleic Acid
uucuuugauggcaugcacuaugcgcgacuugucacu

SEQ ID NO: 12996 - RNA, 36 nt, Artificial Sequence
  Description of Artificial Sequence:  Enzymatic Nucleic Acid
uuuagugauggcaugcacuaugcgcgaguaguguuc

SEQ ID NO: 12997 - RNA, 36 nt, Artificial Sequence
  Description of Artificial Sequence:  Enzymatic Nucleic Acid
aguaaugauggcaugcacuaugcgcgaugaggauuu

SEQ ID NO: 12998 - RNA, 36 nt, Artificial Sequence
  Description of Artificial Sequence:  Enzymatic Nucleic Acid
ucuaaugauggcaugcacuaugcgcgacugaguaac

SEQ ID NO: 12999 - RNA, 36 nt, Artificial Sequence
  Description of Artificial Sequence:  Enzymatic Nucleic Acid
gaaguugauggcaugcacuaugcgcgauuggguuua

SEQ ID NO: 13000 - RNA, 36 nt, Artificial Sequence
  Description of Artificial Sequence:  Enzymatic Nucleic Acid
uggagugauggcaugcacuaugcgcgagggaaguca

SEQ ID NO: 13001 - RNA, 36 nt, Artificial Sequence
  Description of Artificial Sequence:  Enzymatic Nucleic Acid
gguggugauggcaugcacuaugcgcgggggguugga

SEQ ID NO: 13002 - RNA, 36 nt, Artificial Sequence
  Description of Artificial Sequence:  Enzymatic Nucleic Acid
uccugugauggcaugcacuaugcgcggugcccugag

SEQ ID NO: 13003 - RNA, 36 nt, Artificial Sequence
  Description of Artificial Sequence:  Enzymatic Nucleic Acid
ucaauugauggcaugcacuaugcgcgaaacuggucc

SEQ ID NO: 13004 - RNA, 36 nt, Artificial Sequence
  Description of Artificial Sequence:  Enzymatic Nucleic Acid
cuccuugauggcaugcacuaugcgcgaaucaaacug

SEQ ID NO: 13005 - RNA, 36 nt, Artificial Sequence
  Description of Artificial Sequence:  Enzymatic Nucleic Acid
cagugugauggcaugcacuaugcgcgagcuccucaa

SEQ ID NO: 13006 - RNA, 36 nt, Artificial Sequence
  Description of Artificial Sequence:  Enzymatic Nucleic Acid
gugauugauggcaugcacuaugcgcgagugcagcuc

SEQ ID NO: 13007 - RNA, 36 nt, Artificial Sequence
  Description of Artificial Sequence:  Enzymatic Nucleic Acid
ugaugugauggcaugcacuaugcgcgauugggugau

SEQ ID NO: 13008 - RNA, 36 nt, Artificial Sequence
  Description of Artificial Sequence:  Enzymatic Nucleic Acid
ggcugugauggcaugcacuaugcgcgagggcuggcc

SEQ ID NO: 13009 - RNA, 36 nt, Artificial Sequence
  Description of Artificial Sequence:  Enzymatic Nucleic Acid
uugcuugauggcaugcacuaugcgcgaggccagcca

SEQ ID NO: 13010 - RNA, 36 nt, Artificial Sequence
  Description of Artificial Sequence:  Enzymatic Nucleic Acid
ccucaugauggcaugcacuaugcgcgaugucuuagg

SEQ ID NO: 13011 - RNA, 36 nt, Artificial Sequence
  Description of Artificial Sequence:  Enzymatic Nucleic Acid
cuccuugauggcaugcacuaugcgcgacaugucuua

SEQ ID NO: 13012 - RNA, 36 nt, Artificial Sequence
  Description of Artificial Sequence:  Enzymatic Nucleic Acid
uuucuugauggcaugcacuaugcgcgaugccuucuc

SEQ ID NO: 13013 - RNA, 36 nt, Artificial Sequence
  Description of Artificial Sequence:  Enzymatic Nucleic Acid
cgucuugauggcaugcacuaugcgcgaaauucuuuc

SEQ ID NO: 13014 - RNA, 36 nt, Artificial Sequence
  Description of Artificial Sequence:  Enzymatic Nucleic Acid
uggugugauggcaugcacuaugcgcggucucaaauu

SEQ ID NO: 13015 - RNA, 36 nt, Artificial Sequence
  Description of Artificial Sequence:  Enzymatic Nucleic Acid
gcccaugauggcaugcacuaugcgcgauggugcguc

SEQ ID NO: 13016 - RNA, 36 nt, Artificial Sequence
  Description of Artificial Sequence:  Enzymatic Nucleic Acid
aauggugauggcaugcacuaugcgcgauugcugagc

SEQ ID NO: 13017 - RNA, 36 nt, Artificial Sequence
  Description of Artificial Sequence:  Enzymatic Nucleic Acid
aggguugauggcaugcacuaugcgcgagagcuggga

SEQ ID NO: 13018 - RNA, 36 nt, Artificial Sequence
  Description of Artificial Sequence:  Enzymatic Nucleic Acid
gcccuugauggcaugcacuaugcgcgaaauguagaa

SEQ ID NO: 13019 - RNA, 36 nt, Artificial Sequence
  Description of Artificial Sequence:  Enzymatic Nucleic Acid
cucauugauggcaugcacuaugcgcggcuguccauc

SEQ ID NO: 13020 - RNA, 36 nt, Artificial Sequence
  Description of Artificial Sequence:  Enzymatic Nucleic Acid
ccccuugauggcaugcacuaugcgcgaucgcugucc

SEQ ID NO: 13021 - RNA, 36 nt, Artificial Sequence
  Description of Artificial Sequence:  Enzymatic Nucleic Acid
auggaugauggcaugcacuaugcgcgauagaaccac

SEQ ID NO: 13022 - RNA, 36 nt, Artificial Sequence
  Description of Artificial Sequence:  Enzymatic Nucleic Acid
caaaaugauggcaugcacuaugcgcgaugccacgaa

SEQ ID NO: 13023 - RNA, 36 nt, Artificial Sequence
  Description of Artificial Sequence:  Enzymatic Nucleic Acid
caaauugauggcaugcacuaugcgcgaaaacaugcc

SEQ ID NO: 13024 - RNA, 36 nt, Artificial Sequence
  Description of Artificial Sequence:  Enzymatic Nucleic Acid
ugcuaugauggcaugcacuaugcgcgaaaucaaaac

SEQ ID NO: 13025 - RNA, 36 nt, Artificial Sequence
  Description of Artificial Sequence:  Enzymatic Nucleic Acid
acccuugauggcaugcacuaugcgcgagugcuacaa

SEQ ID NO: 13026 - RNA, 36 nt, Artificial Sequence
  Description of Artificial Sequence:  Enzymatic Nucleic Acid
gggcuugauggcaugcacuaugcgcgagaguugagu

SEQ ID NO: 13027 - RNA, 36 nt, Artificial Sequence
  Description of Artificial Sequence:  Enzymatic Nucleic Acid
cagugugauggcaugcacuaugcgcgaucuuacuag

SEQ ID NO: 13028 - RNA, 36 nt, Artificial Sequence
  Description of Artificial Sequence:  Enzymatic Nucleic Acid
guuuuugauggcaugcacuaugcgcgagugcaucuu

SEQ ID NO: 13029 - RNA, 36 nt, Artificial Sequence
  Description of Artificial Sequence:  Enzymatic Nucleic Acid
ggagaugauggcaugcacuaugcgcgaaccuaacuc

SEQ ID NO: 13030 - RNA, 36 nt, Artificial Sequence
  Description of Artificial Sequence:  Enzymatic Nucleic Acid
gccauugauggcaugcacuaugcgcgauggccugga

SEQ ID NO: 13031 - RNA, 36 nt, Artificial Sequence
  Description of Artificial Sequence:  Enzymatic Nucleic Acid
auuuuugauggcaugcacuaugcgcgaguguaaggc

SEQ ID NO: 13032 - RNA, 36 nt, Artificial Sequence
  Description of Artificial Sequence:  Enzymatic Nucleic Acid
ugugaugauggcaugcacuaugcgcgauuuucagug

SEQ ID NO: 13033 - RNA, 36 nt, Artificial Sequence
  Description of Artificial Sequence:  Enzymatic Nucleic Acid
caaaaugauggcaugcacuaugcgcgagaauaauac

SEQ ID NO: 13034 - RNA, 36 nt, Artificial Sequence
  Description of Artificial Sequence:  Enzymatic Nucleic Acid
cugugugauggcaugcacuaugcgcgaaaacagaau

SEQ ID NO: 13035 - RNA, 36 nt, Artificial Sequence
  Description of Artificial Sequence:  Enzymatic Nucleic Acid
uuucaugauggcaugcacuaugcgcgaacuaacugu

SEQ ID NO: 13036 - RNA, 36 nt, Artificial Sequence
  Description of Artificial Sequence:  Enzymatic Nucleic Acid
ucuuuugauggcaugcacuaugcgcgacaacuaacu

SEQ ID NO: 13037 - RNA, 36 nt, Artificial Sequence
  Description of Artificial Sequence:  Enzymatic Nucleic Acid
cuucuugauggcaugcacuaugcgcgagcuuucuuu

SEQ ID NO: 13038 - RNA, 36 nt, Artificial Sequence
  Description of Artificial Sequence:  Enzymatic Nucleic Acid
auuuuugauggcaugcacuaugcgcgauucuucuca

SEQ ID NO: 13039 - RNA, 36 nt, Artificial Sequence
  Description of Artificial Sequence:  Enzymatic Nucleic Acid
gacugugauggcaugcacuaugcgcgauuuucauuc

SEQ ID NO: 13040 - RNA, 36 nt, Artificial Sequence
  Description of Artificial Sequence:  Enzymatic Nucleic Acid
cuccuugauggcaugcacuaugcgcgaggacugcau

SEQ ID NO: 13041 - RNA, 36 nt, Artificial Sequence
  Description of Artificial Sequence:  Enzymatic Nucleic Acid
gcccuugauggcaugcacuaugcgcgguuuugauau

SEQ ID NO: 13042 - RNA, 36 nt, Artificial Sequence
  Description of Artificial Sequence:  Enzymatic Nucleic Acid
uccauugauggcaugcacuaugcgcgagcccucguu

SEQ ID NO: 13043 - RNA, 36 nt, Artificial Sequence
  Description of Artificial Sequence:  Enzymatic Nucleic Acid
ccuuuugauggcaugcacuaugcgcgagauuagugu

SEQ ID NO: 13044 - RNA, 36 nt, Artificial Sequence
  Description of Artificial Sequence:  Enzymatic Nucleic Acid
uuccaugauggcaugcacuaugcgcgauccuuucag

SEQ ID NO: 13045 - RNA, 36 nt, Artificial Sequence
  Description of Artificial Sequence:  Enzymatic Nucleic Acid
auaugugauggcaugcacuaugcgcggccagcuaau

SEQ ID NO: 13046 - RNA, 36 nt, Artificial Sequence
  Description of Artificial Sequence:  Enzymatic Nucleic Acid
uuacuugauggcaugcacuaugcgcgaaggagcuua

SEQ ID NO: 13047 - RNA, 36 nt, Artificial Sequence
  Description of Artificial Sequence:  Enzymatic Nucleic Acid
aauuaugauggcaugcacuaugcgcgauaccaccuu

SEQ ID NO: 13048 - RNA, 36 nt, Artificial Sequence
  Description of Artificial Sequence:  Enzymatic Nucleic Acid
ccuugugauggcaugcacuaugcgcgauaaauuaca

SEQ ID NO: 13049 - RNA, 36 nt, Artificial Sequence
  Description of Artificial Sequence:  Enzymatic Nucleic Acid
uggcuugauggcaugcacuaugcgcgauuaacuaau

SEQ ID NO: 13050 - RNA, 36 nt, Artificial Sequence
  Description of Artificial Sequence:  Enzymatic Nucleic Acid
caaagugauggcaugcacuaugcgcgaguugaaaau

SEQ ID NO: 13051 - RNA, 36 nt, Artificial Sequence
  Description of Artificial Sequence:  Enzymatic Nucleic Acid
aguuuugauggcaugcacuaugcgcgaaagcaguug

SEQ ID NO: 13052 - RNA, 36 nt, Artificial Sequence
  Description of Artificial Sequence:  Enzymatic Nucleic Acid
ccaggugauggcaugcacuaugcgcgaaguuucaaa

SEQ ID NO: 13053 - RNA, 36 nt, Artificial Sequence
  Description of Artificial Sequence:  Enzymatic Nucleic Acid
augcuugauggcaugcacuaugcgcgagaccccagg

SEQ ID NO: 13054 - RNA, 36 nt, Artificial Sequence
  Description of Artificial Sequence:  Enzymatic Nucleic Acid
cccauugauggcaugcacuaugcgcgaugcucagac

SEQ ID NO: 13055 - RNA, 36 nt, Artificial Sequence
  Description of Artificial Sequence:  Enzymatic Nucleic Acid
guaggugauggcaugcacuaugcgcggcccuuuccu

SEQ ID NO: 13056 - RNA, 36 nt, Artificial Sequence
  Description of Artificial Sequence:  Enzymatic Nucleic Acid
cuuagugauggcaugcacuaugcgcggauccaaggc

SEQ ID NO: 13057 - RNA, 36 nt, Artificial Sequence
  Description of Artificial Sequence:  Enzymatic Nucleic Acid
ucaaaugauggcaugcacuaugcgcgagagccagcu

SEQ ID NO: 13058 - RNA, 36 nt, Artificial Sequence
  Description of Artificial Sequence:  Enzymatic Nucleic Acid
agcauugauggcaugcacuaugcgcgaaacagagcc

SEQ ID NO: 13059 - RNA, 36 nt, Artificial Sequence
  Description of Artificial Sequence:  Enzymatic Nucleic Acid
aauagugauggcaugcacuaugcgcgaucaaacaga

SEQ ID NO: 13060 - RNA, 36 nt, Artificial Sequence
  Description of Artificial Sequence:  Enzymatic Nucleic Acid
acuugugauggcaugcacuaugcgcgauaaauagca

SEQ ID NO: 13061 - RNA, 36 nt, Artificial Sequence
  Description of Artificial Sequence:  Enzymatic Nucleic Acid
aaauaugauggcaugcacuaugcgcgauagacccua

SEQ ID NO: 13062 - RNA, 36 nt, Artificial Sequence
  Description of Artificial Sequence:  Enzymatic Nucleic Acid
aggcgugauggcaugcacuaugcgcgauccuaaaua

SEQ ID NO: 13063 - RNA, 36 nt, Artificial Sequence
  Description of Artificial Sequence:  Enzymatic Nucleic Acid
guaggugauggcaugcacuaugcgcggcauccuaaa

SEQ ID NO: 13064 - RNA, 36 nt, Artificial Sequence
  Description of Artificial Sequence:  Enzymatic Nucleic Acid
gcagaugauggcaugcacuaugcgcgauccuaaaua

SEQ ID NO: 13065 - RNA, 36 nt, Artificial Sequence
  Description of Artificial Sequence:  Enzymatic Nucleic Acid
aggugugauggcaugcacuaugcgcgagacauccua

SEQ ID NO: 13066 - RNA, 36 nt, Artificial Sequence
  Description of Artificial Sequence:  Enzymatic Nucleic Acid
ggcugugauggcaugcacuaugcgcgagaaggugca

SEQ ID NO: 13067 - RNA, 36 nt, Artificial Sequence
  Description of Artificial Sequence:  Enzymatic Nucleic Acid
agcagugauggcaugcacuaugcgcgaauccacugu

SEQ ID NO: 13068 - RNA, 36 nt, Artificial Sequence
  Description of Artificial Sequence:  Enzymatic Nucleic Acid
agaagugauggcaugcacuaugcgcgagcaauccac

SEQ ID NO: 13069 - RNA, 36 nt, Artificial Sequence
  Description of Artificial Sequence:  Enzymatic Nucleic Acid
ggaagugauggcaugcacuaugcgcgauacucuucu

SEQ ID NO: 13070 - RNA, 36 nt, Artificial Sequence
  Description of Artificial Sequence:  Enzymatic Nucleic Acid
aauuaugauggcaugcacuaugcgcgauggauaaaa

SEQ ID NO: 13071 - RNA, 36 nt, Artificial Sequence
  Description of Artificial Sequence:  Enzymatic Nucleic Acid
uucuaugauggcaugcacuaugcgcgaguuaaauua

SEQ ID NO: 13072 - RNA, 36 nt, Artificial Sequence
  Description of Artificial Sequence:  Enzymatic Nucleic Acid
gagcuugauggcaugcacuaugcgcgagguucuaca

SEQ ID NO: 13073 - RNA, 36 nt, Artificial Sequence
  Description of Artificial Sequence:  Enzymatic Nucleic Acid
uucuuugauggcaugcacuaugcgcggguuacuuag

SEQ ID NO: 13074 - RNA, 36 nt, Artificial Sequence
  Description of Artificial Sequence:  Enzymatic Nucleic Acid
gcauaugauggcaugcacuaugcgcgauucuucggu

SEQ ID NO: 13075 - RNA, 36 nt, Artificial Sequence
  Description of Artificial Sequence:  Enzymatic Nucleic Acid
agaggugauggcaugcacuaugcgcgauacauucuu

SEQ ID NO: 13076 - RNA, 36 nt, Artificial Sequence
  Description of Artificial Sequence:  Enzymatic Nucleic Acid
aagaaugauggcaugcacuaugcgcgagaggcauac

SEQ ID NO: 13077 - RNA, 36 nt, Artificial Sequence
  Description of Artificial Sequence:  Enzymatic Nucleic Acid
uggcaugauggcaugcacuaugcgcgauaagaacag

SEQ ID NO: 13078 - RNA, 36 nt, Artificial Sequence
  Description of Artificial Sequence:  Enzymatic Nucleic Acid
uguggugauggcaugcacuaugcgcgacauaagaac

SEQ ID NO: 13079 - RNA, 36 nt, Artificial Sequence
  Description of Artificial Sequence:  Enzymatic Nucleic Acid
uuaaaugauggcaugcacuaugcgcgaaggaugugg

SEQ ID NO: 13080 - RNA, 36 nt, Artificial Sequence
  Description of Artificial Sequence:  Enzymatic Nucleic Acid
ucauaugauggcaugcacuaugcgcgagagagccuu

SEQ ID NO: 13081 - RNA, 36 nt, Artificial Sequence
  Description of Artificial Sequence:  Enzymatic Nucleic Acid
cucuuugauggcaugcacuaugcgcgauacagagag

SEQ ID NO: 13082 - RNA, 36 nt, Artificial Sequence
  Description of Artificial Sequence:  Enzymatic Nucleic Acid
aggcuugauggcaugcacuaugcgcgacuagggaau

SEQ ID NO: 13083 - RNA, 36 nt, Artificial Sequence
  Description of Artificial Sequence:  Enzymatic Nucleic Acid
uuccaugauggcaugcacuaugcgcgaaaagccgcu

SEQ ID NO: 13084 - RNA, 36 nt, Artificial Sequence
  Description of Artificial Sequence:  Enzymatic Nucleic Acid
aacaaugauggcaugcacuaugcgcgaaagauuugu

SEQ ID NO: 13085 - RNA, 36 nt, Artificial Sequence
  Description of Artificial Sequence:  Enzymatic Nucleic Acid
aggaaugauggcaugcacuaugcgcgaacaaagauu

SEQ ID NO: 13086 - RNA, 36 nt, Artificial Sequence
  Description of Artificial Sequence:  Enzymatic Nucleic Acid
guuugugauggcaugcacuaugcgcgguauguguaa

SEQ ID NO: 13087 - RNA, 36 nt, Artificial Sequence
  Description of Artificial Sequence:  Enzymatic Nucleic Acid
ugucaugauggcaugcacuaugcgcgaggugguuug

SEQ ID NO: 13088 - RNA, 36 nt, Artificial Sequence
  Description of Artificial Sequence:  Enzymatic Nucleic Acid
gcuguugauggcaugcacuaugcgcgacaggugguu

SEQ ID NO: 13089 - RNA, 36 nt, Artificial Sequence
  Description of Artificial Sequence:  Enzymatic Nucleic Acid
guuauugauggcaugcacuaugcgcgacuauuugcu

SEQ ID NO: 13090 - RNA, 36 nt, Artificial Sequence
  Description of Artificial Sequence:  Enzymatic Nucleic Acid
augaaugauggcaugcacuaugcgcgagcuaagguu

SEQ ID NO: 13091 - RNA, 36 nt, Artificial Sequence
  Description of Artificial Sequence:  Enzymatic Nucleic Acid
caagaugauggcaugcacuaugcgcgaugaacagcu

SEQ ID NO: 13092 - RNA, 36 nt, Artificial Sequence
  Description of Artificial Sequence:  Enzymatic Nucleic Acid
gaaauugauggcaugcacuaugcgcgaagacaugaa

SEQ ID NO: 13093 - RNA, 36 nt, Artificial Sequence
  Description of Artificial Sequence:  Enzymatic Nucleic Acid
aguaaugauggcaugcacuaugcgcgaauucuaaug

SEQ ID NO: 13094 - RNA, 36 nt, Artificial Sequence
  Description of Artificial Sequence:  Enzymatic Nucleic Acid
ugcuaugauggcaugcacuaugcgcgaaaccugagu

SEQ ID NO: 13095 - RNA, 36 nt, Artificial Sequence
  Description of Artificial Sequence:  Enzymatic Nucleic Acid
ggacuugauggcaugcacuaugcgcgauguaugcua

SEQ ID NO: 13096 - RNA, 36 nt, Artificial Sequence
  Description of Artificial Sequence:  Enzymatic Nucleic Acid
uucuaugauggcaugcacuaugcgcgauuaagacuc

SEQ ID NO: 13097 - RNA, 36 nt, Artificial Sequence
  Description of Artificial Sequence:  Enzymatic Nucleic Acid
uauuaugauggcaugcacuaugcgcgaagucuccau

SEQ ID NO: 13098 - RNA, 36 nt, Artificial Sequence
  Description of Artificial Sequence:  Enzymatic Nucleic Acid
uagcuugauggcaugcacuaugcgcgauuauuacaa

SEQ ID NO: 13099 - RNA, 36 nt, Artificial Sequence
  Description of Artificial Sequence:  Enzymatic Nucleic Acid
acaagugauggcaugcacuaugcgcgacuuuguaac

SEQ ID NO: 13100 - RNA, 36 nt, Artificial Sequence
  Description of Artificial Sequence:  Enzymatic Nucleic Acid
augaaugauggcaugcacuaugcgcgaagcacuuug

SEQ ID NO: 13101 - RNA, 36 nt, Artificial Sequence
  Description of Artificial Sequence:  Enzymatic Nucleic Acid
auuuuugauggcaugcacuaugcgcgagugcuauuu

SEQ ID NO: 13102 - RNA, 36 nt, Artificial Sequence
  Description of Artificial Sequence:  Enzymatic Nucleic Acid
uguuuugauggcaugcacuaugcgcgaauuuucagu

SEQ ID NO: 13103 - RNA, 36 nt, Artificial Sequence
  Description of Artificial Sequence:  Enzymatic Nucleic Acid
uaauuugauggcaugcacuaugcgcgauguuucaau

SEQ ID NO: 13104 - RNA, 36 nt, Artificial Sequence
  Description of Artificial Sequence:  Enzymatic Nucleic Acid
auuauugauggcaugcacuaugcgcgaguuaauuca

SEQ ID NO: 13105 - RNA, 36 nt, Artificial Sequence
  Description of Artificial Sequence:  Enzymatic Nucleic Acid
aauggugauggcaugcacuaugcgcgaaaugauugg

SEQ ID NO: 13106 - RNA, 36 nt, Artificial Sequence
  Description of Artificial Sequence:  Enzymatic Nucleic Acid
uuuguugauggcaugcacuaugcgcgauaaauggca

SEQ ID NO: 13107 - RNA, 36 nt, Artificial Sequence
  Description of Artificial Sequence:  Enzymatic Nucleic Acid
gugcuugauggcaugcacuaugcgcgguucuuuguu

SEQ ID NO: 13108 - RNA, 36 nt, Artificial Sequence
  Description of Artificial Sequence:  Enzymatic Nucleic Acid
uaucuugauggcaugcacuaugcgcgagaaacucug

SEQ ID NO: 13109 - RNA, 36 nt, Artificial Sequence
  Description of Artificial Sequence:  Enzymatic Nucleic Acid
acguaugauggcaugcacuaugcgcgauuaucucag

SEQ ID NO: 13110 - RNA, 36 nt, Artificial Sequence
  Description of Artificial Sequence:  Enzymatic Nucleic Acid
gguuuugauggcaugcacuaugcgcgagccccauuc

SEQ ID NO: 13111 - RNA, 36 nt, Artificial Sequence
  Description of Artificial Sequence:  Enzymatic Nucleic Acid
uugcaugauggcaugcacuaugcgcgaugguuucag

SEQ ID NO: 13112 - RNA, 36 nt, Artificial Sequence
  Description of Artificial Sequence:  Enzymatic Nucleic Acid
acuugugauggcaugcacuaugcgcgacaugguuuc

SEQ ID NO: 13113 - RNA, 36 nt, Artificial Sequence
  Description of Artificial Sequence:  Enzymatic Nucleic Acid
agacaugauggcaugcacuaugcgcgagacuugcac

SEQ ID NO: 13114 - RNA, 36 nt, Artificial Sequence
  Description of Artificial Sequence:  Enzymatic Nucleic Acid
caagaugauggcaugcacuaugcgcgacagacuugc

SEQ ID NO: 13115 - RNA, 36 nt, Artificial Sequence
  Description of Artificial Sequence:  Enzymatic Nucleic Acid
acugaugauggcaugcacuaugcgcgaagacacaga

SEQ ID NO: 13116 - RNA, 36 nt, Artificial Sequence
  Description of Artificial Sequence:  Enzymatic Nucleic Acid
gguguugauggcaugcacuaugcgcgacuucuugga

SEQ ID NO: 13117 - RNA, 36 nt, Artificial Sequence
  Description of Artificial Sequence:  Enzymatic Nucleic Acid
caucuugauggcaugcacuaugcgcgggugucacuu

SEQ ID NO: 13118 - RNA, 36 nt, Artificial Sequence
  Description of Artificial Sequence:  Enzymatic Nucleic Acid
auuaaugauggcaugcacuaugcgcgaucucggugu

SEQ ID NO: 13119 - RNA, 36 nt, Artificial Sequence
  Description of Artificial Sequence:  Enzymatic Nucleic Acid
caaggugauggcaugcacuaugcgcgacgggucccu

SEQ ID NO: 13120 - RNA, 36 nt, Artificial Sequence
  Description of Artificial Sequence:  Enzymatic Nucleic Acid
ggaaaugauggcaugcacuaugcgcgaaggcacggg

SEQ ID NO: 13121 - RNA, 36 nt, Artificial Sequence
  Description of Artificial Sequence:  Enzymatic Nucleic Acid
guuugugauggcaugcacuaugcgcgauucuugugg

SEQ ID NO: 13122 - RNA, 36 nt, Artificial Sequence
  Description of Artificial Sequence:  Enzymatic Nucleic Acid
gcuagugauggcaugcacuaugcgcggaguaucugu

SEQ ID NO: 13123 - RNA, 36 nt, Artificial Sequence
  Description of Artificial Sequence:  Enzymatic Nucleic Acid
uuaauugauggcaugcacuaugcgcgaauuuaaaug

SEQ ID NO: 13124 - RNA, 36 nt, Artificial Sequence
  Description of Artificial Sequence:  Enzymatic Nucleic Acid
agaugugauggcaugcacuaugcgcgacuccuccuu

SEQ ID NO: 13125 - RNA, 36 nt, Artificial Sequence
  Description of Artificial Sequence:  Enzymatic Nucleic Acid
acuguugauggcaugcacuaugcgcgggccaaagau

SEQ ID NO: 13126 - RNA, 36 nt, Artificial Sequence
  Description of Artificial Sequence:  Enzymatic Nucleic Acid
aguuaugauggcaugcacuaugcgcgaccacugucg

SEQ ID NO: 13127 - RNA, 36 nt, Artificial Sequence
  Description of Artificial Sequence:  Enzymatic Nucleic Acid
acacaugauggcaugcacuaugcgcgaguuacacca

SEQ ID NO: 13128 - RNA, 36 nt, Artificial Sequence
  Description of Artificial Sequence:  Enzymatic Nucleic Acid
acacaugauggcaugcacuaugcgcgacaguuacac

SEQ ID NO: 13129 - RNA, 36 nt, Artificial Sequence
  Description of Artificial Sequence:  Enzymatic Nucleic Acid
acacaugauggcaugcacuaugcgcgacacaguuac

SEQ ID NO: 13130 - RNA, 36 nt, Artificial Sequence
  Description of Artificial Sequence:  Enzymatic Nucleic Acid
acacaugauggcaugcacuaugcgcgacacacaguu

SEQ ID NO: 13131 - RNA, 36 nt, Artificial Sequence
  Description of Artificial Sequence:  Enzymatic Nucleic Acid
acacaugauggcaugcacuaugcgcgacacacacag

SEQ ID NO: 13132 - RNA, 36 nt, Artificial Sequence
  Description of Artificial Sequence:  Enzymatic Nucleic Acid
acacaugauggcaugcacuaugcgcgacacacacac

SEQ ID NO: 13133 - RNA, 36 nt, Artificial Sequence
  Description of Artificial Sequence:  Enzymatic Nucleic Acid
ccacaugauggcaugcacuaugcgcgacacacacac

SEQ ID NO: 13134 - RNA, 36 nt, Artificial Sequence
  Description of Artificial Sequence:  Enzymatic Nucleic Acid
acccaugauggcaugcacuaugcgcgacacacacac

SEQ ID NO: 13135 - RNA, 36 nt, Artificial Sequence
  Description of Artificial Sequence:  Enzymatic Nucleic Acid
acccaugauggcaugcacuaugcgcgacccacacac

SEQ ID NO: 13136 - RNA, 36 nt, Artificial Sequence
  Description of Artificial Sequence:  Enzymatic Nucleic Acid
acauaugauggcaugcacuaugcgcgacccacaccc

SEQ ID NO: 13137 - RNA, 36 nt, Artificial Sequence
  Description of Artificial Sequence:  Enzymatic Nucleic Acid
acacaugauggcaugcacuaugcgcgauacacccac

SEQ ID NO: 13138 - RNA, 36 nt, Artificial Sequence
  Description of Artificial Sequence:  Enzymatic Nucleic Acid
aaacaugauggcaugcacuaugcgcgacauacaccc

SEQ ID NO: 13139 - RNA, 36 nt, Artificial Sequence
  Description of Artificial Sequence:  Enzymatic Nucleic Acid
caaaaugauggcaugcacuaugcgcgacacauacac

SEQ ID NO: 13140 - RNA, 36 nt, Artificial Sequence
  Description of Artificial Sequence:  Enzymatic Nucleic Acid
augcaugauggcaugcacuaugcgcgaaaacacaca

SEQ ID NO: 13141 - RNA, 36 nt, Artificial Sequence
  Description of Artificial Sequence:  Enzymatic Nucleic Acid
uuaugugauggcaugcacuaugcgcgacaaaacaca

SEQ ID NO: 13142 - RNA, 36 nt, Artificial Sequence
  Description of Artificial Sequence:  Enzymatic Nucleic Acid
uguagugauggcaugcacuaugcgcgauauauucuu

SEQ ID NO: 13143 - RNA, 36 nt, Artificial Sequence
  Description of Artificial Sequence:  Enzymatic Nucleic Acid
uucauugauggcaugcacuaugcgcgaugacuagaa

SEQ ID NO: 13144 - RNA, 36 nt, Artificial Sequence
  Description of Artificial Sequence:  Enzymatic Nucleic Acid
acauuugauggcaugcacuaugcgcgaucaugacua

SEQ ID NO: 13145 - RNA, 36 nt, Artificial Sequence
  Description of Artificial Sequence:  Enzymatic Nucleic Acid
aaauaugauggcaugcacuaugcgcgauucaucaug

SEQ ID NO: 13146 - RNA, 36 nt, Artificial Sequence
  Description of Artificial Sequence:  Enzymatic Nucleic Acid
guauaugauggcaugcacuaugcgcgaaaauacauu

SEQ ID NO: 13147 - RNA, 36 nt, Artificial Sequence
  Description of Artificial Sequence:  Enzymatic Nucleic Acid
gauuaugauggcaugcacuaugcgcgaaaucccaau

SEQ ID NO: 13148 - RNA, 36 nt, Artificial Sequence
  Description of Artificial Sequence:  Enzymatic Nucleic Acid
uuuauugauggcaugcacuaugcgcgaauuaaguug

SEQ ID NO: 13149 - RNA, 36 nt, Artificial Sequence
  Description of Artificial Sequence:  Enzymatic Nucleic Acid
aaaagugauggcaugcacuaugcgcgaguugccaag

SEQ ID NO: 13150 - RNA, 36 nt, Artificial Sequence
  Description of Artificial Sequence:  Enzymatic Nucleic Acid
cagaaugauggcaugcacuaugcgcgauaaaagcag

SEQ ID NO: 13151 - RNA, 36 nt, Artificial Sequence
  Description of Artificial Sequence:  Enzymatic Nucleic Acid
ggagaugauggcaugcacuaugcgcgagaacauaaa

SEQ ID NO: 13152 - RNA, 36 nt, Artificial Sequence
  Description of Artificial Sequence:  Enzymatic Nucleic Acid
cuaaaugauggcaugcacuaugcgcgaaggauaaau

SEQ ID NO: 13153 - RNA, 36 nt, Artificial Sequence
  Description of Artificial Sequence:  Enzymatic Nucleic Acid
cauuuugauggcaugcacuaugcgcgaaaguuuuuc

SEQ ID NO: 13154 - RNA, 36 nt, Artificial Sequence
  Description of Artificial Sequence:  Enzymatic Nucleic Acid
uuuagugauggcaugcacuaugcgcgaauuuuuuga

SEQ ID NO: 13155 - RNA, 36 nt, Artificial Sequence
  Description of Artificial Sequence:  Enzymatic Nucleic Acid
acuaaugauggcaugcacuaugcgcgauuuaguuuu

SEQ ID NO: 13156 - RNA, 36 nt, Artificial Sequence
  Description of Artificial Sequence:  Enzymatic Nucleic Acid
acaauugauggcaugcacuaugcgcgagcuaaacua

SEQ ID NO: 13157 - RNA, 36 nt, Artificial Sequence
  Description of Artificial Sequence:  Enzymatic Nucleic Acid
ccauaugauggcaugcacuaugcgcgaaucagcuaa

SEQ ID NO: 13158 - RNA, 36 nt, Artificial Sequence
  Description of Artificial Sequence:  Enzymatic Nucleic Acid
agguuugauggcaugcacuaugcgcggaaaacccca

SEQ ID NO: 13159 - RNA, 36 nt, Artificial Sequence
  Description of Artificial Sequence:  Enzymatic Nucleic Acid
acaaaugauggcaugcacuaugcgcgaaaaagugaa

SEQ ID NO: 13160 - RNA, 36 nt, Artificial Sequence
  Description of Artificial Sequence:  Enzymatic Nucleic Acid
uaaaaugauggcaugcacuaugcgcgaaacaaaaag

SEQ ID NO: 13161 - RNA, 36 nt, Artificial Sequence
  Description of Artificial Sequence:  Enzymatic Nucleic Acid
uuacaugauggcaugcacuaugcgcgaguugugaaa

SEQ ID NO: 13162 - RNA, 36 nt, Artificial Sequence
  Description of Artificial Sequence:  Enzymatic Nucleic Acid
auuuaugauggcaugcacuaugcgcgacaguuguga

SEQ ID NO: 13163 - RNA, 36 nt, Artificial Sequence
  Description of Artificial Sequence:  Enzymatic Nucleic Acid
auuggugauggcaugcacuaugcgcgaauuuacaca

SEQ ID NO: 13164 - RNA, 36 nt, Artificial Sequence
  Description of Artificial Sequence:  Enzymatic Nucleic Acid
auggaugauggcaugcacuaugcgcgaggaauuauu

SEQ ID NO: 13165 - RNA, 36 nt, Artificial Sequence
  Description of Artificial Sequence:  Enzymatic Nucleic Acid
auuuuugauggcaugcacuaugcgcgauggacagga

SEQ ID NO: 13166 - RNA, 36 nt, Artificial Sequence
  Description of Artificial Sequence:  Enzymatic Nucleic Acid
auuugugauggcaugcacuaugcgcgauuuucaugg

SEQ ID NO: 13167 - RNA, 36 nt, Artificial Sequence
  Description of Artificial Sequence:  Enzymatic Nucleic Acid
aucuaugauggcaugcacuaugcgcgacuggauaau

SEQ ID NO: 13168 - RNA, 36 nt, Artificial Sequence
  Description of Artificial Sequence:  Enzymatic Nucleic Acid
augguugauggcaugcacuaugcgcgaaauauaucu

SEQ ID NO: 13169 - RNA, 36 nt, Artificial Sequence
  Description of Artificial Sequence:  Enzymatic Nucleic Acid
aaaggugauggcaugcacuaugcgcgaaaacuagcc

SEQ ID NO: 13170 - RNA, 36 nt, Artificial Sequence
  Description of Artificial Sequence:  Enzymatic Nucleic Acid
acauuugauggcaugcacuaugcgcgaggcugaaau

SEQ ID NO: 13171 - RNA, 36 nt, Artificial Sequence
  Description of Artificial Sequence:  Enzymatic Nucleic Acid
gcagaugauggcaugcacuaugcgcgauucaggcug

SEQ ID NO: 13172 - RNA, 36 nt, Artificial Sequence
  Description of Artificial Sequence:  Enzymatic Nucleic Acid
auaggugauggcaugcacuaugcgcgagacauucag

SEQ ID NO: 13173 - RNA, 36 nt, Artificial Sequence
  Description of Artificial Sequence:  Enzymatic Nucleic Acid
aagagugauggcaugcacuaugcgcgagagaauaua

SEQ ID NO: 13174 - RNA, 36 nt, Artificial Sequence
  Description of Artificial Sequence:  Enzymatic Nucleic Acid
gaauaugauggcaugcacuaugcgcgaaagagcaga

SEQ ID NO: 13175 - RNA, 36 nt, Artificial Sequence
  Description of Artificial Sequence:  Enzymatic Nucleic Acid
ggguuugauggcaugcacuaugcgcgaaaggagaau

SEQ ID NO: 13176 - RNA, 36 nt, Artificial Sequence
  Description of Artificial Sequence:  Enzymatic Nucleic Acid
ugccaugauggcaugcacuaugcgcgaggauguuuu

SEQ ID NO: 13177 - RNA, 38 nt, Artificial Sequence
  Description of Artificial Sequence:  Enzymatic Nucleic Acid
  misc_feature (31)..(31): n stands for inosine
cggccagccugaugaggccguuaggccgaancaccuug

SEQ ID NO: 13178 - RNA, 38 nt, Artificial Sequence
  Description of Artificial Sequence:  Enzymatic Nucleic Acid
  misc_feature (31)..(31): n stands for inosine
cgacggcccugaugaggccguuaggccgaancagcacc

SEQ ID NO: 13179 - RNA, 38 nt, Artificial Sequence
  Description of Artificial Sequence:  Enzymatic Nucleic Acid
  misc_feature (31)..(31): n stands for inosine
agggcgaccugaugaggccguuaggccgaanccagcag

SEQ ID NO: 13180 - RNA, 38 nt, Artificial Sequence
  Description of Artificial Sequence:  Enzymatic Nucleic Acid
  misc_feature (31)..(31): n stands for inosine
agccacagcugaugaggccguuaggccgaancgacggc

SEQ ID NO: 13181 - RNA, 38 nt, Artificial Sequence
  Description of Artificial Sequence:  Enzymatic Nucleic Acid
  misc_feature (31)..(31): n stands for inosine
gagccacacugaugaggccguuaggccgaangcgacgg

SEQ ID NO: 13182 - RNA, 38 nt, Artificial Sequence
  Description of Artificial Sequence:  Enzymatic Nucleic Acid
  misc_feature (31)..(31): n stands for inosine
agagccaccugaugaggccguuaggccgaanggcgacg

SEQ ID NO: 13183 - RNA, 38 nt, Artificial Sequence
  Description of Artificial Sequence:  Enzymatic Nucleic Acid
  misc_feature (31)..(31): n stands for inosine
ccacgcagcugaugaggccguuaggccgaanccacagg

SEQ ID NO: 13184 - RNA, 38 nt, Artificial Sequence
  Description of Artificial Sequence:  Enzymatic Nucleic Acid
  misc_feature (31)..(31): n stands for inosine
cuccacgccugaugaggccguuaggccgaanagccaca

SEQ ID NO: 13185 - RNA, 38 nt, Artificial Sequence
  Description of Artificial Sequence:  Enzymatic Nucleic Acid
  misc_feature (31)..(31): n stands for inosine
gcggcccgcugaugaggccguuaggccgaanucuccac

SEQ ID NO: 13186 - RNA, 38 nt, Artificial Sequence
  Description of Artificial Sequence:  Enzymatic Nucleic Acid
  misc_feature (31)..(31): n stands for inosine
ggcggccccugaugaggccguuaggccgaangucucca

SEQ ID NO: 13187 - RNA, 38 nt, Artificial Sequence
  Description of Artificial Sequence:  Enzymatic Nucleic Acid
  misc_feature (31)..(31): n stands for inosine
acagaggccugaugaggccguuaggccgaancccgggu

SEQ ID NO: 13188 - RNA, 38 nt, Artificial Sequence
  Description of Artificial Sequence:  Enzymatic Nucleic Acid
  misc_feature (31)..(31): n stands for inosine
cccacagacugaugaggccguuaggccgaancggcccg

SEQ ID NO: 13189 - RNA, 38 nt, Artificial Sequence
  Description of Artificial Sequence:  Enzymatic Nucleic Acid
  misc_feature (31)..(31): n stands for inosine
acccacagcugaugaggccguuaggccgaangcggccc

SEQ ID NO: 13190 - RNA, 38 nt, Artificial Sequence
  Description of Artificial Sequence:  Enzymatic Nucleic Acid
  misc_feature (31)..(31): n stands for inosine
aaacccaccugaugaggccguuaggccgaanaggcggc

SEQ ID NO: 13191 - RNA, 38 nt, Artificial Sequence
  Description of Artificial Sequence:  Enzymatic Nucleic Acid
  misc_feature (31)..(31): n stands for inosine
aaacacuacugaugaggccguuaggccgaancaaaccc

SEQ ID NO: 13192 - RNA, 38 nt, Artificial Sequence
  Description of Artificial Sequence:  Enzymatic Nucleic Acid
  misc_feature (31)..(31): n stands for inosine
gaaacacucugaugaggccguuaggccgaangcaaacc

SEQ ID NO: 13193 - RNA, 38 nt, Artificial Sequence
  Description of Artificial Sequence:  Enzymatic Nucleic Acid
  misc_feature (31)..(31): n stands for inosine
agaucaagcugaugaggccguuaggccgaanaaacacu

SEQ ID NO: 13194 - RNA, 38 nt, Artificial Sequence
  Description of Artificial Sequence:  Enzymatic Nucleic Acid
  misc_feature (31)..(31): n stands for inosine
gcagaucacugaugaggccguuaggccgaanagaaaca

SEQ ID NO: 13195 - RNA, 38 nt, Artificial Sequence
  Description of Artificial Sequence:  Enzymatic Nucleic Acid
  misc_feature (31)..(31): n stands for inosine
gccugggccugaugaggccguuaggccgaanaucaaga

SEQ ID NO: 13196 - RNA, 38 nt, Artificial Sequence
  Description of Artificial Sequence:  Enzymatic Nucleic Acid
  misc_feature (31)..(31): n stands for inosine
ugagccugcugaugaggccguuaggccgaancagauca

SEQ ID NO: 13197 - RNA, 38 nt, Artificial Sequence
  Description of Artificial Sequence:  Enzymatic Nucleic Acid
  misc_feature (31)..(31): n stands for inosine
cugagccucugaugaggccguuaggccgaangcagauc

SEQ ID NO: 13198 - RNA, 38 nt, Artificial Sequence
  Description of Artificial Sequence:  Enzymatic Nucleic Acid
  misc_feature (31)..(31): n stands for inosine
gcugagcccugaugaggccguuaggccgaanggcagau

SEQ ID NO: 13199 - RNA, 38 nt, Artificial Sequence
  Description of Artificial Sequence:  Enzymatic Nucleic Acid
  misc_feature (31)..(31): n stands for inosine
guaugcugcugaugaggccguuaggccgaanccugggc

SEQ ID NO: 13200 - RNA, 38 nt, Artificial Sequence
  Description of Artificial Sequence:  Enzymatic Nucleic Acid
  misc_feature (31)..(31): n stands for inosine
uuguaugccugaugaggccguuaggccgaanagccugg

SEQ ID NO: 13201 - RNA, 38 nt, Artificial Sequence
  Description of Artificial Sequence:  Enzymatic Nucleic Acid
  misc_feature (31)..(31): n stands for inosine
uuuuuguacugaugaggccguuaggccgaancugagcc

SEQ ID NO: 13202 - RNA, 38 nt, Artificial Sequence
  Description of Artificial Sequence:  Enzymatic Nucleic Acid
  misc_feature (31)..(31): n stands for inosine
ugucuuuucugaugaggccguuaggccgaanuaugcug

SEQ ID NO: 13203 - RNA, 38 nt, Artificial Sequence
  Description of Artificial Sequence:  Enzymatic Nucleic Acid
  misc_feature (31)..(31): n stands for inosine
uguaaguacugaugaggccguuaggccgaanucuuuuu

SEQ ID NO: 13204 - RNA, 38 nt, Artificial Sequence
  Description of Artificial Sequence:  Enzymatic Nucleic Acid
  misc_feature (31)..(31): n stands for inosine
uaauuguacugaugaggccguuaggccgaanuaugucu

SEQ ID NO: 13205 - RNA, 38 nt, Artificial Sequence
  Description of Artificial Sequence:  Enzymatic Nucleic Acid
  misc_feature (31)..(31): n stands for inosine
gccuuaaucugaugaggccguuaggccgaanuaaguau

SEQ ID NO: 13206 - RNA, 38 nt, Artificial Sequence
  Description of Artificial Sequence:  Enzymatic Nucleic Acid
  misc_feature (31)..(31): n stands for inosine
guuguauucugaugaggccguuaggccgaanccuuaau

SEQ ID NO: 13207 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaanuauuagc

SEQ ID NO: 13208 - RNA, 38 nt, Artificial Sequence
  Description of Artificial Sequence:  Enzymatic Nucleic Acid
  misc_feature (31)..(31): n stands for inosine
auuugaagcugaugaggccguuaggccgaanuuguauu

SEQ ID NO: 13209 - RNA, 38 nt, Artificial Sequence
  Description of Artificial Sequence:  Enzymatic Nucleic Acid
  misc_feature (31)..(31): n stands for inosine
uaauuugacugaugaggccguuaggccgaanaguugua

SEQ ID NO: 13210 - RNA, 38 nt, Artificial Sequence
  Description of Artificial Sequence:  Enzymatic Nucleic Acid
  misc_feature (31)..(31): n stands for inosine
aaguaauucugaugaggccguuaggccgaanaagaguu

SEQ ID NO: 13211 - RNA, 38 nt, Artificial Sequence
  Description of Artificial Sequence:  Enzymatic Nucleic Acid
  misc_feature (31)..(31): n stands for inosine
ccccugcacugaugaggccguuaggccgaanuaauuug

SEQ ID NO: 13212 - RNA, 38 nt, Artificial Sequence
  Description of Artificial Sequence:  Enzymatic Nucleic Acid
  misc_feature (31)..(31): n stands for inosine
cugucccccugaugaggccguuaggccgaancaaguaa

SEQ ID NO: 13213 - RNA, 38 nt, Artificial Sequence
  Description of Artificial Sequence:  Enzymatic Nucleic Acid
  misc_feature (31)..(31): n stands for inosine
agucccuccugaugaggccguuaggccgaanuccccug

SEQ ID NO: 13214 - RNA, 38 nt, Artificial Sequence
  Description of Artificial Sequence:  Enzymatic Nucleic Acid
  misc_feature (31)..(31): n stands for inosine
ccaguccacugaugaggccguuaggccgaanucccucu

SEQ ID NO: 13215 - RNA, 38 nt, Artificial Sequence
  Description of Artificial Sequence:  Enzymatic Nucleic Acid
  misc_feature (31)..(31): n stands for inosine
ccaaagcccugaugaggccguuaggccgaanuccaagu

SEQ ID NO: 13216 - RNA, 38 nt, Artificial Sequence
  Description of Artificial Sequence:  Enzymatic Nucleic Acid
  misc_feature (31)..(31): n stands for inosine
ugggccaacugaugaggccguuaggccgaanccagucc

SEQ ID NO: 13217 - RNA, 38 nt, Artificial Sequence
  Description of Artificial Sequence:  Enzymatic Nucleic Acid
  misc_feature (31)..(31): n stands for inosine
gauuauugcugaugaggccguuaggccgaanccaaagc

SEQ ID NO: 13218 - RNA, 38 nt, Artificial Sequence
  Description of Artificial Sequence:  Enzymatic Nucleic Acid
  misc_feature (31)..(31): n stands for inosine
ugauuauucugaugaggccguuaggccgaangccaaag

SEQ ID NO: 13219 - RNA, 38 nt, Artificial Sequence
  Description of Artificial Sequence:  Enzymatic Nucleic Acid
  misc_feature (31)..(31): n stands for inosine
cugauuaucugaugaggccguuaggccgaanggccaaa

SEQ ID NO: 13220 - RNA, 38 nt, Artificial Sequence
  Description of Artificial Sequence:  Enzymatic Nucleic Acid
  misc_feature (31)..(31): n stands for inosine
ugccacuccugaugaggccguuaggccgaanauuauug

SEQ ID NO: 13221 - RNA, 38 nt, Artificial Sequence
  Description of Artificial Sequence:  Enzymatic Nucleic Acid
  misc_feature (31)..(31): n stands for inosine
uugcucaccugaugaggccguuaggccgaanccacucu

SEQ ID NO: 13222 - RNA, 38 nt, Artificial Sequence
  Description of Artificial Sequence:  Enzymatic Nucleic Acid
  misc_feature (31)..(31): n stands for inosine
ccacccuucugaugaggccguuaggccgaancucacug

SEQ ID NO: 13223 - RNA, 38 nt, Artificial Sequence
  Description of Artificial Sequence:  Enzymatic Nucleic Acid
  misc_feature (31)..(31): n stands for inosine
cugcacuccugaugaggccguuaggccgaanucaccuc

SEQ ID NO: 13224 - RNA, 38 nt, Artificial Sequence
  Description of Artificial Sequence:  Enzymatic Nucleic Acid
  misc_feature (31)..(31): n stands for inosine
gccaucgccugaugaggccguuaggccgaancacucag

SEQ ID NO: 13225 - RNA, 38 nt, Artificial Sequence
  Description of Artificial Sequence:  Enzymatic Nucleic Acid
  misc_feature (31)..(31): n stands for inosine
acagaagacugaugaggccguuaggccgaanccaucgc

SEQ ID NO: 13226 - RNA, 38 nt, Artificial Sequence
  Description of Artificial Sequence:  Enzymatic Nucleic Acid
  misc_feature (31)..(31): n stands for inosine
uacagaagcugaugaggccguuaggccgaangccaucg

SEQ ID NO: 13227 - RNA, 38 nt, Artificial Sequence
  Description of Artificial Sequence:  Enzymatic Nucleic Acid
  misc_feature (31)..(31): n stands for inosine
cuuacagacugaugaggccguuaggccgaanaggccau

SEQ ID NO: 13228 - RNA, 38 nt, Artificial Sequence
  Description of Artificial Sequence:  Enzymatic Nucleic Acid
  misc_feature (31)..(31): n stands for inosine
ugucuuaccugaugaggccguuaggccgaanaagaggc

SEQ ID NO: 13229 - RNA, 38 nt, Artificial Sequence
  Description of Artificial Sequence:  Enzymatic Nucleic Acid
  misc_feature (31)..(31): n stands for inosine
auugugagcugaugaggccguuaggccgaanucuuaca

SEQ ID NO: 13230 - RNA, 38 nt, Artificial Sequence
  Description of Artificial Sequence:  Enzymatic Nucleic Acid
  misc_feature (31)..(31): n stands for inosine
gaauugugcugaugaggccguuaggccgaanugucuua

SEQ ID NO: 13231 - RNA, 38 nt, Artificial Sequence
  Description of Artificial Sequence:  Enzymatic Nucleic Acid
  misc_feature (31)..(31): n stands for inosine
uggaauugcugaugaggccguuaggccgaanagugucu

SEQ ID NO: 13232 - RNA, 38 nt, Artificial Sequence
  Description of Artificial Sequence:  Enzymatic Nucleic Acid
  misc_feature (31)..(31): n stands for inosine
uuuggaaucugaugaggccguuaggccgaanugagugu

SEQ ID NO: 13233 - RNA, 38 nt, Artificial Sequence
  Description of Artificial Sequence:  Enzymatic Nucleic Acid
  misc_feature (31)..(31): n stands for inosine
ucacuuuucugaugaggccguuaggccgaanaauugug

SEQ ID NO: 13234 - RNA, 38 nt, Artificial Sequence
  Description of Artificial Sequence:  Enzymatic Nucleic Acid
  misc_feature (31)..(31): n stands for inosine
aucacuuucugaugaggccguuaggccgaangaauugu

SEQ ID NO: 13235 - RNA, 38 nt, Artificial Sequence
  Description of Artificial Sequence:  Enzymatic Nucleic Acid
  misc_feature (31)..(31): n stands for inosine
ggcuccagcugaugaggccguuaggccgaanucauuuc

SEQ ID NO: 13236 - RNA, 38 nt, Artificial Sequence
  Description of Artificial Sequence:  Enzymatic Nucleic Acid
  misc_feature (31)..(31): n stands for inosine
uaggcucccugaugaggccguuaggccgaanugucauu

SEQ ID NO: 13237 - RNA, 38 nt, Artificial Sequence
  Description of Artificial Sequence:  Enzymatic Nucleic Acid
  misc_feature (31)..(31): n stands for inosine
cacuuguacugaugaggccguuaggccgaancuccagu

SEQ ID NO: 13238 - RNA, 38 nt, Artificial Sequence
  Description of Artificial Sequence:  Enzymatic Nucleic Acid
  misc_feature (31)..(31): n stands for inosine
gcacuugucugaugaggccguuaggccgaangcuccag

SEQ ID NO: 13239 - RNA, 38 nt, Artificial Sequence
  Description of Artificial Sequence:  Enzymatic Nucleic Acid
  misc_feature (31)..(31): n stands for inosine
gaagcacucugaugaggccguuaggccgaanuaggcuc

SEQ ID NO: 13240 - RNA, 38 nt, Artificial Sequence
  Description of Artificial Sequence:  Enzymatic Nucleic Acid
  misc_feature (31)..(31): n stands for inosine
ccgguagacugaugaggccguuaggccgaancacuugu

SEQ ID NO: 13241 - RNA, 38 nt, Artificial Sequence
  Description of Artificial Sequence:  Enzymatic Nucleic Acid
  misc_feature (31)..(31): n stands for inosine
uucccggucugaugaggccguuaggccgaanaagcacu

SEQ ID NO: 13242 - RNA, 38 nt, Artificial Sequence
  Description of Artificial Sequence:  Enzymatic Nucleic Acid
  misc_feature (31)..(31): n stands for inosine
aguuuccccugaugaggccguuaggccgaanuagaagc

SEQ ID NO: 13243 - RNA, 38 nt, Artificial Sequence
  Description of Artificial Sequence:  Enzymatic Nucleic Acid
  misc_feature (31)..(31): n stands for inosine
gccaaguccugaugaggccguuaggccgaanuuucccg

SEQ ID NO: 13244 - RNA, 38 nt, Artificial Sequence
  Description of Artificial Sequence:  Enzymatic Nucleic Acid
  misc_feature (31)..(31): n stands for inosine
cgaggccacugaugaggccguuaggccgaanucaguuu

SEQ ID NO: 13245 - RNA, 38 nt, Artificial Sequence
  Description of Artificial Sequence:  Enzymatic Nucleic Acid
  misc_feature (31)..(31): n stands for inosine
augaccgacugaugaggccguuaggccgaanccaaguc

SEQ ID NO: 13246 - RNA, 38 nt, Artificial Sequence
  Description of Artificial Sequence:  Enzymatic Nucleic Acid
  misc_feature (31)..(31): n stands for inosine
aaugaccgcugaugaggccguuaggccgaangccaagu

SEQ ID NO: 13247 - RNA, 38 nt, Artificial Sequence
  Description of Artificial Sequence:  Enzymatic Nucleic Acid
  misc_feature (31)..(31): n stands for inosine
gacauaaacugaugaggccguuaggccgaanaccgagg

SEQ ID NO: 13248 - RNA, 38 nt, Artificial Sequence
  Description of Artificial Sequence:  Enzymatic Nucleic Acid
  misc_feature (31)..(31): n stands for inosine
uugaacaucugaugaggccguuaggccgaanacauaaa

SEQ ID NO: 13249 - RNA, 38 nt, Artificial Sequence
  Description of Artificial Sequence:  Enzymatic Nucleic Acid
  misc_feature (31)..(31): n stands for inosine
uguaaucucugaugaggccguuaggccgaanaacauag

SEQ ID NO: 13250 - RNA, 38 nt, Artificial Sequence
  Description of Artificial Sequence:  Enzymatic Nucleic Acid
  misc_feature (31)..(31): n stands for inosine
uggagauccugaugaggccguuaggccgaanuaaucuu

SEQ ID NO: 13251 - RNA, 38 nt, Artificial Sequence
  Description of Artificial Sequence:  Enzymatic Nucleic Acid
  misc_feature (31)..(31): n stands for inosine
auaaauggcugaugaggccguuaggccgaanaucugua

SEQ ID NO: 13252 - RNA, 38 nt, Artificial Sequence
  Description of Artificial Sequence:  Enzymatic Nucleic Acid
  misc_feature (31)..(31): n stands for inosine
caauaaaucugaugaggccguuaggccgaanagaucug

SEQ ID NO: 13253 - RNA, 38 nt, Artificial Sequence
  Description of Artificial Sequence:  Enzymatic Nucleic Acid
  misc_feature (31)..(31): n stands for inosine
gcaauaaacugaugaggccguuaggccgaangagaucu

SEQ ID NO: 13254 - RNA, 38 nt, Artificial Sequence
  Description of Artificial Sequence:  Enzymatic Nucleic Acid
  misc_feature (31)..(31): n stands for inosine
cuaacagacugaugaggccguuaggccgaancaauaaa

SEQ ID NO: 13255 - RNA, 38 nt, Artificial Sequence
  Description of Artificial Sequence:  Enzymatic Nucleic Acid
  misc_feature (31)..(31): n stands for inosine
ucacuaaccugaugaggccguuaggccgaanaagcaau

SEQ ID NO: 13256 - RNA, 38 nt, Artificial Sequence
  Description of Artificial Sequence:  Enzymatic Nucleic Acid
  misc_feature (31)..(31): n stands for inosine
uccauguucugaugaggccguuaggccgaanucacuaa

SEQ ID NO: 13257 - RNA, 38 nt, Artificial Sequence
  Description of Artificial Sequence:  Enzymatic Nucleic Acid
  misc_feature (31)..(31): n stands for inosine
cuccaugucugaugaggccguuaggccgaangucacua

SEQ ID NO: 13258 - RNA, 38 nt, Artificial Sequence
  Description of Artificial Sequence:  Enzymatic Nucleic Acid
  misc_feature (31)..(31): n stands for inosine
cgacuccacugaugaggccguuaggccgaanuugguca

SEQ ID NO: 13259 - RNA, 38 nt, Artificial Sequence
  Description of Artificial Sequence:  Enzymatic Nucleic Acid
  misc_feature (31)..(31): n stands for inosine
cucaguaacugaugaggccguuaggccgaanuacacga

SEQ ID NO: 13260 - RNA, 38 nt, Artificial Sequence
  Description of Artificial Sequence:  Enzymatic Nucleic Acid
  misc_feature (31)..(31): n stands for inosine
uuguucuccugaugaggccguuaggccgaanuaaugua

SEQ ID NO: 13261 - RNA, 38 nt, Artificial Sequence
  Description of Artificial Sequence:  Enzymatic Nucleic Acid
  misc_feature (31)..(31): n stands for inosine
uuuguuuucugaugaggccguuaggccgaanuucucag

SEQ ID NO: 13262 - RNA, 38 nt, Artificial Sequence
  Description of Artificial Sequence:  Enzymatic Nucleic Acid
  misc_feature (31)..(31): n stands for inosine
cacaguuucugaugaggccguuaggccgaanuuuuugu

SEQ ID NO: 13263 - RNA, 38 nt, Artificial Sequence
  Description of Artificial Sequence:  Enzymatic Nucleic Acid
  misc_feature (31)..(31): n stands for inosine
aucaccaccugaugaggccguuaggccgaanuuuuguu

SEQ ID NO: 13264 - RNA, 38 nt, Artificial Sequence
  Description of Artificial Sequence:  Enzymatic Nucleic Acid
  misc_feature (31)..(31): n stands for inosine
cgagacaucugaugaggccguuaggccgaanaaucacc

SEQ ID NO: 13265 - RNA, 38 nt, Artificial Sequence
  Description of Artificial Sequence:  Enzymatic Nucleic Acid
  misc_feature (31)..(31): n stands for inosine
ccgagacacugaugaggccguuaggccgaangaaucac

SEQ ID NO: 13266 - RNA, 38 nt, Artificial Sequence
  Description of Artificial Sequence:  Enzymatic Nucleic Acid
  misc_feature (31)..(31): n stands for inosine
uggacccgcugaugaggccguuaggccgaanacaugga

SEQ ID NO: 13267 - RNA, 38 nt, Artificial Sequence
  Description of Artificial Sequence:  Enzymatic Nucleic Acid
  misc_feature (31)..(31): n stands for inosine
uuugaaaucugaugaggccguuaggccgaanacccgag

SEQ ID NO: 13268 - RNA, 38 nt, Artificial Sequence
  Description of Artificial Sequence:  Enzymatic Nucleic Acid
  misc_feature (31)..(31): n stands for inosine
auuugaaacugaugaggccguuaggccgaangacccga

SEQ ID NO: 13269 - RNA, 38 nt, Artificial Sequence
  Description of Artificial Sequence:  Enzymatic Nucleic Acid
  misc_feature (31)..(31): n stands for inosine
uugagauucugaugaggccguuaggccgaanaaaugga

SEQ ID NO: 13270 - RNA, 38 nt, Artificial Sequence
  Description of Artificial Sequence:  Enzymatic Nucleic Acid
  misc_feature (31)..(31): n stands for inosine
acacguugcugaugaggccguuaggccgaanauuugaa

SEQ ID NO: 13271 - RNA, 38 nt, Artificial Sequence
  Description of Artificial Sequence:  Enzymatic Nucleic Acid
  misc_feature (31)..(31): n stands for inosine
ugacacgucugaugaggccguuaggccgaanagauuug

SEQ ID NO: 13272 - RNA, 38 nt, Artificial Sequence
  Description of Artificial Sequence:  Enzymatic Nucleic Acid
  misc_feature (31)..(31): n stands for inosine
gcacaaagcugaugaggccguuaggccgaanacacguu

SEQ ID NO: 13273 - RNA, 38 nt, Artificial Sequence
  Description of Artificial Sequence:  Enzymatic Nucleic Acid
  misc_feature (31)..(31): n stands for inosine
uugcacaacugaugaggccguuaggccgaanugacacg

SEQ ID NO: 13274 - RNA, 38 nt, Artificial Sequence
  Description of Artificial Sequence:  Enzymatic Nucleic Acid
  misc_feature (31)..(31): n stands for inosine
ggguaucucugaugaggccguuaggccgaancacaaag

SEQ ID NO: 13275 - RNA, 38 nt, Artificial Sequence
  Description of Artificial Sequence:  Enzymatic Nucleic Acid
  misc_feature (31)..(31): n stands for inosine
cuuuucugcugaugaggccguuaggccgaanuaucuug

SEQ ID NO: 13276 - RNA, 38 nt, Artificial Sequence
  Description of Artificial Sequence:  Enzymatic Nucleic Acid
  misc_feature (31)..(31): n stands for inosine
ucuuuucucugaugaggccguuaggccgaanguaucuu

SEQ ID NO: 13277 - RNA, 38 nt, Artificial Sequence
  Description of Artificial Sequence:  Enzymatic Nucleic Acid
  misc_feature (31)..(31): n stands for inosine
cucuuuuccugaugaggccguuaggccgaangguaucu

SEQ ID NO: 13278 - RNA, 38 nt, Artificial Sequence
  Description of Artificial Sequence:  Enzymatic Nucleic Acid
  misc_feature (31)..(31): n stands for inosine
uaccaucacugaugaggccguuaggccgaanaacaaau

SEQ ID NO: 13279 - RNA, 38 nt, Artificial Sequence
  Description of Artificial Sequence:  Enzymatic Nucleic Acid
  misc_feature (31)..(31): n stands for inosine
uuaccauccugaugaggccguuaggccgaangaacaaa

SEQ ID NO: 13280 - RNA, 38 nt, Artificial Sequence
  Description of Artificial Sequence:  Enzymatic Nucleic Acid
  misc_feature (31)..(31): n stands for inosine
ggaaauuccugaugaggccguuaggccgaanuuaccau

SEQ ID NO: 13281 - RNA, 38 nt, Artificial Sequence
  Description of Artificial Sequence:  Enzymatic Nucleic Acid
  misc_feature (31)..(31): n stands for inosine
cugucccacugaugaggccguuaggccgaanaaauucu

SEQ ID NO: 13282 - RNA, 38 nt, Artificial Sequence
  Description of Artificial Sequence:  Enzymatic Nucleic Acid
  misc_feature (31)..(31): n stands for inosine
gcuguccccugaugaggccguuaggccgaangaaauuc

SEQ ID NO: 13283 - RNA, 38 nt, Artificial Sequence
  Description of Artificial Sequence:  Enzymatic Nucleic Acid
  misc_feature (31)..(31): n stands for inosine
cuucuugccugaugaggccguuaggccgaanucccagg

SEQ ID NO: 13284 - RNA, 38 nt, Artificial Sequence
  Description of Artificial Sequence:  Enzymatic Nucleic Acid
  misc_feature (31)..(31): n stands for inosine
gcccuucucugaugaggccguuaggccgaancuguccc

SEQ ID NO: 13285 - RNA, 38 nt, Artificial Sequence
  Description of Artificial Sequence:  Enzymatic Nucleic Acid
  misc_feature (31)..(31): n stands for inosine
aauaguaacugaugaggccguuaggccgaancccuucu

SEQ ID NO: 13286 - RNA, 38 nt, Artificial Sequence
  Description of Artificial Sequence:  Enzymatic Nucleic Acid
  misc_feature (31)..(31): n stands for inosine
cugggaaucugaugaggccguuaggccgaanuaaagcc

SEQ ID NO: 13287 - RNA, 38 nt, Artificial Sequence
  Description of Artificial Sequence:  Enzymatic Nucleic Acid
  misc_feature (31)..(31): n stands for inosine
uguagcugcugaugaggccguuaggccgaanaauagua

SEQ ID NO: 13288 - RNA, 38 nt, Artificial Sequence
  Description of Artificial Sequence:  Enzymatic Nucleic Acid
  misc_feature (31)..(31): n stands for inosine
auguagcucugaugaggccguuaggccgaangaauagu

SEQ ID NO: 13289 - RNA, 38 nt, Artificial Sequence
  Description of Artificial Sequence:  Enzymatic Nucleic Acid
  misc_feature (31)..(31): n stands for inosine
cauguagccugaugaggccguuaggccgaanggaauag

SEQ ID NO: 13290 - RNA, 38 nt, Artificial Sequence
  Description of Artificial Sequence:  Enzymatic Nucleic Acid
  misc_feature (31)..(31): n stands for inosine
gaucaugucugaugaggccguuaggccgaancugggaa

SEQ ID NO: 13291 - RNA, 38 nt, Artificial Sequence
  Description of Artificial Sequence:  Enzymatic Nucleic Acid
  misc_feature (31)..(31): n stands for inosine
gcugaucacugaugaggccguuaggccgaanuagcugg

SEQ ID NO: 13292 - RNA, 38 nt, Artificial Sequence
  Description of Artificial Sequence:  Enzymatic Nucleic Acid
  misc_feature (31)..(31): n stands for inosine
agcauagccugaugaggccguuaggccgaanaucaugu

SEQ ID NO: 13293 - RNA, 38 nt, Artificial Sequence
  Description of Artificial Sequence:  Enzymatic Nucleic Acid
  misc_feature (31)..(31): n stands for inosine
gccagcaucugaugaggccguuaggccgaancugauca

SEQ ID NO: 13294 - RNA, 38 nt, Artificial Sequence
  Description of Artificial Sequence:  Enzymatic Nucleic Acid
  misc_feature (31)..(31): n stands for inosine
accaugcccugaugaggccguuaggccgaancauagcu

SEQ ID NO: 13295 - RNA, 38 nt, Artificial Sequence
  Description of Artificial Sequence:  Enzymatic Nucleic Acid
  misc_feature (31)..(31): n stands for inosine
gaagaccacugaugaggccguuaggccgaanccagcau

SEQ ID NO: 13296 - RNA, 38 nt, Artificial Sequence
  Description of Artificial Sequence:  Enzymatic Nucleic Acid
  misc_feature (31)..(31): n stands for inosine
uucacagacugaugaggccguuaggccgaanaccaugc

SEQ ID NO: 13297 - RNA, 38 nt, Artificial Sequence
  Description of Artificial Sequence:  Enzymatic Nucleic Acid
  misc_feature (31)..(31): n stands for inosine
ugcuucaccugaugaggccguuaggccgaanaagacca

SEQ ID NO: 13298 - RNA, 38 nt, Artificial Sequence
  Description of Artificial Sequence:  Enzymatic Nucleic Acid
  misc_feature (31)..(31): n stands for inosine
uuaauuuucugaugaggccguuaggccgaancuucaca

SEQ ID NO: 13299 - RNA, 38 nt, Artificial Sequence
  Description of Artificial Sequence:  Enzymatic Nucleic Acid
  misc_feature (31)..(31): n stands for inosine
aauagacucugaugaggccguuaggccgaanuaacuuu

SEQ ID NO: 13300 - RNA, 38 nt, Artificial Sequence
  Description of Artificial Sequence:  Enzymatic Nucleic Acid
  misc_feature (31)..(31): n stands for inosine
uaauagaccugaugaggccguuaggccgaanguaacuu

SEQ ID NO: 13301 - RNA, 38 nt, Artificial Sequence
  Description of Artificial Sequence:  Enzymatic Nucleic Acid
  misc_feature (31)..(31): n stands for inosine
uacauaaucugaugaggccguuaggccgaanacuggua

SEQ ID NO: 13302 - RNA, 38 nt, Artificial Sequence
  Description of Artificial Sequence:  Enzymatic Nucleic Acid
  misc_feature (31)..(31): n stands for inosine
gacaacuacugaugaggccguuaggccgaanuacauaa

SEQ ID NO: 13303 - RNA, 38 nt, Artificial Sequence
  Description of Artificial Sequence:  Enzymatic Nucleic Acid
  misc_feature (31)..(31): n stands for inosine
acggacuccugaugaggccguuaggccgaanaaccaca

SEQ ID NO: 13304 - RNA, 38 nt, Artificial Sequence
  Description of Artificial Sequence:  Enzymatic Nucleic Acid
  misc_feature (31)..(31): n stands for inosine
caugagaccugaugaggccguuaggccgaanacucaga

SEQ ID NO: 13305 - RNA, 38 nt, Artificial Sequence
  Description of Artificial Sequence:  Enzymatic Nucleic Acid
  misc_feature (31)..(31): n stands for inosine
auuccaugcugaugaggccguuaggccgaanacggacu

SEQ ID NO: 13306 - RNA, 38 nt, Artificial Sequence
  Description of Artificial Sequence:  Enzymatic Nucleic Acid
  misc_feature (31)..(31): n stands for inosine
caauuccacugaugaggccguuaggccgaanagacgga

SEQ ID NO: 13307 - RNA, 38 nt, Artificial Sequence
  Description of Artificial Sequence:  Enzymatic Nucleic Acid
  misc_feature (31)..(31): n stands for inosine
caacagaucugaugaggccguuaggccgaanuucaauu

SEQ ID NO: 13308 - RNA, 38 nt, Artificial Sequence
  Description of Artificial Sequence:  Enzymatic Nucleic Acid
  misc_feature (31)..(31): n stands for inosine
ucuccaaccugaugaggccguuaggccgaanauaguuc

SEQ ID NO: 13309 - RNA, 38 nt, Artificial Sequence
  Description of Artificial Sequence:  Enzymatic Nucleic Acid
  misc_feature (31)..(31): n stands for inosine
uuaagacacugaugaggccguuaggccgaancuuuucu

SEQ ID NO: 13310 - RNA, 38 nt, Artificial Sequence
  Description of Artificial Sequence:  Enzymatic Nucleic Acid
  misc_feature (31)..(31): n stands for inosine
acaauuuacugaugaggccguuaggccgaanacaagcu

SEQ ID NO: 13311 - RNA, 38 nt, Artificial Sequence
  Description of Artificial Sequence:  Enzymatic Nucleic Acid
  misc_feature (31)..(31): n stands for inosine
guucuugccugaugaggccguuaggccgaanuacaauu

SEQ ID NO: 13312 - RNA, 38 nt, Artificial Sequence
  Description of Artificial Sequence:  Enzymatic Nucleic Acid
  misc_feature (31)..(31): n stands for inosine
ucaguucucugaugaggccguuaggccgaancuguaca

SEQ ID NO: 13313 - RNA, 38 nt, Artificial Sequence
  Description of Artificial Sequence:  Enzymatic Nucleic Acid
  misc_feature (31)..(31): n stands for inosine
uuuaguuccugaugaggccguuaggccgaanuucuugc

SEQ ID NO: 13314 - RNA, 38 nt, Artificial Sequence
  Description of Artificial Sequence:  Enzymatic Nucleic Acid
  misc_feature (31)..(31): n stands for inosine
ccacauuucugaugaggccguuaggccgaanuucaguu

SEQ ID NO: 13315 - RNA, 38 nt, Artificial Sequence
  Description of Artificial Sequence:  Enzymatic Nucleic Acid
  misc_feature (31)..(31): n stands for inosine
ccaguugacugaugaggccguuaggccgaanucaaucc

SEQ ID NO: 13316 - RNA, 38 nt, Artificial Sequence
  Description of Artificial Sequence:  Enzymatic Nucleic Acid
  misc_feature (31)..(31): n stands for inosine
uucccagucugaugaggccguuaggccgaanaagucaa

SEQ ID NO: 13317 - RNA, 38 nt, Artificial Sequence
  Description of Artificial Sequence:  Enzymatic Nucleic Acid
  misc_feature (31)..(31): n stands for inosine
guauuccccugaugaggccguuaggccgaanuugaagu

SEQ ID NO: 13318 - RNA, 38 nt, Artificial Sequence
  Description of Artificial Sequence:  Enzymatic Nucleic Acid
  misc_feature (31)..(31): n stands for inosine
cgaagaagcugaugaggccguuaggccgaanuauuccc

SEQ ID NO: 13319 - RNA, 38 nt, Artificial Sequence
  Description of Artificial Sequence:  Enzymatic Nucleic Acid
  misc_feature (31)..(31): n stands for inosine
ucgaagaacugaugaggccguuaggccgaanguauucc

SEQ ID NO: 13320 - RNA, 38 nt, Artificial Sequence
  Description of Artificial Sequence:  Enzymatic Nucleic Acid
  misc_feature (31)..(31): n stands for inosine
uucgaagacugaugaggccguuaggccgaangguauuc

SEQ ID NO: 13321 - RNA, 38 nt, Artificial Sequence
  Description of Artificial Sequence:  Enzymatic Nucleic Acid
  misc_feature (31)..(31): n stands for inosine
ugcuucgacugaugaggccguuaggccgaanaagggua

SEQ ID NO: 13322 - RNA, 38 nt, Artificial Sequence
  Description of Artificial Sequence:  Enzymatic Nucleic Acid
  misc_feature (31)..(31): n stands for inosine
uaugcugacugaugaggccguuaggccgaancuucgaa

SEQ ID NO: 13323 - RNA, 38 nt, Artificial Sequence
  Description of Artificial Sequence:  Enzymatic Nucleic Acid
  misc_feature (31)..(31): n stands for inosine
ucuuaugccugaugaggccguuaggccgaanaugcuuc

SEQ ID NO: 13324 - RNA, 38 nt, Artificial Sequence
  Description of Artificial Sequence:  Enzymatic Nucleic Acid
  misc_feature (31)..(31): n stands for inosine
guuucuuacugaugaggccguuaggccgaancugaugc

SEQ ID NO: 13325 - RNA, 38 nt, Artificial Sequence
  Description of Artificial Sequence:  Enzymatic Nucleic Acid
  misc_feature (31)..(31): n stands for inosine
gguuuacacugaugaggccguuaggccgaanuuucuua

SEQ ID NO: 13326 - RNA, 38 nt, Artificial Sequence
  Description of Artificial Sequence:  Enzymatic Nucleic Acid
  misc_feature (31)..(31): n stands for inosine
uaggucuccugaugaggccguuaggccgaanuuuacaa

SEQ ID NO: 13327 - RNA, 38 nt, Artificial Sequence
  Description of Artificial Sequence:  Enzymatic Nucleic Acid
  misc_feature (31)..(31): n stands for inosine
gguuuuuacugaugaggccguuaggccgaanucucggu

SEQ ID NO: 13328 - RNA, 38 nt, Artificial Sequence
  Description of Artificial Sequence:  Enzymatic Nucleic Acid
  misc_feature (31)..(31): n stands for inosine
ggguuuuucugaugaggccguuaggccgaangucucgg

SEQ ID NO: 13329 - RNA, 38 nt, Artificial Sequence
  Description of Artificial Sequence:  Enzymatic Nucleic Acid
  misc_feature (31)..(31): n stands for inosine
ccagacugcugaugaggccguuaggccgaanuuuuuag

SEQ ID NO: 13330 - RNA, 38 nt, Artificial Sequence
  Description of Artificial Sequence:  Enzymatic Nucleic Acid
  misc_feature (31)..(31): n stands for inosine
cccagacucugaugaggccguuaggccgaanguuuuua

SEQ ID NO: 13331 - RNA, 38 nt, Artificial Sequence
  Description of Artificial Sequence:  Enzymatic Nucleic Acid
  misc_feature (31)..(31): n stands for inosine
ucccagaccugaugaggccguuaggccgaangguuuuu

SEQ ID NO: 13332 - RNA, 38 nt, Artificial Sequence
  Description of Artificial Sequence:  Enzymatic Nucleic Acid
  misc_feature (31)..(31): n stands for inosine
ucacuccccugaugaggccguuaggccgaanacugggu

SEQ ID NO: 13333 - RNA, 38 nt, Artificial Sequence
  Description of Artificial Sequence:  Enzymatic Nucleic Acid
  misc_feature (31)..(31): n stands for inosine
aguuaaggcugaugaggccguuaggccgaancucaaaa

SEQ ID NO: 13334 - RNA, 38 nt, Artificial Sequence
  Description of Artificial Sequence:  Enzymatic Nucleic Acid
  misc_feature (31)..(31): n stands for inosine
auaguuaacugaugaggccguuaggccgaanugcucaa

SEQ ID NO: 13335 - RNA, 38 nt, Artificial Sequence
  Description of Artificial Sequence:  Enzymatic Nucleic Acid
  misc_feature (31)..(31): n stands for inosine
uauaguuacugaugaggccguuaggccgaangugcuca

SEQ ID NO: 13336 - RNA, 38 nt, Artificial Sequence
  Description of Artificial Sequence:  Enzymatic Nucleic Acid
  misc_feature (31)..(31): n stands for inosine
ccaucuaucugaugaggccguuaggccgaanuuaaggu

SEQ ID NO: 13337 - RNA, 38 nt, Artificial Sequence
  Description of Artificial Sequence:  Enzymatic Nucleic Acid
  misc_feature (31)..(31): n stands for inosine
ucacuccgcugaugaggccguuaggccgaanuuacacc

SEQ ID NO: 13338 - RNA, 38 nt, Artificial Sequence
  Description of Artificial Sequence:  Enzymatic Nucleic Acid
  misc_feature (31)..(31): n stands for inosine
gucacucccugaugaggccguuaggccgaanguuacac

SEQ ID NO: 13339 - RNA, 38 nt, Artificial Sequence
  Description of Artificial Sequence:  Enzymatic Nucleic Acid
  misc_feature (31)..(31): n stands for inosine
caauccuucugaugaggccguuaggccgaanucacucc

SEQ ID NO: 13340 - RNA, 38 nt, Artificial Sequence
  Description of Artificial Sequence:  Enzymatic Nucleic Acid
  misc_feature (31)..(31): n stands for inosine
acaauccucugaugaggccguuaggccgaangucacuc

SEQ ID NO: 13341 - RNA, 38 nt, Artificial Sequence
  Description of Artificial Sequence:  Enzymatic Nucleic Acid
  misc_feature (31)..(31): n stands for inosine
ugcacaggcugaugaggccguuaggccgaanuacaauc

SEQ ID NO: 13342 - RNA, 38 nt, Artificial Sequence
  Description of Artificial Sequence:  Enzymatic Nucleic Acid
  misc_feature (31)..(31): n stands for inosine
gcugcacacugaugaggccguuaggccgaanuguacaa

SEQ ID NO: 13343 - RNA, 38 nt, Artificial Sequence
  Description of Artificial Sequence:  Enzymatic Nucleic Acid
  misc_feature (31)..(31): n stands for inosine
ugcugcaccugaugaggccguuaggccgaanguguaca

SEQ ID NO: 13344 - RNA, 38 nt, Artificial Sequence
  Description of Artificial Sequence:  Enzymatic Nucleic Acid
  misc_feature (31)..(31): n stands for inosine
cuggaugccugaugaggccguuaggccgaancacaggu

SEQ ID NO: 13345 - RNA, 38 nt, Artificial Sequence
  Description of Artificial Sequence:  Enzymatic Nucleic Acid
  misc_feature (31)..(31): n stands for inosine
ccacuggacugaugaggccguuaggccgaancugcaca

SEQ ID NO: 13346 - RNA, 38 nt, Artificial Sequence
  Description of Artificial Sequence:  Enzymatic Nucleic Acid
  misc_feature (31)..(31): n stands for inosine
agcccacucugaugaggccguuaggccgaanaugcugc

SEQ ID NO: 13347 - RNA, 38 nt, Artificial Sequence
  Description of Artificial Sequence:  Enzymatic Nucleic Acid
  misc_feature (31)..(31): n stands for inosine
cagcccaccugaugaggccguuaggccgaangaugcug

SEQ ID NO: 13348 - RNA, 38 nt, Artificial Sequence
  Description of Artificial Sequence:  Enzymatic Nucleic Acid
  misc_feature (31)..(31): n stands for inosine
uggucauccugaugaggccguuaggccgaancccacug

SEQ ID NO: 13349 - RNA, 38 nt, Artificial Sequence
  Description of Artificial Sequence:  Enzymatic Nucleic Acid
  misc_feature (31)..(31): n stands for inosine
uucuucuucugaugaggccguuaggccgaanucaucag

SEQ ID NO: 13350 - RNA, 38 nt, Artificial Sequence
  Description of Artificial Sequence:  Enzymatic Nucleic Acid
  misc_feature (31)..(31): n stands for inosine
guucuucucugaugaggccguuaggccgaangucauca

SEQ ID NO: 13351 - RNA, 38 nt, Artificial Sequence
  Description of Artificial Sequence:  Enzymatic Nucleic Acid
  misc_feature (31)..(31): n stands for inosine
aaaugugccugaugaggccguuaggccgaanuucuucu

SEQ ID NO: 13352 - RNA, 38 nt, Artificial Sequence
  Description of Artificial Sequence:  Enzymatic Nucleic Acid
  misc_feature (31)..(31): n stands for inosine
gacaaaugcugaugaggccguuaggccgaancuguucu

SEQ ID NO: 13353 - RNA, 38 nt, Artificial Sequence
  Description of Artificial Sequence:  Enzymatic Nucleic Acid
  misc_feature (31)..(31): n stands for inosine
cugacaaacugaugaggccguuaggccgaanugcuguu

SEQ ID NO: 13354 - RNA, 38 nt, Artificial Sequence
  Description of Artificial Sequence:  Enzymatic Nucleic Acid
  misc_feature (31)..(31): n stands for inosine
auggaccccugaugaggccguuaggccgaanacaaaug

SEQ ID NO: 13355 - RNA, 38 nt, Artificial Sequence
  Description of Artificial Sequence:  Enzymatic Nucleic Acid
  misc_feature (31)..(31): n stands for inosine
uuuuucaucugaugaggccguuaggccgaanacccuga

SEQ ID NO: 13356 - RNA, 38 nt, Artificial Sequence
  Description of Artificial Sequence:  Enzymatic Nucleic Acid
  misc_feature (31)..(31): n stands for inosine
guuuuucacugaugaggccguuaggccgaangacccug

SEQ ID NO: 13357 - RNA, 38 nt, Artificial Sequence
  Description of Artificial Sequence:  Enzymatic Nucleic Acid
  misc_feature (31)..(31): n stands for inosine
caacaaaacugaugaggccguuaggccgaanuuuuuca

SEQ ID NO: 13358 - RNA, 38 nt, Artificial Sequence
  Description of Artificial Sequence:  Enzymatic Nucleic Acid
  misc_feature (31)..(31): n stands for inosine
gcaacaaacugaugaggccguuaggccgaanguuuuuc

SEQ ID NO: 13359 - RNA, 38 nt, Artificial Sequence
  Description of Artificial Sequence:  Enzymatic Nucleic Acid
  misc_feature (31)..(31): n stands for inosine
cuuccaaacugaugaggccguuaggccgaancaacaaa

SEQ ID NO: 13360 - RNA, 38 nt, Artificial Sequence
  Description of Artificial Sequence:  Enzymatic Nucleic Acid
  misc_feature (31)..(31): n stands for inosine
agauuccacugaugaggccguuaggccgaanccacuuc

SEQ ID NO: 13361 - RNA, 38 nt, Artificial Sequence
  Description of Artificial Sequence:  Enzymatic Nucleic Acid
  misc_feature (31)..(31): n stands for inosine
uccaccagcugaugaggccguuaggccgaanauuccau

SEQ ID NO: 13362 - RNA, 38 nt, Artificial Sequence
  Description of Artificial Sequence:  Enzymatic Nucleic Acid
  misc_feature (31)..(31): n stands for inosine
cuuccacccugaugaggccguuaggccgaanagauucc

SEQ ID NO: 13363 - RNA, 38 nt, Artificial Sequence
  Description of Artificial Sequence:  Enzymatic Nucleic Acid
  misc_feature (31)..(31): n stands for inosine
cccaccgucugaugaggccguuaggccgaancuuccac

SEQ ID NO: 13364 - RNA, 38 nt, Artificial Sequence
  Description of Artificial Sequence:  Enzymatic Nucleic Acid
  misc_feature (31)..(31): n stands for inosine
ccccaccgcugaugaggccguuaggccgaangcuucca

SEQ ID NO: 13365 - RNA, 38 nt, Artificial Sequence
  Description of Artificial Sequence:  Enzymatic Nucleic Acid
  misc_feature (31)..(31): n stands for inosine
agggauuccugaugaggccguuaggccgaanacacgcu

SEQ ID NO: 13366 - RNA, 38 nt, Artificial Sequence
  Description of Artificial Sequence:  Enzymatic Nucleic Acid
  misc_feature (31)..(31): n stands for inosine
cuucgcagcugaugaggccguuaggccgaanauucuga

SEQ ID NO: 13367 - RNA, 38 nt, Artificial Sequence
  Description of Artificial Sequence:  Enzymatic Nucleic Acid
  misc_feature (31)..(31): n stands for inosine
acuucgcacugaugaggccguuaggccgaangauucug

SEQ ID NO: 13368 - RNA, 38 nt, Artificial Sequence
  Description of Artificial Sequence:  Enzymatic Nucleic Acid
  misc_feature (31)..(31): n stands for inosine
uacuucgccugaugaggccguuaggccgaanggauucu

SEQ ID NO: 13369 - RNA, 38 nt, Artificial Sequence
  Description of Artificial Sequence:  Enzymatic Nucleic Acid
  misc_feature (31)..(31): n stands for inosine
guaaccaacugaugaggccguuaggccgaanuacuucg

SEQ ID NO: 13370 - RNA, 38 nt, Artificial Sequence
  Description of Artificial Sequence:  Enzymatic Nucleic Acid
  misc_feature (31)..(31): n stands for inosine
gguaaccacugaugaggccguuaggccgaanguacuuc

SEQ ID NO: 13371 - RNA, 38 nt, Artificial Sequence
  Description of Artificial Sequence:  Enzymatic Nucleic Acid
  misc_feature (31)..(31): n stands for inosine
ugggggugcugaugaggccguuaggccgaanuaaccaa

SEQ ID NO: 13372 - RNA, 38 nt, Artificial Sequence
  Description of Artificial Sequence:  Enzymatic Nucleic Acid
  misc_feature (31)..(31): n stands for inosine
cugggggucugaugaggccguuaggccgaanguaacca

SEQ ID NO: 13373 - RNA, 38 nt, Artificial Sequence
  Description of Artificial Sequence:  Enzymatic Nucleic Acid
  misc_feature (31)..(31): n stands for inosine
ucugggggcugaugaggccguuaggccgaangguaacc

SEQ ID NO: 13374 - RNA, 38 nt, Artificial Sequence
  Description of Artificial Sequence:  Enzymatic Nucleic Acid
  misc_feature (31)..(31): n stands for inosine
uuucugggcugaugaggccguuaggccgaanuggguaa

SEQ ID NO: 13375 - RNA, 38 nt, Artificial Sequence
  Description of Artificial Sequence:  Enzymatic Nucleic Acid
  misc_feature (31)..(31): n stands for inosine
auuucuggcugaugaggccguuaggccgaangugggua

SEQ ID NO: 13376 - RNA, 38 nt, Artificial Sequence
  Description of Artificial Sequence:  Enzymatic Nucleic Acid
  misc_feature (31)..(31): n stands for inosine
uauuucugcugaugaggccguuaggccgaanggugggu

SEQ ID NO: 13377 - RNA, 38 nt, Artificial Sequence
  Description of Artificial Sequence:  Enzymatic Nucleic Acid
  misc_feature (31)..(31): n stands for inosine
uuauuucucugaugaggccguuaggccgaanggguggg

SEQ ID NO: 13378 - RNA, 38 nt, Artificial Sequence
  Description of Artificial Sequence:  Enzymatic Nucleic Acid
  misc_feature (31)..(31): n stands for inosine
uuuauuuccugaugaggccguuaggccgaanggggugg

SEQ ID NO: 13379 - RNA, 38 nt, Artificial Sequence
  Description of Artificial Sequence:  Enzymatic Nucleic Acid
  misc_feature (31)..(31): n stands for inosine
acucaaggcugaugaggccguuaggccgaanuauucca

SEQ ID NO: 13380 - RNA, 38 nt, Artificial Sequence
  Description of Artificial Sequence:  Enzymatic Nucleic Acid
  misc_feature (31)..(31): n stands for inosine
gacucaagcugaugaggccguuaggccgaanguauucc

SEQ ID NO: 13381 - RNA, 38 nt, Artificial Sequence
  Description of Artificial Sequence:  Enzymatic Nucleic Acid
  misc_feature (31)..(31): n stands for inosine
ggacucaacugaugaggccguuaggccgaangguauuc

SEQ ID NO: 13382 - RNA, 38 nt, Artificial Sequence
  Description of Artificial Sequence:  Enzymatic Nucleic Acid
  misc_feature (31)..(31): n stands for inosine
uggacucacugaugaggccguuaggccgaanggguauu

SEQ ID NO: 13383 - RNA, 38 nt, Artificial Sequence
  Description of Artificial Sequence:  Enzymatic Nucleic Acid
  misc_feature (31)..(31): n stands for inosine
gugugauucugaugaggccguuaggccgaanacucaag

SEQ ID NO: 13384 - RNA, 38 nt, Artificial Sequence
  Description of Artificial Sequence:  Enzymatic Nucleic Acid
  misc_feature (31)..(31): n stands for inosine
ugugugaucugaugaggccguuaggccgaangacucaa

SEQ ID NO: 13385 - RNA, 38 nt, Artificial Sequence
  Description of Artificial Sequence:  Enzymatic Nucleic Acid
  misc_feature (31)..(31): n stands for inosine
uaauugugcugaugaggccguuaggccgaanauuggac

SEQ ID NO: 13386 - RNA, 38 nt, Artificial Sequence
  Description of Artificial Sequence:  Enzymatic Nucleic Acid
  misc_feature (31)..(31): n stands for inosine
uuuaauugcugaugaggccguuaggccgaanugauugg

SEQ ID NO: 13387 - RNA, 38 nt, Artificial Sequence
  Description of Artificial Sequence:  Enzymatic Nucleic Acid
  misc_feature (31)..(31): n stands for inosine
gcuuuaaucugaugaggccguuaggccgaanugugauu

SEQ ID NO: 13388 - RNA, 38 nt, Artificial Sequence
  Description of Artificial Sequence:  Enzymatic Nucleic Acid
  misc_feature (31)..(31): n stands for inosine
ucaguacacugaugaggccguuaggccgaanccccgcu

SEQ ID NO: 13389 - RNA, 38 nt, Artificial Sequence
  Description of Artificial Sequence:  Enzymatic Nucleic Acid
  misc_feature (31)..(31): n stands for inosine
uaaucguccugaugaggccguuaggccgaanuacaugc

SEQ ID NO: 13390 - RNA, 38 nt, Artificial Sequence
  Description of Artificial Sequence:  Enzymatic Nucleic Acid
  misc_feature (31)..(31): n stands for inosine
auuuccugcugaugaggccguuaggccgaanucucuuu

SEQ ID NO: 13391 - RNA, 38 nt, Artificial Sequence
  Description of Artificial Sequence:  Enzymatic Nucleic Acid
  misc_feature (31)..(31): n stands for inosine
uaauuucccugaugaggccguuaggccgaanugucucu

SEQ ID NO: 13392 - RNA, 38 nt, Artificial Sequence
  Description of Artificial Sequence:  Enzymatic Nucleic Acid
  misc_feature (31)..(31): n stands for inosine
gaugacagcugaugaggccguuaggccgaanuaauuuc

SEQ ID NO: 13393 - RNA, 38 nt, Artificial Sequence
  Description of Artificial Sequence:  Enzymatic Nucleic Acid
  misc_feature (31)..(31): n stands for inosine
aggaugaccugaugaggccguuaggccgaanuguaauu

SEQ ID NO: 13394 - RNA, 38 nt, Artificial Sequence
  Description of Artificial Sequence:  Enzymatic Nucleic Acid
  misc_feature (31)..(31): n stands for inosine
gguaaggacugaugaggccguuaggccgaanacagugu

SEQ ID NO: 13395 - RNA, 38 nt, Artificial Sequence
  Description of Artificial Sequence:  Enzymatic Nucleic Acid
  misc_feature (31)..(31): n stands for inosine
auugguaacugaugaggccguuaggccgaanaugacag

SEQ ID NO: 13396 - RNA, 38 nt, Artificial Sequence
  Description of Artificial Sequence:  Enzymatic Nucleic Acid
  misc_feature (31)..(31): n stands for inosine
gauugguacugaugaggccguuaggccgaangaugaca

SEQ ID NO: 13397 - RNA, 38 nt, Artificial Sequence
  Description of Artificial Sequence:  Enzymatic Nucleic Acid
  misc_feature (31)..(31): n stands for inosine
augggauucugaugaggccguuaggccgaanuaaggau

SEQ ID NO: 13398 - RNA, 38 nt, Artificial Sequence
  Description of Artificial Sequence:  Enzymatic Nucleic Acid
  misc_feature (31)..(31): n stands for inosine
aaugggaucugaugaggccguuaggccgaanguaagga

SEQ ID NO: 13399 - RNA, 38 nt, Artificial Sequence
  Description of Artificial Sequence:  Enzymatic Nucleic Acid
  misc_feature (31)..(31): n stands for inosine
uugaaaugcugaugaggccguuaggccgaanauuggua

SEQ ID NO: 13400 - RNA, 38 nt, Artificial Sequence
  Description of Artificial Sequence:  Enzymatic Nucleic Acid
  misc_feature (31)..(31): n stands for inosine
uuugaaaucugaugaggccguuaggccgaangauuggu

SEQ ID NO: 13401 - RNA, 38 nt, Artificial Sequence
  Description of Artificial Sequence:  Enzymatic Nucleic Acid
  misc_feature (31)..(31): n stands for inosine
cuuugaaacugaugaggccguuaggccgaanggauugg

SEQ ID NO: 13402 - RNA, 38 nt, Artificial Sequence
  Description of Artificial Sequence:  Enzymatic Nucleic Acid
  misc_feature (31)..(31): n stands for inosine
uucuccuucugaugaggccguuaggccgaanaaauggg

SEQ ID NO: 13403 - RNA, 38 nt, Artificial Sequence
  Description of Artificial Sequence:  Enzymatic Nucleic Acid
  misc_feature (31)..(31): n stands for inosine
cauggcuccugaugaggccguuaggccgaancuucucc

SEQ ID NO: 13404 - RNA, 38 nt, Artificial Sequence
  Description of Artificial Sequence:  Enzymatic Nucleic Acid
  misc_feature (31)..(31): n stands for inosine
gaccacaucugaugaggccguuaggccgaancucugcu

SEQ ID NO: 13405 - RNA, 38 nt, Artificial Sequence
  Description of Artificial Sequence:  Enzymatic Nucleic Acid
  misc_feature (31)..(31): n stands for inosine
agaccacacugaugaggccguuaggccgaangcucugc

SEQ ID NO: 13406 - RNA, 38 nt, Artificial Sequence
  Description of Artificial Sequence:  Enzymatic Nucleic Acid
  misc_feature (31)..(31): n stands for inosine
aaccagagcugaugaggccguuaggccgaanaccacau

SEQ ID NO: 13407 - RNA, 38 nt, Artificial Sequence
  Description of Artificial Sequence:  Enzymatic Nucleic Acid
  misc_feature (31)..(31): n stands for inosine
acaaccagcugaugaggccguuaggccgaanagaccac

SEQ ID NO: 13408 - RNA, 38 nt, Artificial Sequence
  Description of Artificial Sequence:  Enzymatic Nucleic Acid
  misc_feature (31)..(31): n stands for inosine
acacaacccugaugaggccguuaggccgaanagagacc

SEQ ID NO: 13409 - RNA, 38 nt, Artificial Sequence
  Description of Artificial Sequence:  Enzymatic Nucleic Acid
  misc_feature (31)..(31): n stands for inosine
cuggggugcugaugaggccguuaggccgaanacauaca

SEQ ID NO: 13410 - RNA, 38 nt, Artificial Sequence
  Description of Artificial Sequence:  Enzymatic Nucleic Acid
  misc_feature (31)..(31): n stands for inosine
ucuggggucugaugaggccguuaggccgaangacauac

SEQ ID NO: 13411 - RNA, 38 nt, Artificial Sequence
  Description of Artificial Sequence:  Enzymatic Nucleic Acid
  misc_feature (31)..(31): n stands for inosine
aucuggggcugaugaggccguuaggccgaanggacaua

SEQ ID NO: 13412 - RNA, 38 nt, Artificial Sequence
  Description of Artificial Sequence:  Enzymatic Nucleic Acid
  misc_feature (31)..(31): n stands for inosine
caaucuggcugaugaggccguuaggccgaanugggaca

SEQ ID NO: 13413 - RNA, 38 nt, Artificial Sequence
  Description of Artificial Sequence:  Enzymatic Nucleic Acid
  misc_feature (31)..(31): n stands for inosine
ccaaucugcugaugaggccguuaggccgaangugggac

SEQ ID NO: 13414 - RNA, 38 nt, Artificial Sequence
  Description of Artificial Sequence:  Enzymatic Nucleic Acid
  misc_feature (31)..(31): n stands for inosine
accaaucucugaugaggccguuaggccgaangguggga

SEQ ID NO: 13415 - RNA, 38 nt, Artificial Sequence
  Description of Artificial Sequence:  Enzymatic Nucleic Acid
  misc_feature (31)..(31): n stands for inosine
caccaauccugaugaggccguuaggccgaanggguggg

SEQ ID NO: 13416 - RNA, 38 nt, Artificial Sequence
  Description of Artificial Sequence:  Enzymatic Nucleic Acid
  misc_feature (31)..(31): n stands for inosine
gagauuagcugaugaggccguuaggccgaanauuucuc

SEQ ID NO: 13417 - RNA, 38 nt, Artificial Sequence
  Description of Artificial Sequence:  Enzymatic Nucleic Acid
  misc_feature (31)..(31): n stands for inosine
gagagauucugaugaggccguuaggccgaanagauuuc

SEQ ID NO: 13418 - RNA, 38 nt, Artificial Sequence
  Description of Artificial Sequence:  Enzymatic Nucleic Acid
  misc_feature (31)..(31): n stands for inosine
cacaggagcugaugaggccguuaggccgaanauuagag

SEQ ID NO: 13419 - RNA, 38 nt, Artificial Sequence
  Description of Artificial Sequence:  Enzymatic Nucleic Acid
  misc_feature (31)..(31): n stands for inosine
uccacaggcugaugaggccguuaggccgaanagauuag

SEQ ID NO: 13420 - RNA, 38 nt, Artificial Sequence
  Description of Artificial Sequence:  Enzymatic Nucleic Acid
  misc_feature (31)..(31): n stands for inosine
aauccacacugaugaggccguuaggccgaanagagauu

SEQ ID NO: 13421 - RNA, 38 nt, Artificial Sequence
  Description of Artificial Sequence:  Enzymatic Nucleic Acid
  misc_feature (31)..(31): n stands for inosine
gaauccaccugaugaggccguuaggccgaangagagau

SEQ ID NO: 13422 - RNA, 38 nt, Artificial Sequence
  Description of Artificial Sequence:  Enzymatic Nucleic Acid
  misc_feature (31)..(31): n stands for inosine
uacugguacugaugaggccguuaggccgaanaauccac

SEQ ID NO: 13423 - RNA, 38 nt, Artificial Sequence
  Description of Artificial Sequence:  Enzymatic Nucleic Acid
  misc_feature (31)..(31): n stands for inosine
guacuggucugaugaggccguuaggccgaangaaucca

SEQ ID NO: 13424 - RNA, 38 nt, Artificial Sequence
  Description of Artificial Sequence:  Enzymatic Nucleic Acid
  misc_feature (31)..(31): n stands for inosine
gccguacucugaugaggccguuaggccgaanuaggaau

SEQ ID NO: 13425 - RNA, 38 nt, Artificial Sequence
  Description of Artificial Sequence:  Enzymatic Nucleic Acid
  misc_feature (31)..(31): n stands for inosine
ugccguaccugaugaggccguuaggccgaanguaggaa

SEQ ID NO: 13426 - RNA, 38 nt, Artificial Sequence
  Description of Artificial Sequence:  Enzymatic Nucleic Acid
  misc_feature (31)..(31): n stands for inosine
uugaguggcugaugaggccguuaggccgaanccguacu

SEQ ID NO: 13427 - RNA, 38 nt, Artificial Sequence
  Description of Artificial Sequence:  Enzymatic Nucleic Acid
  misc_feature (31)..(31): n stands for inosine
guuugagucugaugaggccguuaggccgaanugccgua

SEQ ID NO: 13428 - RNA, 38 nt, Artificial Sequence
  Description of Artificial Sequence:  Enzymatic Nucleic Acid
  misc_feature (31)..(31): n stands for inosine
cguuugagcugaugaggccguuaggccgaangugccgu

SEQ ID NO: 13429 - RNA, 38 nt, Artificial Sequence
  Description of Artificial Sequence:  Enzymatic Nucleic Acid
  misc_feature (31)..(31): n stands for inosine
agcguuugcugaugaggccguuaggccgaanuggugcc

SEQ ID NO: 13430 - RNA, 38 nt, Artificial Sequence
  Description of Artificial Sequence:  Enzymatic Nucleic Acid
  misc_feature (31)..(31): n stands for inosine
ucagcguucugaugaggccguuaggccgaanaguggug

SEQ ID NO: 13431 - RNA, 38 nt, Artificial Sequence
  Description of Artificial Sequence:  Enzymatic Nucleic Acid
  misc_feature (31)..(31): n stands for inosine
uacauguccugaugaggccguuaggccgaancguuuga

SEQ ID NO: 13432 - RNA, 38 nt, Artificial Sequence
  Description of Artificial Sequence:  Enzymatic Nucleic Acid
  misc_feature (31)..(31): n stands for inosine
accguacacugaugaggccguuaggccgaanucagcgu

SEQ ID NO: 13433 - RNA, 38 nt, Artificial Sequence
  Description of Artificial Sequence:  Enzymatic Nucleic Acid
  misc_feature (31)..(31): n stands for inosine
aauggcaucugaugaggccguuaggccgaanaccguac

SEQ ID NO: 13434 - RNA, 38 nt, Artificial Sequence
  Description of Artificial Sequence:  Enzymatic Nucleic Acid
  misc_feature (31)..(31): n stands for inosine
ggaggaaucugaugaggccguuaggccgaancauagac

SEQ ID NO: 13435 - RNA, 38 nt, Artificial Sequence
  Description of Artificial Sequence:  Enzymatic Nucleic Acid
  misc_feature (31)..(31): n stands for inosine
gggaggaacugaugaggccguuaggccgaangcauaga

SEQ ID NO: 13436 - RNA, 38 nt, Artificial Sequence
  Description of Artificial Sequence:  Enzymatic Nucleic Acid
  misc_feature (31)..(31): n stands for inosine
gcgggggacugaugaggccguuaggccgaanaauggca

SEQ ID NO: 13437 - RNA, 38 nt, Artificial Sequence
  Description of Artificial Sequence:  Enzymatic Nucleic Acid
  misc_feature (31)..(31): n stands for inosine
ugcgggggcugaugaggccguuaggccgaangaauggc

SEQ ID NO: 13438 - RNA, 38 nt, Artificial Sequence
  Description of Artificial Sequence:  Enzymatic Nucleic Acid
  misc_feature (31)..(31): n stands for inosine
gaugcgggcugaugaggccguuaggccgaanaggaaug

SEQ ID NO: 13439 - RNA, 38 nt, Artificial Sequence
  Description of Artificial Sequence:  Enzymatic Nucleic Acid
  misc_feature (31)..(31): n stands for inosine
ugaugcggcugaugaggccguuaggccgaangaggaau

SEQ ID NO: 13440 - RNA, 38 nt, Artificial Sequence
  Description of Artificial Sequence:  Enzymatic Nucleic Acid
  misc_feature (31)..(31): n stands for inosine
gugaugcgcugaugaggccguuaggccgaanggaggaa

SEQ ID NO: 13441 - RNA, 38 nt, Artificial Sequence
  Description of Artificial Sequence:  Enzymatic Nucleic Acid
  misc_feature (31)..(31): n stands for inosine
ugugaugccugaugaggccguuaggccgaangggagga

SEQ ID NO: 13442 - RNA, 38 nt, Artificial Sequence
  Description of Artificial Sequence:  Enzymatic Nucleic Acid
  misc_feature (31)..(31): n stands for inosine
ggaugugacugaugaggccguuaggccgaancggggga

SEQ ID NO: 13443 - RNA, 38 nt, Artificial Sequence
  Description of Artificial Sequence:  Enzymatic Nucleic Acid
  misc_feature (31)..(31): n stands for inosine
aguggaugcugaugaggccguuaggccgaanaugcggg

SEQ ID NO: 13444 - RNA, 38 nt, Artificial Sequence
  Description of Artificial Sequence:  Enzymatic Nucleic Acid
  misc_feature (31)..(31): n stands for inosine
ccaguggacugaugaggccguuaggccgaanugaugcg

SEQ ID NO: 13445 - RNA, 38 nt, Artificial Sequence
  Description of Artificial Sequence:  Enzymatic Nucleic Acid
  misc_feature (31)..(31): n stands for inosine
auaccagucugaugaggccguuaggccgaanaugugau

SEQ ID NO: 13446 - RNA, 38 nt, Artificial Sequence
  Description of Artificial Sequence:  Enzymatic Nucleic Acid
  misc_feature (31)..(31): n stands for inosine
aauaccagcugaugaggccguuaggccgaangauguga

SEQ ID NO: 13447 - RNA, 38 nt, Artificial Sequence
  Description of Artificial Sequence:  Enzymatic Nucleic Acid
  misc_feature (31)..(31): n stands for inosine
ccaauacccugaugaggccguuaggccgaanuggaugu

SEQ ID NO: 13448 - RNA, 38 nt, Artificial Sequence
  Description of Artificial Sequence:  Enzymatic Nucleic Acid
  misc_feature (31)..(31): n stands for inosine
ccuccaaccugaugaggccguuaggccgaanccaauac

SEQ ID NO: 13449 - RNA, 38 nt, Artificial Sequence
  Description of Artificial Sequence:  Enzymatic Nucleic Acid
  misc_feature (31)..(31): n stands for inosine
ggcucguucugaugaggccguuaggccgaancgcacuc

SEQ ID NO: 13450 - RNA, 38 nt, Artificial Sequence
  Description of Artificial Sequence:  Enzymatic Nucleic Acid
  misc_feature (31)..(31): n stands for inosine
gggcucgucugaugaggccguuaggccgaangcgcacu

SEQ ID NO: 13451 - RNA, 38 nt, Artificial Sequence
  Description of Artificial Sequence:  Enzymatic Nucleic Acid
  misc_feature (31)..(31): n stands for inosine
cuuggcugcugaugaggccguuaggccgaancucguug

SEQ ID NO: 13452 - RNA, 38 nt, Artificial Sequence
  Description of Artificial Sequence:  Enzymatic Nucleic Acid
  misc_feature (31)..(31): n stands for inosine
gcuuggcucugaugaggccguuaggccgaangcucguu

SEQ ID NO: 13453 - RNA, 38 nt, Artificial Sequence
  Description of Artificial Sequence:  Enzymatic Nucleic Acid
  misc_feature (31)..(31): n stands for inosine
agcuuggccugaugaggccguuaggccgaanggcucgu

SEQ ID NO: 13454 - RNA, 38 nt, Artificial Sequence
  Description of Artificial Sequence:  Enzymatic Nucleic Acid
  misc_feature (31)..(31): n stands for inosine
gacagcuucugaugaggccguuaggccgaancugggcu

SEQ ID NO: 13455 - RNA, 38 nt, Artificial Sequence
  Description of Artificial Sequence:  Enzymatic Nucleic Acid
  misc_feature (31)..(31): n stands for inosine
agacagcucugaugaggccguuaggccgaangcugggc

SEQ ID NO: 13456 - RNA, 38 nt, Artificial Sequence
  Description of Artificial Sequence:  Enzymatic Nucleic Acid
  misc_feature (31)..(31): n stands for inosine
acugagaccugaugaggccguuaggccgaancuuggcu

SEQ ID NO: 13457 - RNA, 38 nt, Artificial Sequence
  Description of Artificial Sequence:  Enzymatic Nucleic Acid
  misc_feature (31)..(31): n stands for inosine
ugucacugcugaugaggccguuaggccgaanacagcuu

SEQ ID NO: 13458 - RNA, 38 nt, Artificial Sequence
  Description of Artificial Sequence:  Enzymatic Nucleic Acid
  misc_feature (31)..(31): n stands for inosine
uuugucaccugaugaggccguuaggccgaanagacagc

SEQ ID NO: 13459 - RNA, 38 nt, Artificial Sequence
  Description of Artificial Sequence:  Enzymatic Nucleic Acid
  misc_feature (31)..(31): n stands for inosine
uauggguucugaugaggccguuaggccgaanucacuga

SEQ ID NO: 13460 - RNA, 38 nt, Artificial Sequence
  Description of Artificial Sequence:  Enzymatic Nucleic Acid
  misc_feature (31)..(31): n stands for inosine
aggguaugcugaugaggccguuaggccgaanuuuguca

SEQ ID NO: 13461 - RNA, 38 nt, Artificial Sequence
  Description of Artificial Sequence:  Enzymatic Nucleic Acid
  misc_feature (31)..(31): n stands for inosine
aaggguaucugaugaggccguuaggccgaanguuuguc

SEQ ID NO: 13462 - RNA, 38 nt, Artificial Sequence
  Description of Artificial Sequence:  Enzymatic Nucleic Acid
  misc_feature (31)..(31): n stands for inosine
caaggguacugaugaggccguuaggccgaangguuugu

SEQ ID NO: 13463 - RNA, 38 nt, Artificial Sequence
  Description of Artificial Sequence:  Enzymatic Nucleic Acid
  misc_feature (31)..(31): n stands for inosine
uucacaagcugaugaggccguuaggccgaanuaugggu

SEQ ID NO: 13464 - RNA, 38 nt, Artificial Sequence
  Description of Artificial Sequence:  Enzymatic Nucleic Acid
  misc_feature (31)..(31): n stands for inosine
cuucacaacugaugaggccguuaggccgaanguauggg

SEQ ID NO: 13465 - RNA, 38 nt, Artificial Sequence
  Description of Artificial Sequence:  Enzymatic Nucleic Acid
  misc_feature (31)..(31): n stands for inosine
ucuucacacugaugaggccguuaggccgaangguaugg

SEQ ID NO: 13466 - RNA, 38 nt, Artificial Sequence
  Description of Artificial Sequence:  Enzymatic Nucleic Acid
  misc_feature (31)..(31): n stands for inosine
ucccuggacugaugaggccguuaggccgaanuccucca

SEQ ID NO: 13467 - RNA, 38 nt, Artificial Sequence
  Description of Artificial Sequence:  Enzymatic Nucleic Acid
  misc_feature (31)..(31): n stands for inosine
uccucccucugaugaggccguuaggccgaanaaguccu

SEQ ID NO: 13468 - RNA, 38 nt, Artificial Sequence
  Description of Artificial Sequence:  Enzymatic Nucleic Acid
  misc_feature (31)..(31): n stands for inosine
uuccuccccugaugaggccguuaggccgaangaagucc

SEQ ID NO: 13469 - RNA, 38 nt, Artificial Sequence
  Description of Artificial Sequence:  Enzymatic Nucleic Acid
  misc_feature (31)..(31): n stands for inosine
gagcaaaucugaugaggccguuaggccgaanauuuuua

SEQ ID NO: 13470 - RNA, 38 nt, Artificial Sequence
  Description of Artificial Sequence:  Enzymatic Nucleic Acid
  misc_feature (31)..(31): n stands for inosine
ucaauuagcugaugaggccguuaggccgaancaaauug

SEQ ID NO: 13471 - RNA, 38 nt, Artificial Sequence
  Description of Artificial Sequence:  Enzymatic Nucleic Acid
  misc_feature (31)..(31): n stands for inosine
cuucaauucugaugaggccguuaggccgaanagcaaau

SEQ ID NO: 13472 - RNA, 38 nt, Artificial Sequence
  Description of Artificial Sequence:  Enzymatic Nucleic Acid
  misc_feature (31)..(31): n stands for inosine
uacaguuucugaugaggccguuaggccgaanuuuuuuc

SEQ ID NO: 13473 - RNA, 38 nt, Artificial Sequence
  Description of Artificial Sequence:  Enzymatic Nucleic Acid
  misc_feature (31)..(31): n stands for inosine
guacuuaccugaugaggccguuaggccgaanuuuuguu

SEQ ID NO: 13474 - RNA, 38 nt, Artificial Sequence
  Description of Artificial Sequence:  Enzymatic Nucleic Acid
  misc_feature (31)..(31): n stands for inosine
auaacaagcugaugaggccguuaggccgaanuacuuac

SEQ ID NO: 13475 - RNA, 38 nt, Artificial Sequence
  Description of Artificial Sequence:  Enzymatic Nucleic Acid
  misc_feature (31)..(31): n stands for inosine
gauaacaacugaugaggccguuaggccgaanguacuua

SEQ ID NO: 13476 - RNA, 38 nt, Artificial Sequence
  Description of Artificial Sequence:  Enzymatic Nucleic Acid
  misc_feature (31)..(31): n stands for inosine
ggauaacacugaugaggccguuaggccgaangguacuu

SEQ ID NO: 13477 - RNA, 38 nt, Artificial Sequence
  Description of Artificial Sequence:  Enzymatic Nucleic Acid
  misc_feature (31)..(31): n stands for inosine
ugccgcuucugaugaggccguuaggccgaanauaacaa

SEQ ID NO: 13478 - RNA, 38 nt, Artificial Sequence
  Description of Artificial Sequence:  Enzymatic Nucleic Acid
  misc_feature (31)..(31): n stands for inosine
uugccgcucugaugaggccguuaggccgaangauaaca

SEQ ID NO: 13479 - RNA, 38 nt, Artificial Sequence
  Description of Artificial Sequence:  Enzymatic Nucleic Acid
  misc_feature (31)..(31): n stands for inosine
gacacauucugaugaggccguuaggccgaanccgcuug

SEQ ID NO: 13480 - RNA, 38 nt, Artificial Sequence
  Description of Artificial Sequence:  Enzymatic Nucleic Acid
  misc_feature (31)..(31): n stands for inosine
uacaaagccugaugaggccguuaggccgaanacacauu

SEQ ID NO: 13481 - RNA, 38 nt, Artificial Sequence
  Description of Artificial Sequence:  Enzymatic Nucleic Acid
  misc_feature (31)..(31): n stands for inosine
uuguacaacugaugaggccguuaggccgaancugacac

SEQ ID NO: 13482 - RNA, 38 nt, Artificial Sequence
  Description of Artificial Sequence:  Enzymatic Nucleic Acid
  misc_feature (31)..(31): n stands for inosine
uucacauucugaugaggccguuaggccgaanuacaaag

SEQ ID NO: 13483 - RNA, 38 nt, Artificial Sequence
  Description of Artificial Sequence:  Enzymatic Nucleic Acid
  misc_feature (31)..(31): n stands for inosine
gacuuugucugaugaggccguuaggccgaanaccgcuu

SEQ ID NO: 13484 - RNA, 38 nt, Artificial Sequence
  Description of Artificial Sequence:  Enzymatic Nucleic Acid
  misc_feature (31)..(31): n stands for inosine
cccgacuucugaugaggccguuaggccgaanuugaccg

SEQ ID NO: 13485 - RNA, 38 nt, Artificial Sequence
  Description of Artificial Sequence:  Enzymatic Nucleic Acid
  misc_feature (31)..(31): n stands for inosine
guggaaggcugaugaggccguuaggccgaanaucaccc

SEQ ID NO: 13486 - RNA, 38 nt, Artificial Sequence
  Description of Artificial Sequence:  Enzymatic Nucleic Acid
  misc_feature (31)..(31): n stands for inosine
acguggaacugaugaggccguuaggccgaanagaucac

SEQ ID NO: 13487 - RNA, 38 nt, Artificial Sequence
  Description of Artificial Sequence:  Enzymatic Nucleic Acid
  misc_feature (31)..(31): n stands for inosine
cacguggacugaugaggccguuaggccgaangagauca

SEQ ID NO: 13488 - RNA, 38 nt, Artificial Sequence
  Description of Artificial Sequence:  Enzymatic Nucleic Acid
  misc_feature (31)..(31): n stands for inosine
ggucacgucugaugaggccguuaggccgaanaaggaga

SEQ ID NO: 13489 - RNA, 38 nt, Artificial Sequence
  Description of Artificial Sequence:  Enzymatic Nucleic Acid
  misc_feature (31)..(31): n stands for inosine
uggucacgcugaugaggccguuaggccgaangaaggag

SEQ ID NO: 13490 - RNA, 38 nt, Artificial Sequence
  Description of Artificial Sequence:  Enzymatic Nucleic Acid
  misc_feature (31)..(31): n stands for inosine
ggaccccucugaugaggccguuaggccgaanucacgug

SEQ ID NO: 13491 - RNA, 38 nt, Artificial Sequence
  Description of Artificial Sequence:  Enzymatic Nucleic Acid
  misc_feature (31)..(31): n stands for inosine
aggacccccugaugaggccguuaggccgaangucacgu

SEQ ID NO: 13492 - RNA, 38 nt, Artificial Sequence
  Description of Artificial Sequence:  Enzymatic Nucleic Acid
  misc_feature (31)..(31): n stands for inosine
uaauuucacugaugaggccguuaggccgaanaccccug

SEQ ID NO: 13493 - RNA, 38 nt, Artificial Sequence
  Description of Artificial Sequence:  Enzymatic Nucleic Acid
  misc_feature (31)..(31): n stands for inosine
guaauuuccugaugaggccguuaggccgaangaccccu

SEQ ID NO: 13494 - RNA, 38 nt, Artificial Sequence
  Description of Artificial Sequence:  Enzymatic Nucleic Acid
  misc_feature (31)..(31): n stands for inosine
gguugcaacugaugaggccguuaggccgaanuaauuuc

SEQ ID NO: 13495 - RNA, 38 nt, Artificial Sequence
  Description of Artificial Sequence:  Enzymatic Nucleic Acid
  misc_feature (31)..(31): n stands for inosine
ugucaggucugaugaggccguuaggccgaancaaagua

SEQ ID NO: 13496 - RNA, 38 nt, Artificial Sequence
  Description of Artificial Sequence:  Enzymatic Nucleic Acid
  misc_feature (31)..(31): n stands for inosine
gcaugucacugaugaggccguuaggccgaanuugcaaa

SEQ ID NO: 13497 - RNA, 38 nt, Artificial Sequence
  Description of Artificial Sequence:  Enzymatic Nucleic Acid
  misc_feature (31)..(31): n stands for inosine
ugcauguccugaugaggccguuaggccgaanguugcaa

SEQ ID NO: 13498 - RNA, 38 nt, Artificial Sequence
  Description of Artificial Sequence:  Enzymatic Nucleic Acid
  misc_feature (31)..(31): n stands for inosine
gggcugcacugaugaggccguuaggccgaanucagguu

SEQ ID NO: 13499 - RNA, 38 nt, Artificial Sequence
  Description of Artificial Sequence:  Enzymatic Nucleic Acid
  misc_feature (31)..(31): n stands for inosine
cagugggccugaugaggccguuaggccgaancauguca

SEQ ID NO: 13500 - RNA, 38 nt, Artificial Sequence
  Description of Artificial Sequence:  Enzymatic Nucleic Acid
  misc_feature (31)..(31): n stands for inosine
gcucagugcugaugaggccguuaggccgaancugcaug

SEQ ID NO: 13501 - RNA, 38 nt, Artificial Sequence
  Description of Artificial Sequence:  Enzymatic Nucleic Acid
  misc_feature (31)..(31): n stands for inosine
ugcucagucugaugaggccguuaggccgaangcugcau

SEQ ID NO: 13502 - RNA, 38 nt, Artificial Sequence
  Description of Artificial Sequence:  Enzymatic Nucleic Acid
  misc_feature (31)..(31): n stands for inosine
cugcucagcugaugaggccguuaggccgaanggcugca

SEQ ID NO: 13503 - RNA, 38 nt, Artificial Sequence
  Description of Artificial Sequence:  Enzymatic Nucleic Acid
  misc_feature (31)..(31): n stands for inosine
uccugcuccugaugaggccguuaggccgaanugggcug

SEQ ID NO: 13504 - RNA, 38 nt, Artificial Sequence
  Description of Artificial Sequence:  Enzymatic Nucleic Acid
  misc_feature (31)..(31): n stands for inosine
cgcucucccugaugaggccguuaggccgaancucagug

SEQ ID NO: 13505 - RNA, 38 nt, Artificial Sequence
  Description of Artificial Sequence:  Enzymatic Nucleic Acid
  misc_feature (31)..(31): n stands for inosine
caccacaacugaugaggccguuaggccgaanacacgcu

SEQ ID NO: 13506 - RNA, 38 nt, Artificial Sequence
  Description of Artificial Sequence:  Enzymatic Nucleic Acid
  misc_feature (31)..(31): n stands for inosine
gucugcagcugaugaggccguuaggccgaancaccaca

SEQ ID NO: 13507 - RNA, 38 nt, Artificial Sequence
  Description of Artificial Sequence:  Enzymatic Nucleic Acid
  misc_feature (31)..(31): n stands for inosine
cugucugccugaugaggccguuaggccgaanugcacca

SEQ ID NO: 13508 - RNA, 38 nt, Artificial Sequence
  Description of Artificial Sequence:  Enzymatic Nucleic Acid
  misc_feature (31)..(31): n stands for inosine
gaucuguccugaugaggccguuaggccgaancagugca

SEQ ID NO: 13509 - RNA, 38 nt, Artificial Sequence
  Description of Artificial Sequence:  Enzymatic Nucleic Acid
  misc_feature (31)..(31): n stands for inosine
cguagauccugaugaggccguuaggccgaanucugcag

SEQ ID NO: 13510 - RNA, 38 nt, Artificial Sequence
  Description of Artificial Sequence:  Enzymatic Nucleic Acid
  misc_feature (31)..(31): n stands for inosine
ucaaacgucugaugaggccguuaggccgaanaucuguc

SEQ ID NO: 13511 - RNA, 38 nt, Artificial Sequence
  Description of Artificial Sequence:  Enzymatic Nucleic Acid
  misc_feature (31)..(31): n stands for inosine
ccaugugacugaugaggccguuaggccgaanuucucaa

SEQ ID NO: 13512 - RNA, 38 nt, Artificial Sequence
  Description of Artificial Sequence:  Enzymatic Nucleic Acid
  misc_feature (31)..(31): n stands for inosine
accaugugcugaugaggccguuaggccgaanguucuca

SEQ ID NO: 13513 - RNA, 38 nt, Artificial Sequence
  Description of Artificial Sequence:  Enzymatic Nucleic Acid
  misc_feature (31)..(31): n stands for inosine
guaccaugcugaugaggccguuaggccgaanagguucu

SEQ ID NO: 13514 - RNA, 38 nt, Artificial Sequence
  Description of Artificial Sequence:  Enzymatic Nucleic Acid
  misc_feature (31)..(31): n stands for inosine
uuguaccacugaugaggccguuaggccgaanugagguu

SEQ ID NO: 13515 - RNA, 38 nt, Artificial Sequence
  Description of Artificial Sequence:  Enzymatic Nucleic Acid
  misc_feature (31)..(31): n stands for inosine
gccaagcucugaugaggccguuaggccgaanuaccaug

SEQ ID NO: 13516 - RNA, 38 nt, Artificial Sequence
  Description of Artificial Sequence:  Enzymatic Nucleic Acid
  misc_feature (31)..(31): n stands for inosine
gugggccacugaugaggccguuaggccgaancuuguac

SEQ ID NO: 13517 - RNA, 38 nt, Artificial Sequence
  Description of Artificial Sequence:  Enzymatic Nucleic Acid
  misc_feature (31)..(31): n stands for inosine
aggcugugcugaugaggccguuaggccgaanccaagcu

SEQ ID NO: 13518 - RNA, 38 nt, Artificial Sequence
  Description of Artificial Sequence:  Enzymatic Nucleic Acid
  misc_feature (31)..(31): n stands for inosine
gaggcugucugaugaggccguuaggccgaangccaagc

SEQ ID NO: 13519 - RNA, 38 nt, Artificial Sequence
  Description of Artificial Sequence:  Enzymatic Nucleic Acid
  misc_feature (31)..(31): n stands for inosine
agaggcugcugaugaggccguuaggccgaanggccaag

SEQ ID NO: 13520 - RNA, 38 nt, Artificial Sequence
  Description of Artificial Sequence:  Enzymatic Nucleic Acid
  misc_feature (31)..(31): n stands for inosine
gcagaggccugaugaggccguuaggccgaanugggcca

SEQ ID NO: 13521 - RNA, 38 nt, Artificial Sequence
  Description of Artificial Sequence:  Enzymatic Nucleic Acid
  misc_feature (31)..(31): n stands for inosine
uuggcagacugaugaggccguuaggccgaancuguggg

SEQ ID NO: 13522 - RNA, 38 nt, Artificial Sequence
  Description of Artificial Sequence:  Enzymatic Nucleic Acid
  misc_feature (31)..(31): n stands for inosine
auuggcagcugaugaggccguuaggccgaangcugugg

SEQ ID NO: 13523 - RNA, 38 nt, Artificial Sequence
  Description of Artificial Sequence:  Enzymatic Nucleic Acid
  misc_feature (31)..(31): n stands for inosine
ggauuggccugaugaggccguuaggccgaanaggcugu

SEQ ID NO: 13524 - RNA, 38 nt, Artificial Sequence
  Description of Artificial Sequence:  Enzymatic Nucleic Acid
  misc_feature (31)..(31): n stands for inosine
cauggauucugaugaggccguuaggccgaancagaggc

SEQ ID NO: 13525 - RNA, 38 nt, Artificial Sequence
  Description of Artificial Sequence:  Enzymatic Nucleic Acid
  misc_feature (31)..(31): n stands for inosine
acauggaucugaugaggccguuaggccgaangcagagg

SEQ ID NO: 13526 - RNA, 38 nt, Artificial Sequence
  Description of Artificial Sequence:  Enzymatic Nucleic Acid
  misc_feature (31)..(31): n stands for inosine
ucccacaucugaugaggccguuaggccgaanauuggca

SEQ ID NO: 13527 - RNA, 38 nt, Artificial Sequence
  Description of Artificial Sequence:  Enzymatic Nucleic Acid
  misc_feature (31)..(31): n stands for inosine
cucccacacugaugaggccguuaggccgaangauuggc

SEQ ID NO: 13528 - RNA, 38 nt, Artificial Sequence
  Description of Artificial Sequence:  Enzymatic Nucleic Acid
  misc_feature (31)..(31): n stands for inosine
caggugugcugaugaggccguuaggccgaancaacucu

SEQ ID NO: 13529 - RNA, 38 nt, Artificial Sequence
  Description of Artificial Sequence:  Enzymatic Nucleic Acid
  misc_feature (31)..(31): n stands for inosine
acaggugucugaugaggccguuaggccgaangcaacuc

SEQ ID NO: 13530 - RNA, 38 nt, Artificial Sequence
  Description of Artificial Sequence:  Enzymatic Nucleic Acid
  misc_feature (31)..(31): n stands for inosine
aacaggugcugaugaggccguuaggccgaanggcaacu

SEQ ID NO: 13531 - RNA, 38 nt, Artificial Sequence
  Description of Artificial Sequence:  Enzymatic Nucleic Acid
  misc_feature (31)..(31): n stands for inosine
caaacaggcugaugaggccguuaggccgaanugggcaa

SEQ ID NO: 13532 - RNA, 38 nt, Artificial Sequence
  Description of Artificial Sequence:  Enzymatic Nucleic Acid
  misc_feature (31)..(31): n stands for inosine
ugcaaacacugaugaggccguuaggccgaanugugggc

SEQ ID NO: 13533 - RNA, 38 nt, Artificial Sequence
  Description of Artificial Sequence:  Enzymatic Nucleic Acid
  misc_feature (31)..(31): n stands for inosine
uugcaaaccugaugaggccguuaggccgaanguguggg

SEQ ID NO: 13534 - RNA, 38 nt, Artificial Sequence
  Description of Artificial Sequence:  Enzymatic Nucleic Acid
  misc_feature (31)..(31): n stands for inosine
caaguucucugaugaggccguuaggccgaancaaacag

SEQ ID NO: 13535 - RNA, 38 nt, Artificial Sequence
  Description of Artificial Sequence:  Enzymatic Nucleic Acid
  misc_feature (31)..(31): n stands for inosine
aguauccacugaugaggccguuaggccgaanuucuugc

SEQ ID NO: 13536 - RNA, 38 nt, Artificial Sequence
  Description of Artificial Sequence:  Enzymatic Nucleic Acid
  misc_feature (31)..(31): n stands for inosine
uuccaaagcugaugaggccguuaggccgaanuauccaa

SEQ ID NO: 13537 - RNA, 38 nt, Artificial Sequence
  Description of Artificial Sequence:  Enzymatic Nucleic Acid
  misc_feature (31)..(31): n stands for inosine
auuuccaacugaugaggccguuaggccgaanaguaucc

SEQ ID NO: 13538 - RNA, 38 nt, Artificial Sequence
  Description of Artificial Sequence:  Enzymatic Nucleic Acid
  misc_feature (31)..(31): n stands for inosine
aacauggucugaugaggccguuaggccgaancauucaa

SEQ ID NO: 13539 - RNA, 38 nt, Artificial Sequence
  Description of Artificial Sequence:  Enzymatic Nucleic Acid
  misc_feature (31)..(31): n stands for inosine
gaacauggcugaugaggccguuaggccgaangcauuca

SEQ ID NO: 13540 - RNA, 38 nt, Artificial Sequence
  Description of Artificial Sequence:  Enzymatic Nucleic Acid
  misc_feature (31)..(31): n stands for inosine
gagaacaucugaugaggccguuaggccgaanuggcauu

SEQ ID NO: 13541 - RNA, 38 nt, Artificial Sequence
  Description of Artificial Sequence:  Enzymatic Nucleic Acid
  misc_feature (31)..(31): n stands for inosine
agagaacacugaugaggccguuaggccgaanguggcau

SEQ ID NO: 13542 - RNA, 38 nt, Artificial Sequence
  Description of Artificial Sequence:  Enzymatic Nucleic Acid
  misc_feature (31)..(31): n stands for inosine
gcuauuagcugaugaggccguuaggccgaanaacaugg

SEQ ID NO: 13543 - RNA, 38 nt, Artificial Sequence
  Description of Artificial Sequence:  Enzymatic Nucleic Acid
  misc_feature (31)..(31): n stands for inosine
gugcuauucugaugaggccguuaggccgaanagaacau

SEQ ID NO: 13544 - RNA, 38 nt, Artificial Sequence
  Description of Artificial Sequence:  Enzymatic Nucleic Acid
  misc_feature (31)..(31): n stands for inosine
gucauuugcugaugaggccguuaggccgaancuauuag

SEQ ID NO: 13545 - RNA, 38 nt, Artificial Sequence
  Description of Artificial Sequence:  Enzymatic Nucleic Acid
  misc_feature (31)..(31): n stands for inosine
augucauucugaugaggccguuaggccgaanugcuauu

SEQ ID NO: 13546 - RNA, 38 nt, Artificial Sequence
  Description of Artificial Sequence:  Enzymatic Nucleic Acid
  misc_feature (31)..(31): n stands for inosine
gaucaaaacugaugaggccguuaggccgaanucauuug

SEQ ID NO: 13547 - RNA, 38 nt, Artificial Sequence
  Description of Artificial Sequence:  Enzymatic Nucleic Acid
  misc_feature (31)..(31): n stands for inosine
aagcuccacugaugaggccguuaggccgaanaucaaaa

SEQ ID NO: 13548 - RNA, 38 nt, Artificial Sequence
  Description of Artificial Sequence:  Enzymatic Nucleic Acid
  misc_feature (31)..(31): n stands for inosine
cauucuuacugaugaggccguuaggccgaancuccaug

SEQ ID NO: 13549 - RNA, 38 nt, Artificial Sequence
  Description of Artificial Sequence:  Enzymatic Nucleic Acid
  misc_feature (31)..(31): n stands for inosine
ugcaaggacugaugaggccguuaggccgaancauucuu

SEQ ID NO: 13550 - RNA, 38 nt, Artificial Sequence
  Description of Artificial Sequence:  Enzymatic Nucleic Acid
  misc_feature (31)..(31): n stands for inosine
uccugcaacugaugaggccguuaggccgaanaugcauu

SEQ ID NO: 13551 - RNA, 38 nt, Artificial Sequence
  Description of Artificial Sequence:  Enzymatic Nucleic Acid
  misc_feature (31)..(31): n stands for inosine
guccugcacugaugaggccguuaggccgaangaugcau

SEQ ID NO: 13552 - RNA, 38 nt, Artificial Sequence
  Description of Artificial Sequence:  Enzymatic Nucleic Acid
  misc_feature (31)..(31): n stands for inosine
cuuggucccugaugaggccguuaggccgaancaaggau

SEQ ID NO: 13553 - RNA, 38 nt, Artificial Sequence
  Description of Artificial Sequence:  Enzymatic Nucleic Acid
  misc_feature (31)..(31): n stands for inosine
gucuccuucugaugaggccguuaggccgaanuccugca

SEQ ID NO: 13554 - RNA, 38 nt, Artificial Sequence
  Description of Artificial Sequence:  Enzymatic Nucleic Acid
  misc_feature (31)..(31): n stands for inosine
agucuccucugaugaggccguuaggccgaanguccugc

SEQ ID NO: 13555 - RNA, 38 nt, Artificial Sequence
  Description of Artificial Sequence:  Enzymatic Nucleic Acid
  misc_feature (31)..(31): n stands for inosine
gcagacaucugaugaggccguuaggccgaanucuccuu

SEQ ID NO: 13556 - RNA, 38 nt, Artificial Sequence
  Description of Artificial Sequence:  Enzymatic Nucleic Acid
  misc_feature (31)..(31): n stands for inosine
agcaaggccugaugaggccguuaggccgaanacauagu

SEQ ID NO: 13557 - RNA, 38 nt, Artificial Sequence
  Description of Artificial Sequence:  Enzymatic Nucleic Acid
  misc_feature (31)..(31): n stands for inosine
uugagcaacugaugaggccguuaggccgaancagacau

SEQ ID NO: 13558 - RNA, 38 nt, Artificial Sequence
  Description of Artificial Sequence:  Enzymatic Nucleic Acid
  misc_feature (31)..(31): n stands for inosine
cuugagcacugaugaggccguuaggccgaangcagaca

SEQ ID NO: 13559 - RNA, 38 nt, Artificial Sequence
  Description of Artificial Sequence:  Enzymatic Nucleic Acid
  misc_feature (31)..(31): n stands for inosine
cugucuugcugaugaggccguuaggccgaancaaggca

SEQ ID NO: 13560 - RNA, 38 nt, Artificial Sequence
  Description of Artificial Sequence:  Enzymatic Nucleic Acid
  misc_feature (31)..(31): n stands for inosine
uccugucucugaugaggccguuaggccgaanagcaagg

SEQ ID NO: 13561 - RNA, 38 nt, Artificial Sequence
  Description of Artificial Sequence:  Enzymatic Nucleic Acid
  misc_feature (31)..(31): n stands for inosine
ggucuucccugaugaggccguuaggccgaanucuugag

SEQ ID NO: 13562 - RNA, 38 nt, Artificial Sequence
  Description of Artificial Sequence:  Enzymatic Nucleic Acid
  misc_feature (31)..(31): n stands for inosine
cuuuucuucugaugaggccguuaggccgaanucuuccu

SEQ ID NO: 13563 - RNA, 38 nt, Artificial Sequence
  Description of Artificial Sequence:  Enzymatic Nucleic Acid
  misc_feature (31)..(31): n stands for inosine
ucuuuucucugaugaggccguuaggccgaangucuucc

SEQ ID NO: 13564 - RNA, 38 nt, Artificial Sequence
  Description of Artificial Sequence:  Enzymatic Nucleic Acid
  misc_feature (31)..(31): n stands for inosine
ccacgcaacugaugaggccguuaggccgaanucuuuuc

SEQ ID NO: 13565 - RNA, 38 nt, Artificial Sequence
  Description of Artificial Sequence:  Enzymatic Nucleic Acid
  misc_feature (31)..(31): n stands for inosine
gagcugcccugaugaggccguuaggccgaanaccacgc

SEQ ID NO: 13566 - RNA, 38 nt, Artificial Sequence
  Description of Artificial Sequence:  Enzymatic Nucleic Acid
  misc_feature (31)..(31): n stands for inosine
cugugagccugaugaggccguuaggccgaanccugacc

SEQ ID NO: 13567 - RNA, 38 nt, Artificial Sequence
  Description of Artificial Sequence:  Enzymatic Nucleic Acid
  misc_feature (31)..(31): n stands for inosine
ggacugugcugaugaggccguuaggccgaancugccug

SEQ ID NO: 13568 - RNA, 38 nt, Artificial Sequence
  Description of Artificial Sequence:  Enzymatic Nucleic Acid
  misc_feature (31)..(31): n stands for inosine
uaggacugcugaugaggccguuaggccgaanagcugcc

SEQ ID NO: 13569 - RNA, 38 nt, Artificial Sequence
  Description of Artificial Sequence:  Enzymatic Nucleic Acid
  misc_feature (31)..(31): n stands for inosine
ucuaggaccugaugaggccguuaggccgaanugagcug

SEQ ID NO: 13570 - RNA, 38 nt, Artificial Sequence
  Description of Artificial Sequence:  Enzymatic Nucleic Acid
  misc_feature (31)..(31): n stands for inosine
acgcucuacugaugaggccguuaggccgaanacuguga

SEQ ID NO: 13571 - RNA, 38 nt, Artificial Sequence
  Description of Artificial Sequence:  Enzymatic Nucleic Acid
  misc_feature (31)..(31): n stands for inosine
cacgcucucugaugaggccguuaggccgaangacugug

SEQ ID NO: 13572 - RNA, 38 nt, Artificial Sequence
  Description of Artificial Sequence:  Enzymatic Nucleic Acid
  misc_feature (31)..(31): n stands for inosine
aucgugggcugaugaggccguuaggccgaanccacacg

SEQ ID NO: 13573 - RNA, 38 nt, Artificial Sequence
  Description of Artificial Sequence:  Enzymatic Nucleic Acid
  misc_feature (31)..(31): n stands for inosine
ugaucgugcugaugaggccguuaggccgaanugccaca

SEQ ID NO: 13574 - RNA, 38 nt, Artificial Sequence
  Description of Artificial Sequence:  Enzymatic Nucleic Acid
  misc_feature (31)..(31): n stands for inosine
gugaucgucugaugaggccguuaggccgaangugccac

SEQ ID NO: 13575 - RNA, 38 nt, Artificial Sequence
  Description of Artificial Sequence:  Enzymatic Nucleic Acid
  misc_feature (31)..(31): n stands for inosine
ugugaucgcugaugaggccguuaggccgaanggugcca

SEQ ID NO: 13576 - RNA, 38 nt, Artificial Sequence
  Description of Artificial Sequence:  Enzymatic Nucleic Acid
  misc_feature (31)..(31): n stands for inosine
guuuccugcugaugaggccguuaggccgaanaucgugg

SEQ ID NO: 13577 - RNA, 38 nt, Artificial Sequence
  Description of Artificial Sequence:  Enzymatic Nucleic Acid
  misc_feature (31)..(31): n stands for inosine
agguuucccugaugaggccguuaggccgaanugaucgu

SEQ ID NO: 13578 - RNA, 38 nt, Artificial Sequence
  Description of Artificial Sequence:  Enzymatic Nucleic Acid
  misc_feature (31)..(31): n stands for inosine
auucuccacugaugaggccguuaggccgaanuuuccug

SEQ ID NO: 13579 - RNA, 38 nt, Artificial Sequence
  Description of Artificial Sequence:  Enzymatic Nucleic Acid
  misc_feature (31)..(31): n stands for inosine
gauucucccugaugaggccguuaggccgaanguuuccu

SEQ ID NO: 13580 - RNA, 38 nt, Artificial Sequence
  Description of Artificial Sequence:  Enzymatic Nucleic Acid
  misc_feature (31)..(31): n stands for inosine
uugucguccugaugaggccguuaggccgaanauucucc

SEQ ID NO: 13581 - RNA, 38 nt, Artificial Sequence
  Description of Artificial Sequence:  Enzymatic Nucleic Acid
  misc_feature (31)..(31): n stands for inosine
ccaauacucugaugaggccguuaggccgaanucgucug

SEQ ID NO: 13582 - RNA, 38 nt, Artificial Sequence
  Description of Artificial Sequence:  Enzymatic Nucleic Acid
  misc_feature (31)..(31): n stands for inosine
gacuucgacugaugaggccguuaggccgaancuuuccc

SEQ ID NO: 13583 - RNA, 38 nt, Artificial Sequence
  Description of Artificial Sequence:  Enzymatic Nucleic Acid
  misc_feature (31)..(31): n stands for inosine
cgugcaugcugaugaggccguuaggccgaanacuucga

SEQ ID NO: 13584 - RNA, 38 nt, Artificial Sequence
  Description of Artificial Sequence:  Enzymatic Nucleic Acid
  misc_feature (31)..(31): n stands for inosine
gccgugcacugaugaggccguuaggccgaanagacuuc

SEQ ID NO: 13585 - RNA, 38 nt, Artificial Sequence
  Description of Artificial Sequence:  Enzymatic Nucleic Acid
  misc_feature (31)..(31): n stands for inosine
agaugccgcugaugaggccguuaggccgaancaugaga

SEQ ID NO: 13586 - RNA, 38 nt, Artificial Sequence
  Description of Artificial Sequence:  Enzymatic Nucleic Acid
  misc_feature (31)..(31): n stands for inosine
uucccagacugaugaggccguuaggccgaanccgugca

SEQ ID NO: 13587 - RNA, 38 nt, Artificial Sequence
  Description of Artificial Sequence:  Enzymatic Nucleic Acid
  misc_feature (31)..(31): n stands for inosine
ggauuccccugaugaggccguuaggccgaanaugccgu

SEQ ID NO: 13588 - RNA, 38 nt, Artificial Sequence
  Description of Artificial Sequence:  Enzymatic Nucleic Acid
  misc_feature (31)..(31): n stands for inosine
guggagggcugaugaggccguuaggccgaanauuccca

SEQ ID NO: 13589 - RNA, 38 nt, Artificial Sequence
  Description of Artificial Sequence:  Enzymatic Nucleic Acid
  misc_feature (31)..(31): n stands for inosine
uguggaggcugaugaggccguuaggccgaangauuccc

SEQ ID NO: 13590 - RNA, 38 nt, Artificial Sequence
  Description of Artificial Sequence:  Enzymatic Nucleic Acid
  misc_feature (31)..(31): n stands for inosine
cuguggagcugaugaggccguuaggccgaanggauucc

SEQ ID NO: 13591 - RNA, 38 nt, Artificial Sequence
  Description of Artificial Sequence:  Enzymatic Nucleic Acid
  misc_feature (31)..(31): n stands for inosine
ucuguggacugaugaggccguuaggccgaangggauuc

SEQ ID NO: 13592 - RNA, 38 nt, Artificial Sequence
  Description of Artificial Sequence:  Enzymatic Nucleic Acid
  misc_feature (31)..(31): n stands for inosine
aucuguggcugaugaggccguuaggccgaanggggauu

SEQ ID NO: 13593 - RNA, 38 nt, Artificial Sequence
  Description of Artificial Sequence:  Enzymatic Nucleic Acid
  misc_feature (31)..(31): n stands for inosine
ugaucugucugaugaggccguuaggccgaanaggggga

SEQ ID NO: 13594 - RNA, 38 nt, Artificial Sequence
  Description of Artificial Sequence:  Enzymatic Nucleic Acid
  misc_feature (31)..(31): n stands for inosine
augaucugcugaugaggccguuaggccgaangaggggg

SEQ ID NO: 13595 - RNA, 38 nt, Artificial Sequence
  Description of Artificial Sequence:  Enzymatic Nucleic Acid
  misc_feature (31)..(31): n stands for inosine
acaugauccugaugaggccguuaggccgaanuggaggg

SEQ ID NO: 13596 - RNA, 38 nt, Artificial Sequence
  Description of Artificial Sequence:  Enzymatic Nucleic Acid
  misc_feature (31)..(31): n stands for inosine
aaaccacacugaugaggccguuaggccgaanaucugug

SEQ ID NO: 13597 - RNA, 38 nt, Artificial Sequence
  Description of Artificial Sequence:  Enzymatic Nucleic Acid
  misc_feature (31)..(31): n stands for inosine
ucuacaagcugaugaggccguuaggccgaanucucauu

SEQ ID NO: 13598 - RNA, 38 nt, Artificial Sequence
  Description of Artificial Sequence:  Enzymatic Nucleic Acid
  misc_feature (31)..(31): n stands for inosine
uucuacaacugaugaggccguuaggccgaangucucau

SEQ ID NO: 13599 - RNA, 38 nt, Artificial Sequence
  Description of Artificial Sequence:  Enzymatic Nucleic Acid
  misc_feature (31)..(31): n stands for inosine
cuucuacacugaugaggccguuaggccgaanggucuca

SEQ ID NO: 13600 - RNA, 38 nt, Artificial Sequence
  Description of Artificial Sequence:  Enzymatic Nucleic Acid
  misc_feature (31)..(31): n stands for inosine
aaugccugcugaugaggccguuaggccgaanucuucua

SEQ ID NO: 13601 - RNA, 38 nt, Artificial Sequence
  Description of Artificial Sequence:  Enzymatic Nucleic Acid
  misc_feature (31)..(31): n stands for inosine
acaaugcccugaugaggccguuaggccgaanagucuuc

SEQ ID NO: 13602 - RNA, 38 nt, Artificial Sequence
  Description of Artificial Sequence:  Enzymatic Nucleic Acid
  misc_feature (31)..(31): n stands for inosine
caauacaacugaugaggccguuaggccgaanccugagu

SEQ ID NO: 13603 - RNA, 38 nt, Artificial Sequence
  Description of Artificial Sequence:  Enzymatic Nucleic Acid
  misc_feature (31)..(31): n stands for inosine
gagguucccugaugaggccguuaggccgaanuucccau

SEQ ID NO: 13604 - RNA, 38 nt, Artificial Sequence
  Description of Artificial Sequence:  Enzymatic Nucleic Acid
  misc_feature (31)..(31): n stands for inosine
gauagugacugaugaggccguuaggccgaanuuccggu

SEQ ID NO: 13605 - RNA, 38 nt, Artificial Sequence
  Description of Artificial Sequence:  Enzymatic Nucleic Acid
  misc_feature (31)..(31): n stands for inosine
ggauagugcugaugaggccguuaggccgaanguuccgg

SEQ ID NO: 13606 - RNA, 38 nt, Artificial Sequence
  Description of Artificial Sequence:  Enzymatic Nucleic Acid
  misc_feature (31)..(31): n stands for inosine
gcggauagcugaugaggccguuaggccgaanagguucc

SEQ ID NO: 13607 - RNA, 38 nt, Artificial Sequence
  Description of Artificial Sequence:  Enzymatic Nucleic Acid
  misc_feature (31)..(31): n stands for inosine
cugcggaucugaugaggccguuaggccgaanugagguu

SEQ ID NO: 13608 - RNA, 38 nt, Artificial Sequence
  Description of Artificial Sequence:  Enzymatic Nucleic Acid
  misc_feature (31)..(31): n stands for inosine
cacucugccugaugaggccguuaggccgaanauaguga

SEQ ID NO: 13609 - RNA, 38 nt, Artificial Sequence
  Description of Artificial Sequence:  Enzymatic Nucleic Acid
  misc_feature (31)..(31): n stands for inosine
ccucacuccugaugaggccguuaggccgaancggauag

SEQ ID NO: 13610 - RNA, 38 nt, Artificial Sequence
  Description of Artificial Sequence:  Enzymatic Nucleic Acid
  misc_feature (31)..(31): n stands for inosine
gguguagacugaugaggccguuaggccgaanccuucgu

SEQ ID NO: 13611 - RNA, 38 nt, Artificial Sequence
  Description of Artificial Sequence:  Enzymatic Nucleic Acid
  misc_feature (31)..(31): n stands for inosine
agguguagcugaugaggccguuaggccgaangccuucg

SEQ ID NO: 13612 - RNA, 38 nt, Artificial Sequence
  Description of Artificial Sequence:  Enzymatic Nucleic Acid
  misc_feature (31)..(31): n stands for inosine
gcaggugucugaugaggccguuaggccgaanaggccuu

SEQ ID NO: 13613 - RNA, 38 nt, Artificial Sequence
  Description of Artificial Sequence:  Enzymatic Nucleic Acid
  misc_feature (31)..(31): n stands for inosine
cuggcaggcugaugaggccguuaggccgaanuagaggc

SEQ ID NO: 13614 - RNA, 38 nt, Artificial Sequence
  Description of Artificial Sequence:  Enzymatic Nucleic Acid
  misc_feature (31)..(31): n stands for inosine
gccuggcacugaugaggccguuaggccgaanuguagag

SEQ ID NO: 13615 - RNA, 38 nt, Artificial Sequence
  Description of Artificial Sequence:  Enzymatic Nucleic Acid
  misc_feature (31)..(31): n stands for inosine
ugccuggccugaugaggccguuaggccgaanguguaga

SEQ ID NO: 13616 - RNA, 38 nt, Artificial Sequence
  Description of Artificial Sequence:  Enzymatic Nucleic Acid
  misc_feature (31)..(31): n stands for inosine
gcaugccucugaugaggccguuaggccgaancaggugu

SEQ ID NO: 13617 - RNA, 38 nt, Artificial Sequence
  Description of Artificial Sequence:  Enzymatic Nucleic Acid
  misc_feature (31)..(31): n stands for inosine
ugcaugcccugaugaggccguuaggccgaangcaggug

SEQ ID NO: 13618 - RNA, 38 nt, Artificial Sequence
  Description of Artificial Sequence:  Enzymatic Nucleic Acid
  misc_feature (31)..(31): n stands for inosine
acacugcacugaugaggccguuaggccgaanccuggca

SEQ ID NO: 13619 - RNA, 38 nt, Artificial Sequence
  Description of Artificial Sequence:  Enzymatic Nucleic Acid
  misc_feature (31)..(31): n stands for inosine
aagaacaccugaugaggccguuaggccgaancaugccu

SEQ ID NO: 13620 - RNA, 38 nt, Artificial Sequence
  Description of Artificial Sequence:  Enzymatic Nucleic Acid
  misc_feature (31)..(31): n stands for inosine
cacagccacugaugaggccguuaggccgaanaacacug

SEQ ID NO: 13621 - RNA, 38 nt, Artificial Sequence
  Description of Artificial Sequence:  Enzymatic Nucleic Acid
  misc_feature (31)..(31): n stands for inosine
uuuugcaccugaugaggccguuaggccgaanccaagaa

SEQ ID NO: 13622 - RNA, 38 nt, Artificial Sequence
  Description of Artificial Sequence:  Enzymatic Nucleic Acid
  misc_feature (31)..(31): n stands for inosine
uccacuuucugaugaggccguuaggccgaancacagcc

SEQ ID NO: 13623 - RNA, 38 nt, Artificial Sequence
  Description of Artificial Sequence:  Enzymatic Nucleic Acid
  misc_feature (31)..(31): n stands for inosine
augaaaaacugaugaggccguuaggccgaanccuccac

SEQ ID NO: 13624 - RNA, 38 nt, Artificial Sequence
  Description of Artificial Sequence:  Enzymatic Nucleic Acid
  misc_feature (31)..(31): n stands for inosine
uucuauuacugaugaggccguuaggccgaanaaaaaug

SEQ ID NO: 13625 - RNA, 38 nt, Artificial Sequence
  Description of Artificial Sequence:  Enzymatic Nucleic Acid
  misc_feature (31)..(31): n stands for inosine
uuuuccugcugaugaggccguuaggccgaancaccuuc

SEQ ID NO: 13626 - RNA, 38 nt, Artificial Sequence
  Description of Artificial Sequence:  Enzymatic Nucleic Acid
  misc_feature (31)..(31): n stands for inosine
cuuuuccucugaugaggccguuaggccgaangcaccuu

SEQ ID NO: 13627 - RNA, 38 nt, Artificial Sequence
  Description of Artificial Sequence:  Enzymatic Nucleic Acid
  misc_feature (31)..(31): n stands for inosine
ucuuuucccugaugaggccguuaggccgaanggcaccu

SEQ ID NO: 13628 - RNA, 38 nt, Artificial Sequence
  Description of Artificial Sequence:  Enzymatic Nucleic Acid
  misc_feature (31)..(31): n stands for inosine
gauuuccacugaugaggccguuaggccgaanuucgucu

SEQ ID NO: 13629 - RNA, 38 nt, Artificial Sequence
  Description of Artificial Sequence:  Enzymatic Nucleic Acid
  misc_feature (31)..(31): n stands for inosine
uagaauaacugaugaggccguuaggccgaanauuucca

SEQ ID NO: 13630 - RNA, 38 nt, Artificial Sequence
  Description of Artificial Sequence:  Enzymatic Nucleic Acid
  misc_feature (31)..(31): n stands for inosine
ugccuacucugaugaggccguuaggccgaanaauaaug

SEQ ID NO: 13631 - RNA, 38 nt, Artificial Sequence
  Description of Artificial Sequence:  Enzymatic Nucleic Acid
  misc_feature (31)..(31): n stands for inosine
caccgucgcugaugaggccguuaggccgaanccuacua

SEQ ID NO: 13632 - RNA, 38 nt, Artificial Sequence
  Description of Artificial Sequence:  Enzymatic Nucleic Acid
  misc_feature (31)..(31): n stands for inosine
aagaacaucugaugaggccguuaggccgaancaaucac

SEQ ID NO: 13633 - RNA, 38 nt, Artificial Sequence
  Description of Artificial Sequence:  Enzymatic Nucleic Acid
  misc_feature (31)..(31): n stands for inosine
gaagaacacugaugaggccguuaggccgaangcaauca

SEQ ID NO: 13634 - RNA, 38 nt, Artificial Sequence
  Description of Artificial Sequence:  Enzymatic Nucleic Acid
  misc_feature (31)..(31): n stands for inosine
uagccagacugaugaggccguuaggccgaanaacaugg

SEQ ID NO: 13635 - RNA, 38 nt, Artificial Sequence
  Description of Artificial Sequence:  Enzymatic Nucleic Acid
  misc_feature (31)..(31): n stands for inosine
aaguagcccugaugaggccguuaggccgaanaagaaca

SEQ ID NO: 13636 - RNA, 38 nt, Artificial Sequence
  Description of Artificial Sequence:  Enzymatic Nucleic Acid
  misc_feature (31)..(31): n stands for inosine
caagaagucugaugaggccguuaggccgaanccagaag

SEQ ID NO: 13637 - RNA, 38 nt, Artificial Sequence
  Description of Artificial Sequence:  Enzymatic Nucleic Acid
  misc_feature (31)..(31): n stands for inosine
ugacaagacugaugaggccguuaggccgaanuagccag

SEQ ID NO: 13638 - RNA, 38 nt, Artificial Sequence
  Description of Artificial Sequence:  Enzymatic Nucleic Acid
  misc_feature (31)..(31): n stands for inosine
ugaugacacugaugaggccguuaggccgaanaaguagc

SEQ ID NO: 13639 - RNA, 38 nt, Artificial Sequence
  Description of Artificial Sequence:  Enzymatic Nucleic Acid
  misc_feature (31)..(31): n stands for inosine
uaggaugacugaugaggccguuaggccgaanacaagaa

SEQ ID NO: 13640 - RNA, 38 nt, Artificial Sequence
  Description of Artificial Sequence:  Enzymatic Nucleic Acid
  misc_feature (31)..(31): n stands for inosine
cccuaggacugaugaggccguuaggccgaanaugacaa

SEQ ID NO: 13641 - RNA, 38 nt, Artificial Sequence
  Description of Artificial Sequence:  Enzymatic Nucleic Acid
  misc_feature (31)..(31): n stands for inosine
ggucccuacugaugaggccguuaggccgaanaugauga

SEQ ID NO: 13642 - RNA, 38 nt, Artificial Sequence
  Description of Artificial Sequence:  Enzymatic Nucleic Acid
  misc_feature (31)..(31): n stands for inosine
cggucccucugaugaggccguuaggccgaangaugaug

SEQ ID NO: 13643 - RNA, 38 nt, Artificial Sequence
  Description of Artificial Sequence:  Enzymatic Nucleic Acid
  misc_feature (31)..(31): n stands for inosine
cgcuuaaccugaugaggccguuaggccgaanucccuag

SEQ ID NO: 13644 - RNA, 38 nt, Artificial Sequence
  Description of Artificial Sequence:  Enzymatic Nucleic Acid
  misc_feature (31)..(31): n stands for inosine
ccuccauucugaugaggccguuaggccgaancccgcuu

SEQ ID NO: 13645 - RNA, 38 nt, Artificial Sequence
  Description of Artificial Sequence:  Enzymatic Nucleic Acid
  misc_feature (31)..(31): n stands for inosine
cccuccaucugaugaggccguuaggccgaangcccgcu

SEQ ID NO: 13646 - RNA, 38 nt, Artificial Sequence
  Description of Artificial Sequence:  Enzymatic Nucleic Acid
  misc_feature (31)..(31): n stands for inosine
cugucuuccugaugaggccguuaggccgaanuuccccu

SEQ ID NO: 13647 - RNA, 38 nt, Artificial Sequence
  Description of Artificial Sequence:  Enzymatic Nucleic Acid
  misc_feature (31)..(31): n stands for inosine
aaguagcccugaugaggccguuaggccgaanucuucag

SEQ ID NO: 13648 - RNA, 38 nt, Artificial Sequence
  Description of Artificial Sequence:  Enzymatic Nucleic Acid
  misc_feature (31)..(31): n stands for inosine
ggacaagucugaugaggccguuaggccgaanccugucu

SEQ ID NO: 13649 - RNA, 38 nt, Artificial Sequence
  Description of Artificial Sequence:  Enzymatic Nucleic Acid
  misc_feature (31)..(31): n stands for inosine
gauggacacugaugaggccguuaggccgaanuagccug

SEQ ID NO: 13650 - RNA, 38 nt, Artificial Sequence
  Description of Artificial Sequence:  Enzymatic Nucleic Acid
  misc_feature (31)..(31): n stands for inosine
augacgaucugaugaggccguuaggccgaanacaagua

SEQ ID NO: 13651 - RNA, 38 nt, Artificial Sequence
  Description of Artificial Sequence:  Enzymatic Nucleic Acid
  misc_feature (31)..(31): n stands for inosine
caugacgacugaugaggccguuaggccgaangacaagu

SEQ ID NO: 13652 - RNA, 38 nt, Artificial Sequence
  Description of Artificial Sequence:  Enzymatic Nucleic Acid
  misc_feature (31)..(31): n stands for inosine
uggauccacugaugaggccguuaggccgaanacgaugg

SEQ ID NO: 13653 - RNA, 38 nt, Artificial Sequence
  Description of Artificial Sequence:  Enzymatic Nucleic Acid
  misc_feature (31)..(31): n stands for inosine
guucaucucugaugaggccguuaggccgaanauccaug

SEQ ID NO: 13654 - RNA, 38 nt, Artificial Sequence
  Description of Artificial Sequence:  Enzymatic Nucleic Acid
  misc_feature (31)..(31): n stands for inosine
aguucauccugaugaggccguuaggccgaangauccau

SEQ ID NO: 13655 - RNA, 38 nt, Artificial Sequence
  Description of Artificial Sequence:  Enzymatic Nucleic Acid
  misc_feature (31)..(31): n stands for inosine
ccaaugggcugaugaggccguuaggccgaanuucaucu

SEQ ID NO: 13656 - RNA, 38 nt, Artificial Sequence
  Description of Artificial Sequence:  Enzymatic Nucleic Acid
  misc_feature (31)..(31): n stands for inosine
auccaaugcugaugaggccguuaggccgaanaguucau

SEQ ID NO: 13657 - RNA, 38 nt, Artificial Sequence
  Description of Artificial Sequence:  Enzymatic Nucleic Acid
  misc_feature (31)..(31): n stands for inosine
cauccaaucugaugaggccguuaggccgaangaguuca

SEQ ID NO: 13658 - RNA, 38 nt, Artificial Sequence
  Description of Artificial Sequence:  Enzymatic Nucleic Acid
  misc_feature (31)..(31): n stands for inosine
ucauccaacugaugaggccguuaggccgaanggaguuc

SEQ ID NO: 13659 - RNA, 38 nt, Artificial Sequence
  Description of Artificial Sequence:  Enzymatic Nucleic Acid
  misc_feature (31)..(31): n stands for inosine
guucacaacugaugaggccguuaggccgaanuucaucc

SEQ ID NO: 13660 - RNA, 38 nt, Artificial Sequence
  Description of Artificial Sequence:  Enzymatic Nucleic Acid
  misc_feature (31)..(31): n stands for inosine
cauaaggccugaugaggccguuaggccgaanucguuca

SEQ ID NO: 13661 - RNA, 38 nt, Artificial Sequence
  Description of Artificial Sequence:  Enzymatic Nucleic Acid
  misc_feature (31)..(31): n stands for inosine
caucauaacugaugaggccguuaggccgaancagucgu

SEQ ID NO: 13662 - RNA, 38 nt, Artificial Sequence
  Description of Artificial Sequence:  Enzymatic Nucleic Acid
  misc_feature (31)..(31): n stands for inosine
gcaucauacugaugaggccguuaggccgaangcagucg

SEQ ID NO: 13663 - RNA, 38 nt, Artificial Sequence
  Description of Artificial Sequence:  Enzymatic Nucleic Acid
  misc_feature (31)..(31): n stands for inosine
cauuugcucugaugaggccguuaggccgaancaucaua

SEQ ID NO: 13664 - RNA, 38 nt, Artificial Sequence
  Description of Artificial Sequence:  Enzymatic Nucleic Acid
  misc_feature (31)..(31): n stands for inosine
ccauuugccugaugaggccguuaggccgaangcaucau

SEQ ID NO: 13665 - RNA, 38 nt, Artificial Sequence
  Description of Artificial Sequence:  Enzymatic Nucleic Acid
  misc_feature (31)..(31): n stands for inosine
uucccauucugaugaggccguuaggccgaancuggcau

SEQ ID NO: 13666 - RNA, 38 nt, Artificial Sequence
  Description of Artificial Sequence:  Enzymatic Nucleic Acid
  misc_feature (31)..(31): n stands for inosine
gucucuggcugaugaggccguuaggccgaanaauuccc

SEQ ID NO: 13667 - RNA, 38 nt, Artificial Sequence
  Description of Artificial Sequence:  Enzymatic Nucleic Acid
  misc_feature (31)..(31): n stands for inosine
ggucucugcugaugaggccguuaggccgaangaauucc

SEQ ID NO: 13668 - RNA, 38 nt, Artificial Sequence
  Description of Artificial Sequence:  Enzymatic Nucleic Acid
  misc_feature (31)..(31): n stands for inosine
cggucucucugaugaggccguuaggccgaanggaauuc

SEQ ID NO: 13669 - RNA, 38 nt, Artificial Sequence
  Description of Artificial Sequence:  Enzymatic Nucleic Acid
  misc_feature (31)..(31): n stands for inosine
ccggucuccugaugaggccguuaggccgaangggaauu

SEQ ID NO: 13670 - RNA, 38 nt, Artificial Sequence
  Description of Artificial Sequence:  Enzymatic Nucleic Acid
  misc_feature (31)..(31): n stands for inosine
guucagcccugaugaggccguuaggccgaanucucugg

SEQ ID NO: 13671 - RNA, 38 nt, Artificial Sequence
  Description of Artificial Sequence:  Enzymatic Nucleic Acid
  misc_feature (31)..(31): n stands for inosine
cuagguuccugaugaggccguuaggccgaanccggucu

SEQ ID NO: 13672 - RNA, 38 nt, Artificial Sequence
  Description of Artificial Sequence:  Enzymatic Nucleic Acid
  misc_feature (31)..(31): n stands for inosine
cuuaccuacugaugaggccguuaggccgaanuucagcc

SEQ ID NO: 13673 - RNA, 38 nt, Artificial Sequence
  Description of Artificial Sequence:  Enzymatic Nucleic Acid
  misc_feature (31)..(31): n stands for inosine
gcuuaccucugaugaggccguuaggccgaanguucagc

SEQ ID NO: 13674 - RNA, 38 nt, Artificial Sequence
  Description of Artificial Sequence:  Enzymatic Nucleic Acid
  misc_feature (31)..(31): n stands for inosine
ggccaagacugaugaggccguuaggccgaancuuaccu

SEQ ID NO: 13675 - RNA, 38 nt, Artificial Sequence
  Description of Artificial Sequence:  Enzymatic Nucleic Acid
  misc_feature (31)..(31): n stands for inosine
cggccaagcugaugaggccguuaggccgaangcuuacc

SEQ ID NO: 13676 - RNA, 38 nt, Artificial Sequence
  Description of Artificial Sequence:  Enzymatic Nucleic Acid
  misc_feature (31)..(31): n stands for inosine
cacggccacugaugaggccguuaggccgaanaggcuua

SEQ ID NO: 13677 - RNA, 38 nt, Artificial Sequence
  Description of Artificial Sequence:  Enzymatic Nucleic Acid
  misc_feature (31)..(31): n stands for inosine
ggcaccaccugaugaggccguuaggccgaanccaagag

SEQ ID NO: 13678 - RNA, 38 nt, Artificial Sequence
  Description of Artificial Sequence:  Enzymatic Nucleic Acid
  misc_feature (31)..(31): n stands for inosine
uggccaaacugaugaggccguuaggccgaancaccacg

SEQ ID NO: 13679 - RNA, 38 nt, Artificial Sequence
  Description of Artificial Sequence:  Enzymatic Nucleic Acid
  misc_feature (31)..(31): n stands for inosine
uuggccaacugaugaggccguuaggccgaangcaccac

SEQ ID NO: 13680 - RNA, 38 nt, Artificial Sequence
  Description of Artificial Sequence:  Enzymatic Nucleic Acid
  misc_feature (31)..(31): n stands for inosine
aaucucuucugaugaggccguuaggccgaanccaaagg

SEQ ID NO: 13681 - RNA, 38 nt, Artificial Sequence
  Description of Artificial Sequence:  Enzymatic Nucleic Acid
  misc_feature (31)..(31): n stands for inosine
caaucucucugaugaggccguuaggccgaangccaaag

SEQ ID NO: 13682 - RNA, 38 nt, Artificial Sequence
  Description of Artificial Sequence:  Enzymatic Nucleic Acid
  misc_feature (31)..(31): n stands for inosine
aaggcauccugaugaggccguuaggccgaancuucaau

SEQ ID NO: 13683 - RNA, 38 nt, Artificial Sequence
  Description of Artificial Sequence:  Enzymatic Nucleic Acid
  misc_feature (31)..(31): n stands for inosine
auuccaaacugaugaggccguuaggccgaancaucugc

SEQ ID NO: 13684 - RNA, 38 nt, Artificial Sequence
  Description of Artificial Sequence:  Enzymatic Nucleic Acid
  misc_feature (31)..(31): n stands for inosine
aauuccaacugaugaggccguuaggccgaangcaucug

SEQ ID NO: 13685 - RNA, 38 nt, Artificial Sequence
  Description of Artificial Sequence:  Enzymatic Nucleic Acid
  misc_feature (31)..(31): n stands for inosine
ugcugucucugaugaggccguuaggccgaanucaauuc

SEQ ID NO: 13686 - RNA, 38 nt, Artificial Sequence
  Description of Artificial Sequence:  Enzymatic Nucleic Acid
  misc_feature (31)..(31): n stands for inosine
caaguugccugaugaggccguuaggccgaanucuuguc

SEQ ID NO: 13687 - RNA, 38 nt, Artificial Sequence
  Description of Artificial Sequence:  Enzymatic Nucleic Acid
  misc_feature (31)..(31): n stands for inosine
cugcaagucugaugaggccguuaggccgaancugucuu

SEQ ID NO: 13688 - RNA, 38 nt, Artificial Sequence
  Description of Artificial Sequence:  Enzymatic Nucleic Acid
  misc_feature (31)..(31): n stands for inosine
guccugcacugaugaggccguuaggccgaanuugcugu

SEQ ID NO: 13689 - RNA, 38 nt, Artificial Sequence
  Description of Artificial Sequence:  Enzymatic Nucleic Acid
  misc_feature (31)..(31): n stands for inosine
uacugucccugaugaggccguuaggccgaancaaguug

SEQ ID NO: 13690 - RNA, 38 nt, Artificial Sequence
  Description of Artificial Sequence:  Enzymatic Nucleic Acid
  misc_feature (31)..(31): n stands for inosine
acugcuaccugaugaggccguuaggccgaanuccugca

SEQ ID NO: 13691 - RNA, 38 nt, Artificial Sequence
  Description of Artificial Sequence:  Enzymatic Nucleic Acid
  misc_feature (31)..(31): n stands for inosine
auuuugaccugaugaggccguuaggccgaancuacugu

SEQ ID NO: 13692 - RNA, 38 nt, Artificial Sequence
  Description of Artificial Sequence:  Enzymatic Nucleic Acid
  misc_feature (31)..(31): n stands for inosine
caacauuucugaugaggccguuaggccgaanacugcua

SEQ ID NO: 13693 - RNA, 38 nt, Artificial Sequence
  Description of Artificial Sequence:  Enzymatic Nucleic Acid
  misc_feature (31)..(31): n stands for inosine
cugugugucugaugaggccguuaggccgaancuccuuc

SEQ ID NO: 13694 - RNA, 38 nt, Artificial Sequence
  Description of Artificial Sequence:  Enzymatic Nucleic Acid
  misc_feature (31)..(31): n stands for inosine
ucacugugcugaugaggccguuaggccgaanuugcucc

SEQ ID NO: 13695 - RNA, 38 nt, Artificial Sequence
  Description of Artificial Sequence:  Enzymatic Nucleic Acid
  misc_feature (31)..(31): n stands for inosine
gcucacugcugaugaggccguuaggccgaanuguugcu

SEQ ID NO: 13696 - RNA, 38 nt, Artificial Sequence
  Description of Artificial Sequence:  Enzymatic Nucleic Acid
  misc_feature (31)..(31): n stands for inosine
augcucaccugaugaggccguuaggccgaanuguguug

SEQ ID NO: 13697 - RNA, 38 nt, Artificial Sequence
  Description of Artificial Sequence:  Enzymatic Nucleic Acid
  misc_feature (31)..(31): n stands for inosine
gagcucgacugaugaggccguuaggccgaancucacug

SEQ ID NO: 13698 - RNA, 38 nt, Artificial Sequence
  Description of Artificial Sequence:  Enzymatic Nucleic Acid
  misc_feature (31)..(31): n stands for inosine
gacaugagcugaugaggccguuaggccgaancucgaug

SEQ ID NO: 13699 - RNA, 38 nt, Artificial Sequence
  Description of Artificial Sequence:  Enzymatic Nucleic Acid
  misc_feature (31)..(31): n stands for inosine
cagacaugcugaugaggccguuaggccgaanagcucga

SEQ ID NO: 13700 - RNA, 38 nt, Artificial Sequence
  Description of Artificial Sequence:  Enzymatic Nucleic Acid
  misc_feature (31)..(31): n stands for inosine
uucagacacugaugaggccguuaggccgaanagagcuc

SEQ ID NO: 13701 - RNA, 38 nt, Artificial Sequence
  Description of Artificial Sequence:  Enzymatic Nucleic Acid
  misc_feature (31)..(31): n stands for inosine
uugaguuccugaugaggccguuaggccgaanacaugag

SEQ ID NO: 13702 - RNA, 38 nt, Artificial Sequence
  Description of Artificial Sequence:  Enzymatic Nucleic Acid
  misc_feature (31)..(31): n stands for inosine
ggaucuugcugaugaggccguuaggccgaanuucagac

SEQ ID NO: 13703 - RNA, 38 nt, Artificial Sequence
  Description of Artificial Sequence:  Enzymatic Nucleic Acid
  misc_feature (31)..(31): n stands for inosine
gaggaucucugaugaggccguuaggccgaanaguucag

SEQ ID NO: 13704 - RNA, 38 nt, Artificial Sequence
  Description of Artificial Sequence:  Enzymatic Nucleic Acid
  misc_feature (31)..(31): n stands for inosine
augaaugacugaugaggccguuaggccgaanaucuuga

SEQ ID NO: 13705 - RNA, 38 nt, Artificial Sequence
  Description of Artificial Sequence:  Enzymatic Nucleic Acid
  misc_feature (31)..(31): n stands for inosine
uaugaaugcugaugaggccguuaggccgaangaucuug

SEQ ID NO: 13706 - RNA, 38 nt, Artificial Sequence
  Description of Artificial Sequence:  Enzymatic Nucleic Acid
  misc_feature (31)..(31): n stands for inosine
aauaugaacugaugaggccguuaggccgaanaggaucu

SEQ ID NO: 13707 - RNA, 38 nt, Artificial Sequence
  Description of Artificial Sequence:  Enzymatic Nucleic Acid
  misc_feature (31)..(31): n stands for inosine
gaccaauacugaugaggccguuaggccgaanaaugagg

SEQ ID NO: 13708 - RNA, 38 nt, Artificial Sequence
  Description of Artificial Sequence:  Enzymatic Nucleic Acid
  misc_feature (31)..(31): n stands for inosine
ugagauggcugaugaggccguuaggccgaanaccaaua

SEQ ID NO: 13709 - RNA, 38 nt, Artificial Sequence
  Description of Artificial Sequence:  Enzymatic Nucleic Acid
  misc_feature (31)..(31): n stands for inosine
auugagaucugaugaggccguuaggccgaanugaccaa

SEQ ID NO: 13710 - RNA, 38 nt, Artificial Sequence
  Description of Artificial Sequence:  Enzymatic Nucleic Acid
  misc_feature (31)..(31): n stands for inosine
cauugagacugaugaggccguuaggccgaangugacca

SEQ ID NO: 13711 - RNA, 38 nt, Artificial Sequence
  Description of Artificial Sequence:  Enzymatic Nucleic Acid
  misc_feature (31)..(31): n stands for inosine
ccacauugcugaugaggccguuaggccgaanaugguga

SEQ ID NO: 13712 - RNA, 38 nt, Artificial Sequence
  Description of Artificial Sequence:  Enzymatic Nucleic Acid
  misc_feature (31)..(31): n stands for inosine
gaccacaucugaugaggccguuaggccgaanagauggu

SEQ ID NO: 13713 - RNA, 38 nt, Artificial Sequence
  Description of Artificial Sequence:  Enzymatic Nucleic Acid
  misc_feature (31)..(31): n stands for inosine
uagaaggucugaugaggccguuaggccgaanaccacau

SEQ ID NO: 13714 - RNA, 38 nt, Artificial Sequence
  Description of Artificial Sequence:  Enzymatic Nucleic Acid
  misc_feature (31)..(31): n stands for inosine
accuagaacugaugaggccguuaggccgaanuugacca

SEQ ID NO: 13715 - RNA, 38 nt, Artificial Sequence
  Description of Artificial Sequence:  Enzymatic Nucleic Acid
  misc_feature (31)..(31): n stands for inosine
caccuagacugaugaggccguuaggccgaanguugacc

SEQ ID NO: 13716 - RNA, 38 nt, Artificial Sequence
  Description of Artificial Sequence:  Enzymatic Nucleic Acid
  misc_feature (31)..(31): n stands for inosine
aggcaccucugaugaggccguuaggccgaanaagguug

SEQ ID NO: 13717 - RNA, 38 nt, Artificial Sequence
  Description of Artificial Sequence:  Enzymatic Nucleic Acid
  misc_feature (31)..(31): n stands for inosine
uugguacacugaugaggccguuaggccgaancaccuag

SEQ ID NO: 13718 - RNA, 38 nt, Artificial Sequence
  Description of Artificial Sequence:  Enzymatic Nucleic Acid
  misc_feature (31)..(31): n stands for inosine
cuugguaccugaugaggccguuaggccgaangcaccua

SEQ ID NO: 13719 - RNA, 38 nt, Artificial Sequence
  Description of Artificial Sequence:  Enzymatic Nucleic Acid
  misc_feature (31)..(31): n stands for inosine
ccuggcuucugaugaggccguuaggccgaanuacaggc

SEQ ID NO: 13720 - RNA, 38 nt, Artificial Sequence
  Description of Artificial Sequence:  Enzymatic Nucleic Acid
  misc_feature (31)..(31): n stands for inosine
uccuggcucugaugaggccguuaggccgaanguacagg

SEQ ID NO: 13721 - RNA, 38 nt, Artificial Sequence
  Description of Artificial Sequence:  Enzymatic Nucleic Acid
  misc_feature (31)..(31): n stands for inosine
gcccuccucugaugaggccguuaggccgaancuuggua

SEQ ID NO: 13722 - RNA, 38 nt, Artificial Sequence
  Description of Artificial Sequence:  Enzymatic Nucleic Acid
  misc_feature (31)..(31): n stands for inosine
ggcccucccugaugaggccguuaggccgaangcuuggu

SEQ ID NO: 13723 - RNA, 38 nt, Artificial Sequence
  Description of Artificial Sequence:  Enzymatic Nucleic Acid
  misc_feature (31)..(31): n stands for inosine
ccaugagucugaugaggccguuaggccgaancccuccu

SEQ ID NO: 13724 - RNA, 38 nt, Artificial Sequence
  Description of Artificial Sequence:  Enzymatic Nucleic Acid
  misc_feature (31)..(31): n stands for inosine
accaugagcugaugaggccguuaggccgaangcccucc

SEQ ID NO: 13725 - RNA, 38 nt, Artificial Sequence
  Description of Artificial Sequence:  Enzymatic Nucleic Acid
  misc_feature (31)..(31): n stands for inosine
ucaccaugcugaugaggccguuaggccgaanuggcccu

SEQ ID NO: 13726 - RNA, 38 nt, Artificial Sequence
  Description of Artificial Sequence:  Enzymatic Nucleic Acid
  misc_feature (31)..(31): n stands for inosine
aaucaccacugaugaggccguuaggccgaanaguggcc

SEQ ID NO: 13727 - RNA, 38 nt, Artificial Sequence
  Description of Artificial Sequence:  Enzymatic Nucleic Acid
  misc_feature (31)..(31): n stands for inosine
aaauuugccugaugaggccguuaggccgaanaauucca

SEQ ID NO: 13728 - RNA, 38 nt, Artificial Sequence
  Description of Artificial Sequence:  Enzymatic Nucleic Acid
  misc_feature (31)..(31): n stands for inosine
uccaaauucugaugaggccguuaggccgaancagaauu

SEQ ID NO: 13729 - RNA, 38 nt, Artificial Sequence
  Description of Artificial Sequence:  Enzymatic Nucleic Acid
  misc_feature (31)..(31): n stands for inosine
aguggacacugaugaggccguuaggccgaanuuuccaa

SEQ ID NO: 13730 - RNA, 38 nt, Artificial Sequence
  Description of Artificial Sequence:  Enzymatic Nucleic Acid
  misc_feature (31)..(31): n stands for inosine
aaguggaccugaugaggccguuaggccgaanguuucca

SEQ ID NO: 13731 - RNA, 38 nt, Artificial Sequence
  Description of Artificial Sequence:  Enzymatic Nucleic Acid
  misc_feature (31)..(31): n stands for inosine
agguaagucugaugaggccguuaggccgaanacagguu

SEQ ID NO: 13732 - RNA, 38 nt, Artificial Sequence
  Description of Artificial Sequence:  Enzymatic Nucleic Acid
  misc_feature (31)..(31): n stands for inosine
cagguaagcugaugaggccguuaggccgaangacaggu

SEQ ID NO: 13733 - RNA, 38 nt, Artificial Sequence
  Description of Artificial Sequence:  Enzymatic Nucleic Acid
  misc_feature (31)..(31): n stands for inosine
cucagguacugaugaggccguuaggccgaanuggacag

SEQ ID NO: 13734 - RNA, 38 nt, Artificial Sequence
  Description of Artificial Sequence:  Enzymatic Nucleic Acid
  misc_feature (31)..(31): n stands for inosine
gcuccucacugaugaggccguuaggccgaanuaagugg

SEQ ID NO: 13735 - RNA, 38 nt, Artificial Sequence
  Description of Artificial Sequence:  Enzymatic Nucleic Acid
  misc_feature (31)..(31): n stands for inosine
ugcuccuccugaugaggccguuaggccgaanguaagug

SEQ ID NO: 13736 - RNA, 38 nt, Artificial Sequence
  Description of Artificial Sequence:  Enzymatic Nucleic Acid
  misc_feature (31)..(31): n stands for inosine
auuucucucugaugaggccguuaggccgaancuccuca

SEQ ID NO: 13737 - RNA, 38 nt, Artificial Sequence
  Description of Artificial Sequence:  Enzymatic Nucleic Acid
  misc_feature (31)..(31): n stands for inosine
cuuguaggcugaugaggccguuaggccgaanacaaauu

SEQ ID NO: 13738 - RNA, 38 nt, Artificial Sequence
  Description of Artificial Sequence:  Enzymatic Nucleic Acid
  misc_feature (31)..(31): n stands for inosine
ucuuguagcugaugaggccguuaggccgaangacaaau

SEQ ID NO: 13739 - RNA, 38 nt, Artificial Sequence
  Description of Artificial Sequence:  Enzymatic Nucleic Acid
  misc_feature (31)..(31): n stands for inosine
gucuuguacugaugaggccguuaggccgaanggacaaa

SEQ ID NO: 13740 - RNA, 38 nt, Artificial Sequence
  Description of Artificial Sequence:  Enzymatic Nucleic Acid
  misc_feature (31)..(31): n stands for inosine
ggucuugucugaugaggccguuaggccgaangggacaa

SEQ ID NO: 13741 - RNA, 38 nt, Artificial Sequence
  Description of Artificial Sequence:  Enzymatic Nucleic Acid
  misc_feature (31)..(31): n stands for inosine
uuuggucucugaugaggccguuaggccgaanuagggga

SEQ ID NO: 13742 - RNA, 38 nt, Artificial Sequence
  Description of Artificial Sequence:  Enzymatic Nucleic Acid
  misc_feature (31)..(31): n stands for inosine
gccccuuucugaugaggccguuaggccgaanucuugua

SEQ ID NO: 13743 - RNA, 38 nt, Artificial Sequence
  Description of Artificial Sequence:  Enzymatic Nucleic Acid
  misc_feature (31)..(31): n stands for inosine
ugccccuucugaugaggccguuaggccgaangucuugu

SEQ ID NO: 13744 - RNA, 38 nt, Artificial Sequence
  Description of Artificial Sequence:  Enzymatic Nucleic Acid
  misc_feature (31)..(31): n stands for inosine
cggaaucgcugaugaggccguuaggccgaanccccuuu

SEQ ID NO: 13745 - RNA, 38 nt, Artificial Sequence
  Description of Artificial Sequence:  Enzymatic Nucleic Acid
  misc_feature (31)..(31): n stands for inosine
cccuugaccugaugaggccguuaggccgaanaaucgug

SEQ ID NO: 13746 - RNA, 38 nt, Artificial Sequence
  Description of Artificial Sequence:  Enzymatic Nucleic Acid
  misc_feature (31)..(31): n stands for inosine
cuuucccucugaugaggccguuaggccgaanacggaau

SEQ ID NO: 13747 - RNA, 38 nt, Artificial Sequence
  Description of Artificial Sequence:  Enzymatic Nucleic Acid
  misc_feature (31)..(31): n stands for inosine
uccaacgucugaugaggccguuaggccgaanucuuucc

SEQ ID NO: 13748 - RNA, 38 nt, Artificial Sequence
  Description of Artificial Sequence:  Enzymatic Nucleic Acid
  misc_feature (31)..(31): n stands for inosine
acagggaucugaugaggccguuaggccgaancuccaac

SEQ ID NO: 13749 - RNA, 38 nt, Artificial Sequence
  Description of Artificial Sequence:  Enzymatic Nucleic Acid
  misc_feature (31)..(31): n stands for inosine
auccacagcugaugaggccguuaggccgaanauugcuc

SEQ ID NO: 13750 - RNA, 38 nt, Artificial Sequence
  Description of Artificial Sequence:  Enzymatic Nucleic Acid
  misc_feature (31)..(31): n stands for inosine
gauccacacugaugaggccguuaggccgaangauugcu

SEQ ID NO: 13751 - RNA, 38 nt, Artificial Sequence
  Description of Artificial Sequence:  Enzymatic Nucleic Acid
  misc_feature (31)..(31): n stands for inosine
agauccaccugaugaggccguuaggccgaanggauugc

SEQ ID NO: 13752 - RNA, 38 nt, Artificial Sequence
  Description of Artificial Sequence:  Enzymatic Nucleic Acid
  misc_feature (31)..(31): n stands for inosine
gccguuuccugaugaggccguuaggccgaanauccaca

SEQ ID NO: 13753 - RNA, 38 nt, Artificial Sequence
  Description of Artificial Sequence:  Enzymatic Nucleic Acid
  misc_feature (31)..(31): n stands for inosine
gcuguccacugaugaggccguuaggccgaancgccguu

SEQ ID NO: 13754 - RNA, 38 nt, Artificial Sequence
  Description of Artificial Sequence:  Enzymatic Nucleic Acid
  misc_feature (31)..(31): n stands for inosine
ggugaugccugaugaggccguuaggccgaanuccaagc

SEQ ID NO: 13755 - RNA, 38 nt, Artificial Sequence
  Description of Artificial Sequence:  Enzymatic Nucleic Acid
  misc_feature (31)..(31): n stands for inosine
acuggugacugaugaggccguuaggccgaancugucca

SEQ ID NO: 13756 - RNA, 38 nt, Artificial Sequence
  Description of Artificial Sequence:  Enzymatic Nucleic Acid
  misc_feature (31)..(31): n stands for inosine
gcuacuggcugaugaggccguuaggccgaanaugcugu

SEQ ID NO: 13757 - RNA, 38 nt, Artificial Sequence
  Description of Artificial Sequence:  Enzymatic Nucleic Acid
  misc_feature (31)..(31): n stands for inosine
uggcuacucugaugaggccguuaggccgaanugaugcu

SEQ ID NO: 13758 - RNA, 38 nt, Artificial Sequence
  Description of Artificial Sequence:  Enzymatic Nucleic Acid
  misc_feature (31)..(31): n stands for inosine
cuggcuaccugaugaggccguuaggccgaangugaugc

SEQ ID NO: 13759 - RNA, 38 nt, Artificial Sequence
  Description of Artificial Sequence:  Enzymatic Nucleic Acid
  misc_feature (31)..(31): n stands for inosine
ugagcucucugaugaggccguuaggccgaancuacugg

SEQ ID NO: 13760 - RNA, 38 nt, Artificial Sequence
  Description of Artificial Sequence:  Enzymatic Nucleic Acid
  misc_feature (31)..(31): n stands for inosine
cugagcuccugaugaggccguuaggccgaangcuacug

SEQ ID NO: 13761 - RNA, 38 nt, Artificial Sequence
  Description of Artificial Sequence:  Enzymatic Nucleic Acid
  misc_feature (31)..(31): n stands for inosine
gcuggcugcugaugaggccguuaggccgaancucuggc

SEQ ID NO: 13762 - RNA, 38 nt, Artificial Sequence
  Description of Artificial Sequence:  Enzymatic Nucleic Acid
  misc_feature (31)..(31): n stands for inosine
gagcuggccugaugaggccguuaggccgaanagcucug

SEQ ID NO: 13763 - RNA, 38 nt, Artificial Sequence
  Description of Artificial Sequence:  Enzymatic Nucleic Acid
  misc_feature (31)..(31): n stands for inosine
ccagagcucugaugaggccguuaggccgaancugagcu

SEQ ID NO: 13764 - RNA, 38 nt, Artificial Sequence
  Description of Artificial Sequence:  Enzymatic Nucleic Acid
  misc_feature (31)..(31): n stands for inosine
uccagagccugaugaggccguuaggccgaangcugagc

SEQ ID NO: 13765 - RNA, 38 nt, Artificial Sequence
  Description of Artificial Sequence:  Enzymatic Nucleic Acid
  misc_feature (31)..(31): n stands for inosine
aaauccagcugaugaggccguuaggccgaancuggcug

SEQ ID NO: 13766 - RNA, 38 nt, Artificial Sequence
  Description of Artificial Sequence:  Enzymatic Nucleic Acid
  misc_feature (31)..(31): n stands for inosine
acaaaucccugaugaggccguuaggccgaanagcuggc

SEQ ID NO: 13767 - RNA, 38 nt, Artificial Sequence
  Description of Artificial Sequence:  Enzymatic Nucleic Acid
  misc_feature (31)..(31): n stands for inosine
ucacugagcugaugaggccguuaggccgaanacuucuc

SEQ ID NO: 13768 - RNA, 38 nt, Artificial Sequence
  Description of Artificial Sequence:  Enzymatic Nucleic Acid
  misc_feature (31)..(31): n stands for inosine
aucacugacugaugaggccguuaggccgaangacuucu

SEQ ID NO: 13769 - RNA, 38 nt, Artificial Sequence
  Description of Artificial Sequence:  Enzymatic Nucleic Acid
  misc_feature (31)..(31): n stands for inosine
caucacugcugaugaggccguuaggccgaanggacuuc

SEQ ID NO: 13770 - RNA, 38 nt, Artificial Sequence
  Description of Artificial Sequence:  Enzymatic Nucleic Acid
  misc_feature (31)..(31): n stands for inosine
uacaucaccugaugaggccguuaggccgaanagggacu

SEQ ID NO: 13771 - RNA, 38 nt, Artificial Sequence
  Description of Artificial Sequence:  Enzymatic Nucleic Acid
  misc_feature (31)..(31): n stands for inosine
ucuucaggcugaugaggccguuaggccgaancuuccuc

SEQ ID NO: 13772 - RNA, 38 nt, Artificial Sequence
  Description of Artificial Sequence:  Enzymatic Nucleic Acid
  misc_feature (31)..(31): n stands for inosine
gaucuucacugaugaggccguuaggccgaanagcuucc

SEQ ID NO: 13773 - RNA, 38 nt, Artificial Sequence
  Description of Artificial Sequence:  Enzymatic Nucleic Acid
  misc_feature (31)..(31): n stands for inosine
agaucuuccugaugaggccguuaggccgaangagcuuc

SEQ ID NO: 13774 - RNA, 38 nt, Artificial Sequence
  Description of Artificial Sequence:  Enzymatic Nucleic Acid
  misc_feature (31)..(31): n stands for inosine
ccuuauaccugaugaggccguuaggccgaanaucuuca

SEQ ID NO: 13775 - RNA, 38 nt, Artificial Sequence
  Description of Artificial Sequence:  Enzymatic Nucleic Acid
  misc_feature (31)..(31): n stands for inosine
ggucaggacugaugaggccguuaggccgaanuccuuau

SEQ ID NO: 13776 - RNA, 38 nt, Artificial Sequence
  Description of Artificial Sequence:  Enzymatic Nucleic Acid
  misc_feature (31)..(31): n stands for inosine
caaggucacugaugaggccguuaggccgaanaaguccu

SEQ ID NO: 13777 - RNA, 38 nt, Artificial Sequence
  Description of Artificial Sequence:  Enzymatic Nucleic Acid
  misc_feature (31)..(31): n stands for inosine
ccaagguccugaugaggccguuaggccgaangaagucc

SEQ ID NO: 13778 - RNA, 38 nt, Artificial Sequence
  Description of Artificial Sequence:  Enzymatic Nucleic Acid
  misc_feature (31)..(31): n stands for inosine
ugcuccaacugaugaggccguuaggccgaanucaggaa

SEQ ID NO: 13779 - RNA, 38 nt, Artificial Sequence
  Description of Artificial Sequence:  Enzymatic Nucleic Acid
  misc_feature (31)..(31): n stands for inosine
augcuccacugaugaggccguuaggccgaangucagga

SEQ ID NO: 13780 - RNA, 38 nt, Artificial Sequence
  Description of Artificial Sequence:  Enzymatic Nucleic Acid
  misc_feature (31)..(31): n stands for inosine
agaugagacugaugaggccguuaggccgaancuccaag

SEQ ID NO: 13781 - RNA, 38 nt, Artificial Sequence
  Description of Artificial Sequence:  Enzymatic Nucleic Acid
  misc_feature (31)..(31): n stands for inosine
aacagaugcugaugaggccguuaggccgaanaugcucc

SEQ ID NO: 13782 - RNA, 38 nt, Artificial Sequence
  Description of Artificial Sequence:  Enzymatic Nucleic Acid
  misc_feature (31)..(31): n stands for inosine
guaacagacugaugaggccguuaggccgaanagaugcu

SEQ ID NO: 13783 - RNA, 38 nt, Artificial Sequence
  Description of Artificial Sequence:  Enzymatic Nucleic Acid
  misc_feature (31)..(31): n stands for inosine
gcuguaaccugaugaggccguuaggccgaanaugagau

SEQ ID NO: 13784 - RNA, 38 nt, Artificial Sequence
  Description of Artificial Sequence:  Enzymatic Nucleic Acid
  misc_feature (31)..(31): n stands for inosine
uuggaagccugaugaggccguuaggccgaanuaacaga

SEQ ID NO: 13785 - RNA, 38 nt, Artificial Sequence
  Description of Artificial Sequence:  Enzymatic Nucleic Acid
  misc_feature (31)..(31): n stands for inosine
cacuuggacugaugaggccguuaggccgaancuguaac

SEQ ID NO: 13786 - RNA, 38 nt, Artificial Sequence
  Description of Artificial Sequence:  Enzymatic Nucleic Acid
  misc_feature (31)..(31): n stands for inosine
agccacuucugaugaggccguuaggccgaanaagcugu

SEQ ID NO: 13787 - RNA, 38 nt, Artificial Sequence
  Description of Artificial Sequence:  Enzymatic Nucleic Acid
  misc_feature (31)..(31): n stands for inosine
uagccacucugaugaggccguuaggccgaangaagcug

SEQ ID NO: 13788 - RNA, 38 nt, Artificial Sequence
  Description of Artificial Sequence:  Enzymatic Nucleic Acid
  misc_feature (31)..(31): n stands for inosine
augcccuucugaugaggccguuaggccgaanccacuug

SEQ ID NO: 13789 - RNA, 38 nt, Artificial Sequence
  Description of Artificial Sequence:  Enzymatic Nucleic Acid
  misc_feature (31)..(31): n stands for inosine
gaacuccacugaugaggccguuaggccgaancccuuag

SEQ ID NO: 13790 - RNA, 38 nt, Artificial Sequence
  Description of Artificial Sequence:  Enzymatic Nucleic Acid
  misc_feature (31)..(31): n stands for inosine
cgaugccacugaugaggccguuaggccgaanaacucca

SEQ ID NO: 13791 - RNA, 38 nt, Artificial Sequence
  Description of Artificial Sequence:  Enzymatic Nucleic Acid
  misc_feature (31)..(31): n stands for inosine
uuucgcgacugaugaggccguuaggccgaanccaagaa

SEQ ID NO: 13792 - RNA, 38 nt, Artificial Sequence
  Description of Artificial Sequence:  Enzymatic Nucleic Acid
  misc_feature (31)..(31): n stands for inosine
gucccugucugaugaggccguuaggccgaanauacacu

SEQ ID NO: 13793 - RNA, 38 nt, Artificial Sequence
  Description of Artificial Sequence:  Enzymatic Nucleic Acid
  misc_feature (31)..(31): n stands for inosine
ggucccugcugaugaggccguuaggccgaangauacac

SEQ ID NO: 13794 - RNA, 38 nt, Artificial Sequence
  Description of Artificial Sequence:  Enzymatic Nucleic Acid
  misc_feature (31)..(31): n stands for inosine
cagguccccugaugaggccguuaggccgaanuggauac

SEQ ID NO: 13795 - RNA, 38 nt, Artificial Sequence
  Description of Artificial Sequence:  Enzymatic Nucleic Acid
  misc_feature (31)..(31): n stands for inosine
ugccgccacugaugaggccguuaggccgaanucccugu

SEQ ID NO: 13796 - RNA, 38 nt, Artificial Sequence
  Description of Artificial Sequence:  Enzymatic Nucleic Acid
  misc_feature (31)..(31): n stands for inosine
gugccgcccugaugaggccguuaggccgaangucccug

SEQ ID NO: 13797 - RNA, 38 nt, Artificial Sequence
  Description of Artificial Sequence:  Enzymatic Nucleic Acid
  misc_feature (31)..(31): n stands for inosine
auauuucgcugaugaggccguuaggccgaanccgccag

SEQ ID NO: 13798 - RNA, 38 nt, Artificial Sequence
  Description of Artificial Sequence:  Enzymatic Nucleic Acid
  misc_feature (31)..(31): n stands for inosine
cgauaagacugaugaggccguuaggccgaanauauuuc

SEQ ID NO: 13799 - RNA, 38 nt, Artificial Sequence
  Description of Artificial Sequence:  Enzymatic Nucleic Acid
  misc_feature (31)..(31): n stands for inosine
ccgauaagcugaugaggccguuaggccgaangauauuu

SEQ ID NO: 13800 - RNA, 38 nt, Artificial Sequence
  Description of Artificial Sequence:  Enzymatic Nucleic Acid
  misc_feature (31)..(31): n stands for inosine
cuccgauacugaugaggccguuaggccgaanaggauau

SEQ ID NO: 13801 - RNA, 38 nt, Artificial Sequence
  Description of Artificial Sequence:  Enzymatic Nucleic Acid
  misc_feature (31)..(31): n stands for inosine
aaagucaccugaugaggccguuaggccgaanauuuuaa

SEQ ID NO: 13802 - RNA, 38 nt, Artificial Sequence
  Description of Artificial Sequence:  Enzymatic Nucleic Acid
  misc_feature (31)..(31): n stands for inosine
caagccaacugaugaggccguuaggccgaanucacaga

SEQ ID NO: 13803 - RNA, 38 nt, Artificial Sequence
  Description of Artificial Sequence:  Enzymatic Nucleic Acid
  misc_feature (31)..(31): n stands for inosine
ccgggccacugaugaggccguuaggccgaanccaaagu

SEQ ID NO: 13804 - RNA, 38 nt, Artificial Sequence
  Description of Artificial Sequence:  Enzymatic Nucleic Acid
  misc_feature (31)..(31): n stands for inosine
auaucccgcugaugaggccguuaggccgaanccaagcc

SEQ ID NO: 13805 - RNA, 38 nt, Artificial Sequence
  Description of Artificial Sequence:  Enzymatic Nucleic Acid
  misc_feature (31)..(31): n stands for inosine
aauauccccugaugaggccguuaggccgaangccaagc

SEQ ID NO: 13806 - RNA, 38 nt, Artificial Sequence
  Description of Artificial Sequence:  Enzymatic Nucleic Acid
  misc_feature (31)..(31): n stands for inosine
cauaaucucugaugaggccguuaggccgaanaucuuua

SEQ ID NO: 13807 - RNA, 38 nt, Artificial Sequence
  Description of Artificial Sequence:  Enzymatic Nucleic Acid
  misc_feature (31)..(31): n stands for inosine
acauaauccugaugaggccguuaggccgaangaucuuu

SEQ ID NO: 13808 - RNA, 38 nt, Artificial Sequence
  Description of Artificial Sequence:  Enzymatic Nucleic Acid
  misc_feature (31)..(31): n stands for inosine
uccuuuuccugaugaggccguuaggccgaanacauaau

SEQ ID NO: 13809 - RNA, 38 nt, Artificial Sequence
  Description of Artificial Sequence:  Enzymatic Nucleic Acid
  misc_feature (31)..(31): n stands for inosine
gggaggcgcugaugaggccguuaggccgaancaucucc

SEQ ID NO: 13810 - RNA, 38 nt, Artificial Sequence
  Description of Artificial Sequence:  Enzymatic Nucleic Acid
  misc_feature (31)..(31): n stands for inosine
caaagggacugaugaggccguuaggccgaancgagcau

SEQ ID NO: 13811 - RNA, 38 nt, Artificial Sequence
  Description of Artificial Sequence:  Enzymatic Nucleic Acid
  misc_feature (31)..(31): n stands for inosine
ucaaagggcugaugaggccguuaggccgaangcgagca

SEQ ID NO: 13812 - RNA, 38 nt, Artificial Sequence
  Description of Artificial Sequence:  Enzymatic Nucleic Acid
  misc_feature (31)..(31): n stands for inosine
uuucaaagcugaugaggccguuaggccgaanaggcgag

SEQ ID NO: 13813 - RNA, 38 nt, Artificial Sequence
  Description of Artificial Sequence:  Enzymatic Nucleic Acid
  misc_feature (31)..(31): n stands for inosine
auuucaaacugaugaggccguuaggccgaangaggcga

SEQ ID NO: 13814 - RNA, 38 nt, Artificial Sequence
  Description of Artificial Sequence:  Enzymatic Nucleic Acid
  misc_feature (31)..(31): n stands for inosine
cauuucaacugaugaggccguuaggccgaanggaggcg

SEQ ID NO: 13815 - RNA, 38 nt, Artificial Sequence
  Description of Artificial Sequence:  Enzymatic Nucleic Acid
  misc_feature (31)..(31): n stands for inosine
guuucuggcugaugaggccguuaggccgaanccaucca

SEQ ID NO: 13816 - RNA, 38 nt, Artificial Sequence
  Description of Artificial Sequence:  Enzymatic Nucleic Acid
  misc_feature (31)..(31): n stands for inosine
uguuucugcugaugaggccguuaggccgaangccaucc

SEQ ID NO: 13817 - RNA, 38 nt, Artificial Sequence
  Description of Artificial Sequence:  Enzymatic Nucleic Acid
  misc_feature (31)..(31): n stands for inosine
uuguuucucugaugaggccguuaggccgaanggccauc

SEQ ID NO: 13818 - RNA, 38 nt, Artificial Sequence
  Description of Artificial Sequence:  Enzymatic Nucleic Acid
  misc_feature (31)..(31): n stands for inosine
auuguuuccugaugaggccguuaggccgaangggccau

SEQ ID NO: 13819 - RNA, 38 nt, Artificial Sequence
  Description of Artificial Sequence:  Enzymatic Nucleic Acid
  misc_feature (31)..(31): n stands for inosine
ucaaaaaucugaugaggccguuaggccgaanuuucugg

SEQ ID NO: 13820 - RNA, 38 nt, Artificial Sequence
  Description of Artificial Sequence:  Enzymatic Nucleic Acid
  misc_feature (31)..(31): n stands for inosine
guacacuccugaugaggccguuaggccgaanucaaaaa

SEQ ID NO: 13821 - RNA, 38 nt, Artificial Sequence
  Description of Artificial Sequence:  Enzymatic Nucleic Acid
  misc_feature (31)..(31): n stands for inosine
cuggauugcugaugaggccguuaggccgaanuacacuc

SEQ ID NO: 13822 - RNA, 38 nt, Artificial Sequence
  Description of Artificial Sequence:  Enzymatic Nucleic Acid
  misc_feature (31)..(31): n stands for inosine
cucuggaucugaugaggccguuaggccgaanuguacac

SEQ ID NO: 13823 - RNA, 38 nt, Artificial Sequence
  Description of Artificial Sequence:  Enzymatic Nucleic Acid
  misc_feature (31)..(31): n stands for inosine
gucacucucugaugaggccguuaggccgaanauugugu

SEQ ID NO: 13824 - RNA, 38 nt, Artificial Sequence
  Description of Artificial Sequence:  Enzymatic Nucleic Acid
  misc_feature (31)..(31): n stands for inosine
cgucacuccugaugaggccguuaggccgaangauugug

SEQ ID NO: 13825 - RNA, 38 nt, Artificial Sequence
  Description of Artificial Sequence:  Enzymatic Nucleic Acid
  misc_feature (31)..(31): n stands for inosine
aaaagacccugaugaggccguuaggccgaanacgucac

SEQ ID NO: 13826 - RNA, 38 nt, Artificial Sequence
  Description of Artificial Sequence:  Enzymatic Nucleic Acid
  misc_feature (31)..(31): n stands for inosine
acaccaaacugaugaggccguuaggccgaanaccagac

SEQ ID NO: 13827 - RNA, 38 nt, Artificial Sequence
  Description of Artificial Sequence:  Enzymatic Nucleic Acid
  misc_feature (31)..(31): n stands for inosine
uuucccaccugaugaggccguuaggccgaancaaaaca

SEQ ID NO: 13828 - RNA, 38 nt, Artificial Sequence
  Description of Artificial Sequence:  Enzymatic Nucleic Acid
  misc_feature (31)..(31): n stands for inosine
gcaccuaacugaugaggccguuaggccgaanaaaauau

SEQ ID NO: 13829 - RNA, 38 nt, Artificial Sequence
  Description of Artificial Sequence:  Enzymatic Nucleic Acid
  misc_feature (31)..(31): n stands for inosine
agcaccuacugaugaggccguuaggccgaangaaaaua

SEQ ID NO: 13830 - RNA, 38 nt, Artificial Sequence
  Description of Artificial Sequence:  Enzymatic Nucleic Acid
  misc_feature (31)..(31): n stands for inosine
uauggagacugaugaggccguuaggccgaancaccuaa

SEQ ID NO: 13831 - RNA, 38 nt, Artificial Sequence
  Description of Artificial Sequence:  Enzymatic Nucleic Acid
  misc_feature (31)..(31): n stands for inosine
ggauauggcugaugaggccguuaggccgaanaagcacc

SEQ ID NO: 13832 - RNA, 38 nt, Artificial Sequence
  Description of Artificial Sequence:  Enzymatic Nucleic Acid
  misc_feature (31)..(31): n stands for inosine
caggauaucugaugaggccguuaggccgaanagaagca

SEQ ID NO: 13833 - RNA, 38 nt, Artificial Sequence
  Description of Artificial Sequence:  Enzymatic Nucleic Acid
  misc_feature (31)..(31): n stands for inosine
ccaggauacugaugaggccguuaggccgaangagaagc

SEQ ID NO: 13834 - RNA, 38 nt, Artificial Sequence
  Description of Artificial Sequence:  Enzymatic Nucleic Acid
  misc_feature (31)..(31): n stands for inosine
uuaccccacugaugaggccguuaggccgaanauaugga

SEQ ID NO: 13835 - RNA, 38 nt, Artificial Sequence
  Description of Artificial Sequence:  Enzymatic Nucleic Acid
  misc_feature (31)..(31): n stands for inosine
uuuacccccugaugaggccguuaggccgaangauaugg

SEQ ID NO: 13836 - RNA, 38 nt, Artificial Sequence
  Description of Artificial Sequence:  Enzymatic Nucleic Acid
  misc_feature (31)..(31): n stands for inosine
cucauucucugaugaggccguuaggccgaanuuccuuc

SEQ ID NO: 13837 - RNA, 38 nt, Artificial Sequence
  Description of Artificial Sequence:  Enzymatic Nucleic Acid
  misc_feature (31)..(31): n stands for inosine
uaaucaggcugaugaggccguuaggccgaancccucau

SEQ ID NO: 13838 - RNA, 38 nt, Artificial Sequence
  Description of Artificial Sequence:  Enzymatic Nucleic Acid
  misc_feature (31)..(31): n stands for inosine
auaaucagcugaugaggccguuaggccgaangcccuca

SEQ ID NO: 13839 - RNA, 38 nt, Artificial Sequence
  Description of Artificial Sequence:  Enzymatic Nucleic Acid
  misc_feature (31)..(31): n stands for inosine
uauaaucacugaugaggccguuaggccgaanggcccuc

SEQ ID NO: 13840 - RNA, 38 nt, Artificial Sequence
  Description of Artificial Sequence:  Enzymatic Nucleic Acid
  misc_feature (31)..(31): n stands for inosine
guauaauccugaugaggccguuaggccgaangggcccu

SEQ ID NO: 13841 - RNA, 38 nt, Artificial Sequence
  Description of Artificial Sequence:  Enzymatic Nucleic Acid
  misc_feature (31)..(31): n stands for inosine
ucuggugucugaugaggccguuaggccgaanuauaauc

SEQ ID NO: 13842 - RNA, 38 nt, Artificial Sequence
  Description of Artificial Sequence:  Enzymatic Nucleic Acid
  misc_feature (31)..(31): n stands for inosine
auuucuggcugaugaggccguuaggccgaanuaguaua

SEQ ID NO: 13843 - RNA, 38 nt, Artificial Sequence
  Description of Artificial Sequence:  Enzymatic Nucleic Acid
  misc_feature (31)..(31): n stands for inosine
acauuucucugaugaggccguuaggccgaanuguagua

SEQ ID NO: 13844 - RNA, 38 nt, Artificial Sequence
  Description of Artificial Sequence:  Enzymatic Nucleic Acid
  misc_feature (31)..(31): n stands for inosine
uacauuuccugaugaggccguuaggccgaanguguagu

SEQ ID NO: 13845 - RNA, 38 nt, Artificial Sequence
  Description of Artificial Sequence:  Enzymatic Nucleic Acid
  misc_feature (31)..(31): n stands for inosine
cauggucucugaugaggccguuaggccgaanuacauuu

SEQ ID NO: 13846 - RNA, 38 nt, Artificial Sequence
  Description of Artificial Sequence:  Enzymatic Nucleic Acid
  misc_feature (31)..(31): n stands for inosine
gcaugguccugaugaggccguuaggccgaanguacauu

SEQ ID NO: 13847 - RNA, 38 nt, Artificial Sequence
  Description of Artificial Sequence:  Enzymatic Nucleic Acid
  misc_feature (31)..(31): n stands for inosine
uccagcaucugaugaggccguuaggccgaanucuggua

SEQ ID NO: 13848 - RNA, 38 nt, Artificial Sequence
  Description of Artificial Sequence:  Enzymatic Nucleic Acid
  misc_feature (31)..(31): n stands for inosine
guccagcacugaugaggccguuaggccgaangucuggu

SEQ ID NO: 13849 - RNA, 38 nt, Artificial Sequence
  Description of Artificial Sequence:  Enzymatic Nucleic Acid
  misc_feature (31)..(31): n stands for inosine
agcagucccugaugaggccguuaggccgaancaugguc

SEQ ID NO: 13850 - RNA, 38 nt, Artificial Sequence
  Description of Artificial Sequence:  Enzymatic Nucleic Acid
  misc_feature (31)..(31): n stands for inosine
cccgugcccugaugaggccguuaggccgaancagucca

SEQ ID NO: 13851 - RNA, 38 nt, Artificial Sequence
  Description of Artificial Sequence:  Enzymatic Nucleic Acid
  misc_feature (31)..(31): n stands for inosine
gcuccccgcugaugaggccguuaggccgaanccagcag

SEQ ID NO: 13852 - RNA, 38 nt, Artificial Sequence
  Description of Artificial Sequence:  Enzymatic Nucleic Acid
  misc_feature (31)..(31): n stands for inosine
ucugacugcugaugaggccguuaggccgaancuccccg

SEQ ID NO: 13853 - RNA, 38 nt, Artificial Sequence
  Description of Artificial Sequence:  Enzymatic Nucleic Acid
  misc_feature (31)..(31): n stands for inosine
cucugacucugaugaggccguuaggccgaangcucccc

SEQ ID NO: 13854 - RNA, 38 nt, Artificial Sequence
  Description of Artificial Sequence:  Enzymatic Nucleic Acid
  misc_feature (31)..(31): n stands for inosine
ucucugaccugaugaggccguuaggccgaanggcuccc

SEQ ID NO: 13855 - RNA, 38 nt, Artificial Sequence
  Description of Artificial Sequence:  Enzymatic Nucleic Acid
  misc_feature (31)..(31): n stands for inosine
ugggucuccugaugaggccguuaggccgaanacugggc

SEQ ID NO: 13856 - RNA, 38 nt, Artificial Sequence
  Description of Artificial Sequence:  Enzymatic Nucleic Acid
  misc_feature (31)..(31): n stands for inosine
aaaacgugcugaugaggccguuaggccgaanucucuga

SEQ ID NO: 13857 - RNA, 38 nt, Artificial Sequence
  Description of Artificial Sequence:  Enzymatic Nucleic Acid
  misc_feature (31)..(31): n stands for inosine
gaaaacgucugaugaggccguuaggccgaangucucug

SEQ ID NO: 13858 - RNA, 38 nt, Artificial Sequence
  Description of Artificial Sequence:  Enzymatic Nucleic Acid
  misc_feature (31)..(31): n stands for inosine
ugaaaacgcugaugaggccguuaggccgaanggucucu

SEQ ID NO: 13859 - RNA, 38 nt, Artificial Sequence
  Description of Artificial Sequence:  Enzymatic Nucleic Acid
  misc_feature (31)..(31): n stands for inosine
accaacuccugaugaggccguuaggccgaanaaaacgu

SEQ ID NO: 13860 - RNA, 38 nt, Artificial Sequence
  Description of Artificial Sequence:  Enzymatic Nucleic Acid
  misc_feature (31)..(31): n stands for inosine
uucccaaacugaugaggccguuaggccgaanuuccacc

SEQ ID NO: 13861 - RNA, 38 nt, Artificial Sequence
  Description of Artificial Sequence:  Enzymatic Nucleic Acid
  misc_feature (31)..(31): n stands for inosine
cuugcaagcugaugaggccguuaggccgaanauuuccc

SEQ ID NO: 13862 - RNA, 38 nt, Artificial Sequence
  Description of Artificial Sequence:  Enzymatic Nucleic Acid
  misc_feature (31)..(31): n stands for inosine
agcuugcacugaugaggccguuaggccgaanagauuuc

SEQ ID NO: 13863 - RNA, 38 nt, Artificial Sequence
  Description of Artificial Sequence:  Enzymatic Nucleic Acid
  misc_feature (31)..(31): n stands for inosine
cauuagcucugaugaggccguuaggccgaancaagaga

SEQ ID NO: 13864 - RNA, 38 nt, Artificial Sequence
  Description of Artificial Sequence:  Enzymatic Nucleic Acid
  misc_feature (31)..(31): n stands for inosine
ugagcauucugaugaggccguuaggccgaancuugcaa

SEQ ID NO: 13865 - RNA, 38 nt, Artificial Sequence
  Description of Artificial Sequence:  Enzymatic Nucleic Acid
  misc_feature (31)..(31): n stands for inosine
uccugcugcugaugaggccguuaggccgaancauuagc

SEQ ID NO: 13866 - RNA, 38 nt, Artificial Sequence
  Description of Artificial Sequence:  Enzymatic Nucleic Acid
  misc_feature (31)..(31): n stands for inosine
cauccugccugaugaggccguuaggccgaanagcauua

SEQ ID NO: 13867 - RNA, 38 nt, Artificial Sequence
  Description of Artificial Sequence:  Enzymatic Nucleic Acid
  misc_feature (31)..(31): n stands for inosine
ugccaucccugaugaggccguuaggccgaancugagca

SEQ ID NO: 13868 - RNA, 38 nt, Artificial Sequence
  Description of Artificial Sequence:  Enzymatic Nucleic Acid
  misc_feature (31)..(31): n stands for inosine
guagucuucugaugaggccguuaggccgaanccauccu

SEQ ID NO: 13869 - RNA, 38 nt, Artificial Sequence
  Description of Artificial Sequence:  Enzymatic Nucleic Acid
  misc_feature (31)..(31): n stands for inosine
aacaaugucugaugaggccguuaggccgaanucuuugc

SEQ ID NO: 13870 - RNA, 38 nt, Artificial Sequence
  Description of Artificial Sequence:  Enzymatic Nucleic Acid
  misc_feature (31)..(31): n stands for inosine
aagaacaacugaugaggccguuaggccgaanuagucuu

SEQ ID NO: 13871 - RNA, 38 nt, Artificial Sequence
  Description of Artificial Sequence:  Enzymatic Nucleic Acid
  misc_feature (31)..(31): n stands for inosine
auaucggacugaugaggccguuaggccgaanaacaaug

SEQ ID NO: 13872 - RNA, 38 nt, Artificial Sequence
  Description of Artificial Sequence:  Enzymatic Nucleic Acid
  misc_feature (31)..(31): n stands for inosine
cugauauccugaugaggccguuaggccgaanaagaaca

SEQ ID NO: 13873 - RNA, 38 nt, Artificial Sequence
  Description of Artificial Sequence:  Enzymatic Nucleic Acid
  misc_feature (31)..(31): n stands for inosine
aaagucuccugaugaggccguuaggccgaanauaucgg

SEQ ID NO: 13874 - RNA, 38 nt, Artificial Sequence
  Description of Artificial Sequence:  Enzymatic Nucleic Acid
  misc_feature (31)..(31): n stands for inosine
augcucaacugaugaggccguuaggccgaanucucuga

SEQ ID NO: 13875 - RNA, 38 nt, Artificial Sequence
  Description of Artificial Sequence:  Enzymatic Nucleic Acid
  misc_feature (31)..(31): n stands for inosine
cucuuccacugaugaggccguuaggccgaancucaaag

SEQ ID NO: 13876 - RNA, 38 nt, Artificial Sequence
  Description of Artificial Sequence:  Enzymatic Nucleic Acid
  misc_feature (31)..(31): n stands for inosine
gagagucccugaugaggccguuaggccgaanaauccuc

SEQ ID NO: 13877 - RNA, 38 nt, Artificial Sequence
  Description of Artificial Sequence:  Enzymatic Nucleic Acid
  misc_feature (31)..(31): n stands for inosine
gcagagagcugaugaggccguuaggccgaanuccagaa

SEQ ID NO: 13878 - RNA, 38 nt, Artificial Sequence
  Description of Artificial Sequence:  Enzymatic Nucleic Acid
  misc_feature (31)..(31): n stands for inosine
aggcagagcugaugaggccguuaggccgaanaguccag

SEQ ID NO: 13879 - RNA, 38 nt, Artificial Sequence
  Description of Artificial Sequence:  Enzymatic Nucleic Acid
  misc_feature (31)..(31): n stands for inosine
guaggcagcugaugaggccguuaggccgaanagagucc

SEQ ID NO: 13880 - RNA, 38 nt, Artificial Sequence
  Description of Artificial Sequence:  Enzymatic Nucleic Acid
  misc_feature (31)..(31): n stands for inosine
agguaggccugaugaggccguuaggccgaanagagagu

SEQ ID NO: 13881 - RNA, 38 nt, Artificial Sequence
  Description of Artificial Sequence:  Enzymatic Nucleic Acid
  misc_feature (31)..(31): n stands for inosine
gugagguacugaugaggccguuaggccgaancagagag

SEQ ID NO: 13882 - RNA, 38 nt, Artificial Sequence
  Description of Artificial Sequence:  Enzymatic Nucleic Acid
  misc_feature (31)..(31): n stands for inosine
ggugaggucugaugaggccguuaggccgaangcagaga

SEQ ID NO: 13883 - RNA, 38 nt, Artificial Sequence
  Description of Artificial Sequence:  Enzymatic Nucleic Acid
  misc_feature (31)..(31): n stands for inosine
acaggugacugaugaggccguuaggccgaanuaggcag

SEQ ID NO: 13884 - RNA, 38 nt, Artificial Sequence
  Description of Artificial Sequence:  Enzymatic Nucleic Acid
  misc_feature (31)..(31): n stands for inosine
aacaggugcugaugaggccguuaggccgaanguaggca

SEQ ID NO: 13885 - RNA, 38 nt, Artificial Sequence
  Description of Artificial Sequence:  Enzymatic Nucleic Acid
  misc_feature (31)..(31): n stands for inosine
gaaacaggcugaugaggccguuaggccgaanagguagg

SEQ ID NO: 13886 - RNA, 38 nt, Artificial Sequence
  Description of Artificial Sequence:  Enzymatic Nucleic Acid
  misc_feature (31)..(31): n stands for inosine
aggaaacacugaugaggccguuaggccgaanugaggua

SEQ ID NO: 13887 - RNA, 38 nt, Artificial Sequence
  Description of Artificial Sequence:  Enzymatic Nucleic Acid
  misc_feature (31)..(31): n stands for inosine
caggaaaccugaugaggccguuaggccgaangugaggu

SEQ ID NO: 13888 - RNA, 38 nt, Artificial Sequence
  Description of Artificial Sequence:  Enzymatic Nucleic Acid
  misc_feature (31)..(31): n stands for inosine
uccauacacugaugaggccguuaggccgaanaaacagg

SEQ ID NO: 13889 - RNA, 38 nt, Artificial Sequence
  Description of Artificial Sequence:  Enzymatic Nucleic Acid
  misc_feature (31)..(31): n stands for inosine
cuccauaccugaugaggccguuaggccgaangaaacag

SEQ ID NO: 13890 - RNA, 38 nt, Artificial Sequence
  Description of Artificial Sequence:  Enzymatic Nucleic Acid
  misc_feature (31)..(31): n stands for inosine
gaauuuggcugaugaggccguuaggccgaanucacaua

SEQ ID NO: 13891 - RNA, 38 nt, Artificial Sequence
  Description of Artificial Sequence:  Enzymatic Nucleic Acid
  misc_feature (31)..(31): n stands for inosine
ggaauuugcugaugaggccguuaggccgaangucacau

SEQ ID NO: 13892 - RNA, 38 nt, Artificial Sequence
  Description of Artificial Sequence:  Enzymatic Nucleic Acid
  misc_feature (31)..(31): n stands for inosine
uggaauuucugaugaggccguuaggccgaanggucaca

SEQ ID NO: 13893 - RNA, 38 nt, Artificial Sequence
  Description of Artificial Sequence:  Enzymatic Nucleic Acid
  misc_feature (31)..(31): n stands for inosine
auggaauucugaugaggccguuaggccgaangggucac

SEQ ID NO: 13894 - RNA, 38 nt, Artificial Sequence
  Description of Artificial Sequence:  Enzymatic Nucleic Acid
  misc_feature (31)..(31): n stands for inosine
gucauaaucugaugaggccguuaggccgaanaauuugg

SEQ ID NO: 13895 - RNA, 38 nt, Artificial Sequence
  Description of Artificial Sequence:  Enzymatic Nucleic Acid
  misc_feature (31)..(31): n stands for inosine
ugucauaacugaugaggccguuaggccgaangaauuug

SEQ ID NO: 13896 - RNA, 38 nt, Artificial Sequence
  Description of Artificial Sequence:  Enzymatic Nucleic Acid
  misc_feature (31)..(31): n stands for inosine
ugcugugucugaugaggccguuaggccgaanucauaau

SEQ ID NO: 13897 - RNA, 38 nt, Artificial Sequence
  Description of Artificial Sequence:  Enzymatic Nucleic Acid
  misc_feature (31)..(31): n stands for inosine
uccugcugcugaugaggccguuaggccgaanuugucau

SEQ ID NO: 13898 - RNA, 38 nt, Artificial Sequence
  Description of Artificial Sequence:  Enzymatic Nucleic Acid
  misc_feature (31)..(31): n stands for inosine
auuccugccugaugaggccguuaggccgaanuguuguc

SEQ ID NO: 13899 - RNA, 38 nt, Artificial Sequence
  Description of Artificial Sequence:  Enzymatic Nucleic Acid
  misc_feature (31)..(31): n stands for inosine
cugauucccugaugaggccguuaggccgaancuguguu

SEQ ID NO: 13900 - RNA, 38 nt, Artificial Sequence
  Description of Artificial Sequence:  Enzymatic Nucleic Acid
  misc_feature (31)..(31): n stands for inosine
auacugaccugaugaggccguuaggccgaanauuccug

SEQ ID NO: 13901 - RNA, 38 nt, Artificial Sequence
  Description of Artificial Sequence:  Enzymatic Nucleic Acid
  misc_feature (31)..(31): n stands for inosine
gcagauaccugaugaggccguuaggccgaanacugauu

SEQ ID NO: 13902 - RNA, 38 nt, Artificial Sequence
  Description of Artificial Sequence:  Enzymatic Nucleic Acid
  misc_feature (31)..(31): n stands for inosine
uguucugccugaugaggccguuaggccgaanauacuga

SEQ ID NO: 13903 - RNA, 38 nt, Artificial Sequence
  Description of Artificial Sequence:  Enzymatic Nucleic Acid
  misc_feature (31)..(31): n stands for inosine
uacuguuccugaugaggccguuaggccgaancagauac

SEQ ID NO: 13904 - RNA, 38 nt, Artificial Sequence
  Description of Artificial Sequence:  Enzymatic Nucleic Acid
  misc_feature (31)..(31): n stands for inosine
ucgcuuaccugaugaggccguuaggccgaanuucugca

SEQ ID NO: 13905 - RNA, 38 nt, Artificial Sequence
  Description of Artificial Sequence:  Enzymatic Nucleic Acid
  misc_feature (31)..(31): n stands for inosine
cacaggcccugaugaggccguuaggccgaancucuuuc

SEQ ID NO: 13906 - RNA, 38 nt, Artificial Sequence
  Description of Artificial Sequence:  Enzymatic Nucleic Acid
  misc_feature (31)..(31): n stands for inosine
cacucacacugaugaggccguuaggccgaanccggcuc

SEQ ID NO: 13907 - RNA, 38 nt, Artificial Sequence
  Description of Artificial Sequence:  Enzymatic Nucleic Acid
  misc_feature (31)..(31): n stands for inosine
acacucaccugaugaggccguuaggccgaangccggcu

SEQ ID NO: 13908 - RNA, 38 nt, Artificial Sequence
  Description of Artificial Sequence:  Enzymatic Nucleic Acid
  misc_feature (31)..(31): n stands for inosine
ucuucaaacugaugaggccguuaggccgaanuuuuuac

SEQ ID NO: 13909 - RNA, 38 nt, Artificial Sequence
  Description of Artificial Sequence:  Enzymatic Nucleic Acid
  misc_feature (31)..(31): n stands for inosine
uucuaacgcugaugaggccguuaggccgaanauaucuu

SEQ ID NO: 13910 - RNA, 38 nt, Artificial Sequence
  Description of Artificial Sequence:  Enzymatic Nucleic Acid
  misc_feature (31)..(31): n stands for inosine
cuucuaaccugaugaggccguuaggccgaangauaucu

SEQ ID NO: 13911 - RNA, 38 nt, Artificial Sequence
  Description of Artificial Sequence:  Enzymatic Nucleic Acid
  misc_feature (31)..(31): n stands for inosine
uuacuucucugaugaggccguuaggccgaanuucuucu

SEQ ID NO: 13912 - RNA, 38 nt, Artificial Sequence
  Description of Artificial Sequence:  Enzymatic Nucleic Acid
  misc_feature (31)..(31): n stands for inosine
uuuacuuccugaugaggccguuaggccgaanguucuuc

SEQ ID NO: 13913 - RNA, 38 nt, Artificial Sequence
  Description of Artificial Sequence:  Enzymatic Nucleic Acid
  misc_feature (31)..(31): n stands for inosine
gucaucugcugaugaggccguuaggccgaanauuacuu

SEQ ID NO: 13914 - RNA, 38 nt, Artificial Sequence
  Description of Artificial Sequence:  Enzymatic Nucleic Acid
  misc_feature (31)..(31): n stands for inosine
ugucaucucugaugaggccguuaggccgaangauuacu

SEQ ID NO: 13915 - RNA, 38 nt, Artificial Sequence
  Description of Artificial Sequence:  Enzymatic Nucleic Acid
  misc_feature (31)..(31): n stands for inosine
uugucauccugaugaggccguuaggccgaanggauuac

SEQ ID NO: 13916 - RNA, 38 nt, Artificial Sequence
  Description of Artificial Sequence:  Enzymatic Nucleic Acid
  misc_feature (31)..(31): n stands for inosine
cgucuggucugaugaggccguuaggccgaanucaucug

SEQ ID NO: 13917 - RNA, 38 nt, Artificial Sequence
  Description of Artificial Sequence:  Enzymatic Nucleic Acid
  misc_feature (31)..(31): n stands for inosine
guccgucucugaugaggccguuaggccgaanuugucau

SEQ ID NO: 13918 - RNA, 38 nt, Artificial Sequence
  Description of Artificial Sequence:  Enzymatic Nucleic Acid
  misc_feature (31)..(31): n stands for inosine
uguccguccugaugaggccguuaggccgaanguuguca

SEQ ID NO: 13919 - RNA, 38 nt, Artificial Sequence
  Description of Artificial Sequence:  Enzymatic Nucleic Acid
  misc_feature (31)..(31): n stands for inosine
cauaccaccugaugaggccguuaggccgaanuccgucu

SEQ ID NO: 13920 - RNA, 38 nt, Artificial Sequence
  Description of Artificial Sequence:  Enzymatic Nucleic Acid
  misc_feature (31)..(31): n stands for inosine
cugaggcacugaugaggccguuaggccgaanaaccaua

SEQ ID NO: 13921 - RNA, 38 nt, Artificial Sequence
  Description of Artificial Sequence:  Enzymatic Nucleic Acid
  misc_feature (31)..(31): n stands for inosine
ucuucugacugaugaggccguuaggccgaancaagaac

SEQ ID NO: 13922 - RNA, 38 nt, Artificial Sequence
  Description of Artificial Sequence:  Enzymatic Nucleic Acid
  misc_feature (31)..(31): n stands for inosine
cucuucugcugaugaggccguuaggccgaangcaagaa

SEQ ID NO: 13923 - RNA, 38 nt, Artificial Sequence
  Description of Artificial Sequence:  Enzymatic Nucleic Acid
  misc_feature (31)..(31): n stands for inosine
agcucuuccugaugaggccguuaggccgaanaggcaag

SEQ ID NO: 13924 - RNA, 38 nt, Artificial Sequence
  Description of Artificial Sequence:  Enzymatic Nucleic Acid
  misc_feature (31)..(31): n stands for inosine
aaguuuuccugaugaggccguuaggccgaancucuucu

SEQ ID NO: 13925 - RNA, 38 nt, Artificial Sequence
  Description of Artificial Sequence:  Enzymatic Nucleic Acid
  misc_feature (31)..(31): n stands for inosine
ucuuccaacugaugaggccguuaggccgaanuuuucag

SEQ ID NO: 13926 - RNA, 38 nt, Artificial Sequence
  Description of Artificial Sequence:  Enzymatic Nucleic Acid
  misc_feature (31)..(31): n stands for inosine
uuugguuccugaugaggccguuaggccgaanucuucca

SEQ ID NO: 13927 - RNA, 38 nt, Artificial Sequence
  Description of Artificial Sequence:  Enzymatic Nucleic Acid
  misc_feature (31)..(31): n stands for inosine
gauaauuucugaugaggccguuaggccgaanuucuguc

SEQ ID NO: 13928 - RNA, 38 nt, Artificial Sequence
  Description of Artificial Sequence:  Enzymatic Nucleic Acid
  misc_feature (31)..(31): n stands for inosine
agauaauucugaugaggccguuaggccgaanguucugu

SEQ ID NO: 13929 - RNA, 38 nt, Artificial Sequence
  Description of Artificial Sequence:  Enzymatic Nucleic Acid
  misc_feature (31)..(31): n stands for inosine
aaagauggcugaugaggccguuaggccgaanauaauuu

SEQ ID NO: 13930 - RNA, 38 nt, Artificial Sequence
  Description of Artificial Sequence:  Enzymatic Nucleic Acid
  misc_feature (31)..(31): n stands for inosine
caaaagaucugaugaggccguuaggccgaanagauaau

SEQ ID NO: 13931 - RNA, 38 nt, Artificial Sequence
  Description of Artificial Sequence:  Enzymatic Nucleic Acid
  misc_feature (31)..(31): n stands for inosine
ccaaaagacugaugaggccguuaggccgaangagauaa

SEQ ID NO: 13932 - RNA, 38 nt, Artificial Sequence
  Description of Artificial Sequence:  Enzymatic Nucleic Acid
  misc_feature (31)..(31): n stands for inosine
ccaccaaacugaugaggccguuaggccgaanauggaga

SEQ ID NO: 13933 - RNA, 38 nt, Artificial Sequence
  Description of Artificial Sequence:  Enzymatic Nucleic Acid
  misc_feature (31)..(31): n stands for inosine
uuuugcugcugaugaggccguuaggccgaancaccauu

SEQ ID NO: 13934 - RNA, 38 nt, Artificial Sequence
  Description of Artificial Sequence:  Enzymatic Nucleic Acid
  misc_feature (31)..(31): n stands for inosine
cuuuugcucugaugaggccguuaggccgaangcaccau

SEQ ID NO: 13935 - RNA, 38 nt, Artificial Sequence
  Description of Artificial Sequence:  Enzymatic Nucleic Acid
  misc_feature (31)..(31): n stands for inosine
gcuuuugccugaugaggccguuaggccgaanggcacca

SEQ ID NO: 13936 - RNA, 38 nt, Artificial Sequence
  Description of Artificial Sequence:  Enzymatic Nucleic Acid
  misc_feature (31)..(31): n stands for inosine
ccugcuuucugaugaggccguuaggccgaancugggca

SEQ ID NO: 13937 - RNA, 38 nt, Artificial Sequence
  Description of Artificial Sequence:  Enzymatic Nucleic Acid
  misc_feature (31)..(31): n stands for inosine
agacuccccugaugaggccguuaggccgaancuuuugc

SEQ ID NO: 13938 - RNA, 38 nt, Artificial Sequence
  Description of Artificial Sequence:  Enzymatic Nucleic Acid
  misc_feature (31)..(31): n stands for inosine
gaugccaccugaugaggccguuaggccgaanacucccu

SEQ ID NO: 13939 - RNA, 38 nt, Artificial Sequence
  Description of Artificial Sequence:  Enzymatic Nucleic Acid
  misc_feature (31)..(31): n stands for inosine
ccuucagacugaugaggccguuaggccgaanccacaga

SEQ ID NO: 13940 - RNA, 38 nt, Artificial Sequence
  Description of Artificial Sequence:  Enzymatic Nucleic Acid
  misc_feature (31)..(31): n stands for inosine
gagccuuccugaugaggccguuaggccgaanaugccac

SEQ ID NO: 13941 - RNA, 38 nt, Artificial Sequence
  Description of Artificial Sequence:  Enzymatic Nucleic Acid
  misc_feature (31)..(31): n stands for inosine
cugguuugcugaugaggccguuaggccgaanccuucag

SEQ ID NO: 13942 - RNA, 38 nt, Artificial Sequence
  Description of Artificial Sequence:  Enzymatic Nucleic Acid
  misc_feature (31)..(31): n stands for inosine
gucugguucugaugaggccguuaggccgaanagccuuc

SEQ ID NO: 13943 - RNA, 38 nt, Artificial Sequence
  Description of Artificial Sequence:  Enzymatic Nucleic Acid
  misc_feature (31)..(31): n stands for inosine
gcuugucucugaugaggccguuaggccgaanuuugagc

SEQ ID NO: 13944 - RNA, 38 nt, Artificial Sequence
  Description of Artificial Sequence:  Enzymatic Nucleic Acid
  misc_feature (31)..(31): n stands for inosine
cgcuuguccugaugaggccguuaggccgaanguuugag

SEQ ID NO: 13945 - RNA, 38 nt, Artificial Sequence
  Description of Artificial Sequence:  Enzymatic Nucleic Acid
  misc_feature (31)..(31): n stands for inosine
uagccgcucugaugaggccguuaggccgaanucugguu

SEQ ID NO: 13946 - RNA, 38 nt, Artificial Sequence
  Description of Artificial Sequence:  Enzymatic Nucleic Acid
  misc_feature (31)..(31): n stands for inosine
ggacuggucugaugaggccguuaggccgaanccgcuug

SEQ ID NO: 13947 - RNA, 38 nt, Artificial Sequence
  Description of Artificial Sequence:  Enzymatic Nucleic Acid
  misc_feature (31)..(31): n stands for inosine
uccggacucugaugaggccguuaggccgaanuagccgc

SEQ ID NO: 13948 - RNA, 38 nt, Artificial Sequence
  Description of Artificial Sequence:  Enzymatic Nucleic Acid
  misc_feature (31)..(31): n stands for inosine
auccggaccugaugaggccguuaggccgaanguagccg

SEQ ID NO: 13949 - RNA, 38 nt, Artificial Sequence
  Description of Artificial Sequence:  Enzymatic Nucleic Acid
  misc_feature (31)..(31): n stands for inosine
ugauaucccugaugaggccguuaggccgaanacuggua

SEQ ID NO: 13950 - RNA, 38 nt, Artificial Sequence
  Description of Artificial Sequence:  Enzymatic Nucleic Acid
  misc_feature (31)..(31): n stands for inosine
caucggagcugaugaggccguuaggccgaanauauccg

SEQ ID NO: 13951 - RNA, 38 nt, Artificial Sequence
  Description of Artificial Sequence:  Enzymatic Nucleic Acid
  misc_feature (31)..(31): n stands for inosine
gucaucggcugaugaggccguuaggccgaanugauauc

SEQ ID NO: 13952 - RNA, 38 nt, Artificial Sequence
  Description of Artificial Sequence:  Enzymatic Nucleic Acid
  misc_feature (31)..(31): n stands for inosine
gugucauccugaugaggccguuaggccgaanagugaua

SEQ ID NO: 13953 - RNA, 38 nt, Artificial Sequence
  Description of Artificial Sequence:  Enzymatic Nucleic Acid
  misc_feature (31)..(31): n stands for inosine
ggugucugcugaugaggccguuaggccgaanucaucgg

SEQ ID NO: 13954 - RNA, 38 nt, Artificial Sequence
  Description of Artificial Sequence:  Enzymatic Nucleic Acid
  misc_feature (31)..(31): n stands for inosine
gugguguccugaugaggccguuaggccgaanugucauc

SEQ ID NO: 13955 - RNA, 38 nt, Artificial Sequence
  Description of Artificial Sequence:  Enzymatic Nucleic Acid
  misc_feature (31)..(31): n stands for inosine
cacgguggcugaugaggccguuaggccgaanucugugu

SEQ ID NO: 13956 - RNA, 38 nt, Artificial Sequence
  Description of Artificial Sequence:  Enzymatic Nucleic Acid
  misc_feature (31)..(31): n stands for inosine
uacacggucugaugaggccguuaggccgaanugucugu

SEQ ID NO: 13957 - RNA, 38 nt, Artificial Sequence
  Description of Artificial Sequence:  Enzymatic Nucleic Acid
  misc_feature (31)..(31): n stands for inosine
guacacggcugaugaggccguuaggccgaangugucug

SEQ ID NO: 13958 - RNA, 38 nt, Artificial Sequence
  Description of Artificial Sequence:  Enzymatic Nucleic Acid
  misc_feature (31)..(31): n stands for inosine
gaguacaccugaugaggccguuaggccgaanugguguc

SEQ ID NO: 13959 - RNA, 38 nt, Artificial Sequence
  Description of Artificial Sequence:  Enzymatic Nucleic Acid
  misc_feature (31)..(31): n stands for inosine
cucacuggcugaugaggccguuaggccgaanuacacgg

SEQ ID NO: 13960 - RNA, 38 nt, Artificial Sequence
  Description of Artificial Sequence:  Enzymatic Nucleic Acid
  misc_feature (31)..(31): n stands for inosine
uccucacucugaugaggccguuaggccgaanaguacac

SEQ ID NO: 13961 - RNA, 38 nt, Artificial Sequence
  Description of Artificial Sequence:  Enzymatic Nucleic Acid
  misc_feature (31)..(31): n stands for inosine
uuccucaccugaugaggccguuaggccgaangaguaca

SEQ ID NO: 13962 - RNA, 38 nt, Artificial Sequence
  Description of Artificial Sequence:  Enzymatic Nucleic Acid
  misc_feature (31)..(31): n stands for inosine
aaaaguuccugaugaggccguuaggccgaancuuccuc

SEQ ID NO: 13963 - RNA, 38 nt, Artificial Sequence
  Description of Artificial Sequence:  Enzymatic Nucleic Acid
  misc_feature (31)..(31): n stands for inosine
gcuuuaaacugaugaggccguuaggccgaanuucugcu

SEQ ID NO: 13964 - RNA, 38 nt, Artificial Sequence
  Description of Artificial Sequence:  Enzymatic Nucleic Acid
  misc_feature (31)..(31): n stands for inosine
ucucuauccugaugaggccguuaggccgaancuuuaaa

SEQ ID NO: 13965 - RNA, 38 nt, Artificial Sequence
  Description of Artificial Sequence:  Enzymatic Nucleic Acid
  misc_feature (31)..(31): n stands for inosine
uaccgguucugaugaggccguuaggccgaancacucca

SEQ ID NO: 13966 - RNA, 38 nt, Artificial Sequence
  Description of Artificial Sequence:  Enzymatic Nucleic Acid
  misc_feature (31)..(31): n stands for inosine
gugcuacccugaugaggccguuaggccgaanuuugcac

SEQ ID NO: 13967 - RNA, 38 nt, Artificial Sequence
  Description of Artificial Sequence:  Enzymatic Nucleic Acid
  misc_feature (31)..(31): n stands for inosine
cugggcugcugaugaggccguuaggccgaancuaccgg

SEQ ID NO: 13968 - RNA, 38 nt, Artificial Sequence
  Description of Artificial Sequence:  Enzymatic Nucleic Acid
  misc_feature (31)..(31): n stands for inosine
aucugggccugaugaggccguuaggccgaanugcuacc

SEQ ID NO: 13969 - RNA, 38 nt, Artificial Sequence
  Description of Artificial Sequence:  Enzymatic Nucleic Acid
  misc_feature (31)..(31): n stands for inosine
agaaucugcugaugaggccguuaggccgaancugugcu

SEQ ID NO: 13970 - RNA, 38 nt, Artificial Sequence
  Description of Artificial Sequence:  Enzymatic Nucleic Acid
  misc_feature (31)..(31): n stands for inosine
gagaaucucugaugaggccguuaggccgaangcugugc

SEQ ID NO: 13971 - RNA, 38 nt, Artificial Sequence
  Description of Artificial Sequence:  Enzymatic Nucleic Acid
  misc_feature (31)..(31): n stands for inosine
ggagaauccugaugaggccguuaggccgaanggcugug

SEQ ID NO: 13972 - RNA, 38 nt, Artificial Sequence
  Description of Artificial Sequence:  Enzymatic Nucleic Acid
  misc_feature (31)..(31): n stands for inosine
caggcuggcugaugaggccguuaggccgaanaaucugg

SEQ ID NO: 13973 - RNA, 38 nt, Artificial Sequence
  Description of Artificial Sequence:  Enzymatic Nucleic Acid
  misc_feature (31)..(31): n stands for inosine
gucaggcucugaugaggccguuaggccgaanagaaucu

SEQ ID NO: 13974 - RNA, 38 nt, Artificial Sequence
  Description of Artificial Sequence:  Enzymatic Nucleic Acid
  misc_feature (31)..(31): n stands for inosine
ugucaggccugaugaggccguuaggccgaangagaauc

SEQ ID NO: 13975 - RNA, 38 nt, Artificial Sequence
  Description of Artificial Sequence:  Enzymatic Nucleic Acid
  misc_feature (31)..(31): n stands for inosine
ccgugucacugaugaggccguuaggccgaancuggaga

SEQ ID NO: 13976 - RNA, 38 nt, Artificial Sequence
  Description of Artificial Sequence:  Enzymatic Nucleic Acid
  misc_feature (31)..(31): n stands for inosine
cccguguccugaugaggccguuaggccgaangcuggag

SEQ ID NO: 13977 - RNA, 38 nt, Artificial Sequence
  Description of Artificial Sequence:  Enzymatic Nucleic Acid
  misc_feature (31)..(31): n stands for inosine
gguccccgcugaugaggccguuaggccgaanucaggcu

SEQ ID NO: 13978 - RNA, 38 nt, Artificial Sequence
  Description of Artificial Sequence:  Enzymatic Nucleic Acid
  misc_feature (31)..(31): n stands for inosine
cucagugucugaugaggccguuaggccgaanuccccgu

SEQ ID NO: 13979 - RNA, 38 nt, Artificial Sequence
  Description of Artificial Sequence:  Enzymatic Nucleic Acid
  misc_feature (31)..(31): n stands for inosine
gcucagugcugaugaggccguuaggccgaanguccccg

SEQ ID NO: 13980 - RNA, 38 nt, Artificial Sequence
  Description of Artificial Sequence:  Enzymatic Nucleic Acid
  misc_feature (31)..(31): n stands for inosine
gagcucagcugaugaggccguuaggccgaanugguccc

SEQ ID NO: 13981 - RNA, 38 nt, Artificial Sequence
  Description of Artificial Sequence:  Enzymatic Nucleic Acid
  misc_feature (31)..(31): n stands for inosine
gagagcuccugaugaggccguuaggccgaanugugguc

SEQ ID NO: 13982 - RNA, 38 nt, Artificial Sequence
  Description of Artificial Sequence:  Enzymatic Nucleic Acid
  misc_feature (31)..(31): n stands for inosine
aggaggagcugaugaggccguuaggccgaancucagug

SEQ ID NO: 13983 - RNA, 38 nt, Artificial Sequence
  Description of Artificial Sequence:  Enzymatic Nucleic Acid
  misc_feature (31)..(31): n stands for inosine
acaggaggcugaugaggccguuaggccgaanagcucag

SEQ ID NO: 13984 - RNA, 38 nt, Artificial Sequence
  Description of Artificial Sequence:  Enzymatic Nucleic Acid
  misc_feature (31)..(31): n stands for inosine
aaacaggacugaugaggccguuaggccgaanagagcuc

SEQ ID NO: 13985 - RNA, 38 nt, Artificial Sequence
  Description of Artificial Sequence:  Enzymatic Nucleic Acid
  misc_feature (31)..(31): n stands for inosine
uaaacaggcugaugaggccguuaggccgaangagagcu

SEQ ID NO: 13986 - RNA, 38 nt, Artificial Sequence
  Description of Artificial Sequence:  Enzymatic Nucleic Acid
  misc_feature (31)..(31): n stands for inosine
uuuaaacacugaugaggccguuaggccgaanaggagag

SEQ ID NO: 13987 - RNA, 38 nt, Artificial Sequence
  Description of Artificial Sequence:  Enzymatic Nucleic Acid
  misc_feature (31)..(31): n stands for inosine
uuuuaaaccugaugaggccguuaggccgaangaggaga

SEQ ID NO: 13988 - RNA, 38 nt, Artificial Sequence
  Description of Artificial Sequence:  Enzymatic Nucleic Acid
  misc_feature (31)..(31): n stands for inosine
gguguggacugaugaggccguuaggccgaancuuccuu

SEQ ID NO: 13989 - RNA, 38 nt, Artificial Sequence
  Description of Artificial Sequence:  Enzymatic Nucleic Acid
  misc_feature (31)..(31): n stands for inosine
uggggugucugaugaggccguuaggccgaanaugcuuc

SEQ ID NO: 13990 - RNA, 38 nt, Artificial Sequence
  Description of Artificial Sequence:  Enzymatic Nucleic Acid
  misc_feature (31)..(31): n stands for inosine
uuggggugcugaugaggccguuaggccgaangaugcuu

SEQ ID NO: 13991 - RNA, 38 nt, Artificial Sequence
  Description of Artificial Sequence:  Enzymatic Nucleic Acid
  misc_feature (31)..(31): n stands for inosine
aguuggggcugaugaggccguuaggccgaanuggaugc

SEQ ID NO: 13992 - RNA, 38 nt, Artificial Sequence
  Description of Artificial Sequence:  Enzymatic Nucleic Acid
  misc_feature (31)..(31): n stands for inosine
ggaguuggcugaugaggccguuaggccgaanuguggau

SEQ ID NO: 13993 - RNA, 38 nt, Artificial Sequence
  Description of Artificial Sequence:  Enzymatic Nucleic Acid
  misc_feature (31)..(31): n stands for inosine
gggaguugcugaugaggccguuaggccgaangugugga

SEQ ID NO: 13994 - RNA, 38 nt, Artificial Sequence
  Description of Artificial Sequence:  Enzymatic Nucleic Acid
  misc_feature (31)..(31): n stands for inosine
cgggaguucugaugaggccguuaggccgaanggugugg

SEQ ID NO: 13995 - RNA, 38 nt, Artificial Sequence
  Description of Artificial Sequence:  Enzymatic Nucleic Acid
  misc_feature (31)..(31): n stands for inosine
ccgggagucugaugaggccguuaggccgaangggugug

SEQ ID NO: 13996 - RNA, 38 nt, Artificial Sequence
  Description of Artificial Sequence:  Enzymatic Nucleic Acid
  misc_feature (31)..(31): n stands for inosine
uguccgggcugaugaggccguuaggccgaanuuggggu

SEQ ID NO: 13997 - RNA, 38 nt, Artificial Sequence
  Description of Artificial Sequence:  Enzymatic Nucleic Acid
  misc_feature (31)..(31): n stands for inosine
gauguccgcugaugaggccguuaggccgaanaguuggg

SEQ ID NO: 13998 - RNA, 38 nt, Artificial Sequence
  Description of Artificial Sequence:  Enzymatic Nucleic Acid
  misc_feature (31)..(31): n stands for inosine
ugaugucccugaugaggccguuaggccgaangaguugg

SEQ ID NO: 13999 - RNA, 38 nt, Artificial Sequence
  Description of Artificial Sequence:  Enzymatic Nucleic Acid
  misc_feature (31)..(31): n stands for inosine
ucaugugacugaugaggccguuaggccgaanuccggga

SEQ ID NO: 14000 - RNA, 38 nt, Artificial Sequence
  Description of Artificial Sequence:  Enzymatic Nucleic Acid
  misc_feature (31)..(31): n stands for inosine
cucucaugcugaugaggccguuaggccgaanauguccg

SEQ ID NO: 14001 - RNA, 38 nt, Artificial Sequence
  Description of Artificial Sequence:  Enzymatic Nucleic Acid
  misc_feature (31)..(31): n stands for inosine
accucucacugaugaggccguuaggccgaanugauguc

SEQ ID NO: 14002 - RNA, 38 nt, Artificial Sequence
  Description of Artificial Sequence:  Enzymatic Nucleic Acid
  misc_feature (31)..(31): n stands for inosine
aucugagccugaugaggccguuaggccgaanaccucuc

SEQ ID NO: 14003 - RNA, 38 nt, Artificial Sequence
  Description of Artificial Sequence:  Enzymatic Nucleic Acid
  misc_feature (31)..(31): n stands for inosine
aaaaucugcugaugaggccguuaggccgaancagaccu

SEQ ID NO: 14004 - RNA, 38 nt, Artificial Sequence
  Description of Artificial Sequence:  Enzymatic Nucleic Acid
  misc_feature (31)..(31): n stands for inosine
ucaaaauccugaugaggccguuaggccgaanagcagac

SEQ ID NO: 14005 - RNA, 38 nt, Artificial Sequence
  Description of Artificial Sequence:  Enzymatic Nucleic Acid
  misc_feature (31)..(31): n stands for inosine
ugguggaacugaugaggccguuaggccgaanaacaaca

SEQ ID NO: 14006 - RNA, 38 nt, Artificial Sequence
  Description of Artificial Sequence:  Enzymatic Nucleic Acid
  misc_feature (31)..(31): n stands for inosine
cugcuggucugaugaggccguuaggccgaanaaagaac

SEQ ID NO: 14007 - RNA, 38 nt, Artificial Sequence
  Description of Artificial Sequence:  Enzymatic Nucleic Acid
  misc_feature (31)..(31): n stands for inosine
ccugcuggcugaugaggccguuaggccgaangaaagaa

SEQ ID NO: 14008 - RNA, 38 nt, Artificial Sequence
  Description of Artificial Sequence:  Enzymatic Nucleic Acid
  misc_feature (31)..(31): n stands for inosine
uuccugcucugaugaggccguuaggccgaanuggaaag

SEQ ID NO: 14009 - RNA, 38 nt, Artificial Sequence
  Description of Artificial Sequence:  Enzymatic Nucleic Acid
  misc_feature (31)..(31): n stands for inosine
cuuccugccugaugaggccguuaggccgaanguggaaa

SEQ ID NO: 14010 - RNA, 38 nt, Artificial Sequence
  Description of Artificial Sequence:  Enzymatic Nucleic Acid
  misc_feature (31)..(31): n stands for inosine
cuacuucccugaugaggccguuaggccgaancuggugg

SEQ ID NO: 14011 - RNA, 38 nt, Artificial Sequence
  Description of Artificial Sequence:  Enzymatic Nucleic Acid
  misc_feature (31)..(31): n stands for inosine
ucaaaugccugaugaggccguuaggccgaancuacuuc

SEQ ID NO: 14012 - RNA, 38 nt, Artificial Sequence
  Description of Artificial Sequence:  Enzymatic Nucleic Acid
  misc_feature (31)..(31): n stands for inosine
aaaucaaacugaugaggccguuaggccgaancggcuac

SEQ ID NO: 14013 - RNA, 38 nt, Artificial Sequence
  Description of Artificial Sequence:  Enzymatic Nucleic Acid
  misc_feature (31)..(31): n stands for inosine
ugucgaaacugaugaggccguuaggccgaanaaaauca

SEQ ID NO: 14014 - RNA, 38 nt, Artificial Sequence
  Description of Artificial Sequence:  Enzymatic Nucleic Acid
  misc_feature (31)..(31): n stands for inosine
uuuucugucugaugaggccguuaggccgaanucgaaau

SEQ ID NO: 14015 - RNA, 38 nt, Artificial Sequence
  Description of Artificial Sequence:  Enzymatic Nucleic Acid
  misc_feature (31)..(31): n stands for inosine
ccuuuuuccugaugaggccguuaggccgaanuugucga

SEQ ID NO: 14016 - RNA, 38 nt, Artificial Sequence
  Description of Artificial Sequence:  Enzymatic Nucleic Acid
  misc_feature (31)..(31): n stands for inosine
caguccgacugaugaggccguuaggccgaanuccuuuu

SEQ ID NO: 14017 - RNA, 38 nt, Artificial Sequence
  Description of Artificial Sequence:  Enzymatic Nucleic Acid
  misc_feature (31)..(31): n stands for inosine
gcaguccgcugaugaggccguuaggccgaanguccuuu

SEQ ID NO: 14018 - RNA, 38 nt, Artificial Sequence
  Description of Artificial Sequence:  Enzymatic Nucleic Acid
  misc_feature (31)..(31): n stands for inosine
cucccugccugaugaggccguuaggccgaanuccgagg

SEQ ID NO: 14019 - RNA, 38 nt, Artificial Sequence
  Description of Artificial Sequence:  Enzymatic Nucleic Acid
  misc_feature (31)..(31): n stands for inosine
uggcuccccugaugaggccguuaggccgaancaguccg

SEQ ID NO: 14020 - RNA, 38 nt, Artificial Sequence
  Description of Artificial Sequence:  Enzymatic Nucleic Acid
  misc_feature (31)..(31): n stands for inosine
gaagagcucugaugaggccguuaggccgaancucccug

SEQ ID NO: 14021 - RNA, 38 nt, Artificial Sequence
  Description of Artificial Sequence:  Enzymatic Nucleic Acid
  misc_feature (31)..(31): n stands for inosine
agaagagccugaugaggccguuaggccgaangcucccu

SEQ ID NO: 14022 - RNA, 38 nt, Artificial Sequence
  Description of Artificial Sequence:  Enzymatic Nucleic Acid
  misc_feature (31)..(31): n stands for inosine
ccuagaagcugaugaggccguuaggccgaancuggcuc

SEQ ID NO: 14023 - RNA, 38 nt, Artificial Sequence
  Description of Artificial Sequence:  Enzymatic Nucleic Acid
  misc_feature (31)..(31): n stands for inosine
agccuagacugaugaggccguuaggccgaanagcuggc

SEQ ID NO: 14024 - RNA, 38 nt, Artificial Sequence
  Description of Artificial Sequence:  Enzymatic Nucleic Acid
  misc_feature (31)..(31): n stands for inosine
acaagccucugaugaggccguuaggccgaanaagagcu

SEQ ID NO: 14025 - RNA, 36 nt, Artificial Sequence
  Description of Artificial Sequence:  Enzymatic Nucleic Acid
gccagugauggcaugcacuaugcgcgagcaccuugc

SEQ ID NO: 14026 - RNA, 36 nt, Artificial Sequence
  Description of Artificial Sequence:  Enzymatic Nucleic Acid
cagggugauggcaugcacuaugcgcggacggccagc

SEQ ID NO: 14027 - RNA, 36 nt, Artificial Sequence
  Description of Artificial Sequence:  Enzymatic Nucleic Acid
ccacgugauggcaugcacuaugcgcgagagccacag

SEQ ID NO: 14028 - RNA, 36 nt, Artificial Sequence
  Description of Artificial Sequence:  Enzymatic Nucleic Acid
agaggugauggcaugcacuaugcgcgggcccggguc

SEQ ID NO: 14029 - RNA, 36 nt, Artificial Sequence
  Description of Artificial Sequence:  Enzymatic Nucleic Acid
cuaggugauggcaugcacuaugcgcgaaacccacag

SEQ ID NO: 14030 - RNA, 36 nt, Artificial Sequence
  Description of Artificial Sequence:  Enzymatic Nucleic Acid
cagauugauggcaugcacuaugcgcgaagagaaaca

SEQ ID NO: 14031 - RNA, 36 nt, Artificial Sequence
  Description of Artificial Sequence:  Enzymatic Nucleic Acid
cugggugauggcaugcacuaugcgcgagaucaagag

SEQ ID NO: 14032 - RNA, 36 nt, Artificial Sequence
  Description of Artificial Sequence:  Enzymatic Nucleic Acid
cccugugauggcaugcacuaugcgcgaaguaauuug

SEQ ID NO: 14033 - RNA, 36 nt, Artificial Sequence
  Description of Artificial Sequence:  Enzymatic Nucleic Acid
uugcuugauggcaugcacuaugcgcgacugccacuc

SEQ ID NO: 14034 - RNA, 36 nt, Artificial Sequence
  Description of Artificial Sequence:  Enzymatic Nucleic Acid
ucaguugauggcaugcacuaugcgcgaccuccaccc

SEQ ID NO: 14035 - RNA, 36 nt, Artificial Sequence
  Description of Artificial Sequence:  Enzymatic Nucleic Acid
gcacuugauggcaugcacuaugcgcgagucaccucc

SEQ ID NO: 14036 - RNA, 36 nt, Artificial Sequence
  Description of Artificial Sequence:  Enzymatic Nucleic Acid
cgcugugauggcaugcacuaugcgcgacucagucac

SEQ ID NO: 14037 - RNA, 36 nt, Artificial Sequence
  Description of Artificial Sequence:  Enzymatic Nucleic Acid
gccauugauggcaugcacuaugcgcggcugcacuca

SEQ ID NO: 14038 - RNA, 36 nt, Artificial Sequence
  Description of Artificial Sequence:  Enzymatic Nucleic Acid
ccgauugauggcaugcacuaugcgcgacuuuuggaa

SEQ ID NO: 14039 - RNA, 36 nt, Artificial Sequence
  Description of Artificial Sequence:  Enzymatic Nucleic Acid
aguguugauggcaugcacuaugcgcgauuuccgauc

SEQ ID NO: 14040 - RNA, 36 nt, Artificial Sequence
  Description of Artificial Sequence:  Enzymatic Nucleic Acid
agaagugauggcaugcacuaugcgcgacuuguaggc

SEQ ID NO: 14041 - RNA, 36 nt, Artificial Sequence
  Description of Artificial Sequence:  Enzymatic Nucleic Acid
caaguugauggcaugcacuaugcgcgaguuucccgg

SEQ ID NO: 14042 - RNA, 36 nt, Artificial Sequence
  Description of Artificial Sequence:  Enzymatic Nucleic Acid
agaagugauggcaugcacuaugcgcgaauaaaugga

SEQ ID NO: 14043 - RNA, 36 nt, Artificial Sequence
  Description of Artificial Sequence:  Enzymatic Nucleic Acid
uugguugauggcaugcacuaugcgcgacuaacagaa

SEQ ID NO: 14044 - RNA, 36 nt, Artificial Sequence
  Description of Artificial Sequence:  Enzymatic Nucleic Acid
guucuugauggcaugcacuaugcgcgaguaauguac

SEQ ID NO: 14045 - RNA, 36 nt, Artificial Sequence
  Description of Artificial Sequence:  Enzymatic Nucleic Acid
ggaauugauggcaugcacuaugcgcgaccacaguuu

SEQ ID NO: 14046 - RNA, 36 nt, Artificial Sequence
  Description of Artificial Sequence:  Enzymatic Nucleic Acid
ucuugugauggcaugcacuaugcgcgacaaagugac

SEQ ID NO: 14047 - RNA, 36 nt, Artificial Sequence
  Description of Artificial Sequence:  Enzymatic Nucleic Acid
accauugauggcaugcacuaugcgcgaggaacaaau

SEQ ID NO: 14048 - RNA, 36 nt, Artificial Sequence
  Description of Artificial Sequence:  Enzymatic Nucleic Acid
cugauugauggcaugcacuaugcgcgauguagcugg

SEQ ID NO: 14049 - RNA, 36 nt, Artificial Sequence
  Description of Artificial Sequence:  Enzymatic Nucleic Acid
gccagugauggcaugcacuaugcgcgauagcugauc

SEQ ID NO: 14050 - RNA, 36 nt, Artificial Sequence
  Description of Artificial Sequence:  Enzymatic Nucleic Acid
ugcuuugauggcaugcacuaugcgcgacagaagacc

SEQ ID NO: 14051 - RNA, 36 nt, Artificial Sequence
  Description of Artificial Sequence:  Enzymatic Nucleic Acid
uucauugauggcaugcacuaugcgcgauuaauuuuu

SEQ ID NO: 14052 - RNA, 36 nt, Artificial Sequence
  Description of Artificial Sequence:  Enzymatic Nucleic Acid
acuuuugauggcaugcacuaugcgcgaucauuaauu

SEQ ID NO: 14053 - RNA, 36 nt, Artificial Sequence
  Description of Artificial Sequence:  Enzymatic Nucleic Acid
cacauugauggcaugcacuaugcgcgauaaauccua

SEQ ID NO: 14054 - RNA, 36 nt, Artificial Sequence
  Description of Artificial Sequence:  Enzymatic Nucleic Acid
ggacuugauggcaugcacuaugcgcgagaaccacau

SEQ ID NO: 14055 - RNA, 36 nt, Artificial Sequence
  Description of Artificial Sequence:  Enzymatic Nucleic Acid
uaguuugauggcaugcacuaugcgcgaauuccauga

SEQ ID NO: 14056 - RNA, 36 nt, Artificial Sequence
  Description of Artificial Sequence:  Enzymatic Nucleic Acid
uaguuugauggcaugcacuaugcgcgaguucuugcu

SEQ ID NO: 14057 - RNA, 36 nt, Artificial Sequence
  Description of Artificial Sequence:  Enzymatic Nucleic Acid
gaaguugauggcaugcacuaugcgcgaauccccaca

SEQ ID NO: 14058 - RNA, 36 nt, Artificial Sequence
  Description of Artificial Sequence:  Enzymatic Nucleic Acid
ugcuuugauggcaugcacuaugcgcggaagaagggu

SEQ ID NO: 14059 - RNA, 36 nt, Artificial Sequence
  Description of Artificial Sequence:  Enzymatic Nucleic Acid
ggucuugauggcaugcacuaugcgcggguuuacaag

SEQ ID NO: 14060 - RNA, 36 nt, Artificial Sequence
  Description of Artificial Sequence:  Enzymatic Nucleic Acid
caucuugauggcaugcacuaugcgcgacucccagac

SEQ ID NO: 14061 - RNA, 36 nt, Artificial Sequence
  Description of Artificial Sequence:  Enzymatic Nucleic Acid
uucuuugauggcaugcacuaugcgcgaucucacucc

SEQ ID NO: 14062 - RNA, 36 nt, Artificial Sequence
  Description of Artificial Sequence:  Enzymatic Nucleic Acid
gugcuugauggcaugcacuaugcgcgaaaaauuucu

SEQ ID NO: 14063 - RNA, 36 nt, Artificial Sequence
  Description of Artificial Sequence:  Enzymatic Nucleic Acid
uugguugauggcaugcacuaugcgcgacuccggguu

SEQ ID NO: 14064 - RNA, 36 nt, Artificial Sequence
  Description of Artificial Sequence:  Enzymatic Nucleic Acid
ugcugugauggcaugcacuaugcgcgacagguguac

SEQ ID NO: 14065 - RNA, 36 nt, Artificial Sequence
  Description of Artificial Sequence:  Enzymatic Nucleic Acid
gucauugauggcaugcacuaugcgcgagcccacugg

SEQ ID NO: 14066 - RNA, 36 nt, Artificial Sequence
  Description of Artificial Sequence:  Enzymatic Nucleic Acid
uugguugauggcaugcacuaugcgcgaucagcccac

SEQ ID NO: 14067 - RNA, 36 nt, Artificial Sequence
  Description of Artificial Sequence:  Enzymatic Nucleic Acid
uuuuuugauggcaugcacuaugcgcgauggacccug

SEQ ID NO: 14068 - RNA, 36 nt, Artificial Sequence
  Description of Artificial Sequence:  Enzymatic Nucleic Acid
aaaagugauggcaugcacuaugcgcgaacaaaaggu

SEQ ID NO: 14069 - RNA, 36 nt, Artificial Sequence
  Description of Artificial Sequence:  Enzymatic Nucleic Acid
cuucgugauggcaugcacuaugcgcgagggauucug

SEQ ID NO: 14070 - RNA, 36 nt, Artificial Sequence
  Description of Artificial Sequence:  Enzymatic Nucleic Acid
uacuuugauggcaugcacuaugcgcggcagggauuc

SEQ ID NO: 14071 - RNA, 36 nt, Artificial Sequence
  Description of Artificial Sequence:  Enzymatic Nucleic Acid
ggacuugauggcaugcacuaugcgcgaagggguauu

SEQ ID NO: 14072 - RNA, 36 nt, Artificial Sequence
  Description of Artificial Sequence:  Enzymatic Nucleic Acid
aucguugauggcaugcacuaugcgcgaguacaugcc

SEQ ID NO: 14073 - RNA, 36 nt, Artificial Sequence
  Description of Artificial Sequence:  Enzymatic Nucleic Acid
auaauugauggcaugcacuaugcgcggucaguacau

SEQ ID NO: 14074 - RNA, 36 nt, Artificial Sequence
  Description of Artificial Sequence:  Enzymatic Nucleic Acid
ucacuugauggcaugcacuaugcgcgacuuccauaa

SEQ ID NO: 14075 - RNA, 36 nt, Artificial Sequence
  Description of Artificial Sequence:  Enzymatic Nucleic Acid
ucuuuugauggcaugcacuaugcgcgacucacuucc

SEQ ID NO: 14076 - RNA, 36 nt, Artificial Sequence
  Description of Artificial Sequence:  Enzymatic Nucleic Acid
uuucuugauggcaugcacuaugcgcgaccaaucugg

SEQ ID NO: 14077 - RNA, 36 nt, Artificial Sequence
  Description of Artificial Sequence:  Enzymatic Nucleic Acid
gucagugauggcaugcacuaugcgcgguuugagugg

SEQ ID NO: 14078 - RNA, 36 nt, Artificial Sequence
  Description of Artificial Sequence:  Enzymatic Nucleic Acid
cauguugauggcaugcacuaugcgcgagcguuugag

SEQ ID NO: 14079 - RNA, 36 nt, Artificial Sequence
  Description of Artificial Sequence:  Enzymatic Nucleic Acid
aauggugauggcaugcacuaugcgcgauagaccgua

SEQ ID NO: 14080 - RNA, 36 nt, Artificial Sequence
  Description of Artificial Sequence:  Enzymatic Nucleic Acid
ugaugugauggcaugcacuaugcgcggggggaggaa

SEQ ID NO: 14081 - RNA, 36 nt, Artificial Sequence
  Description of Artificial Sequence:  Enzymatic Nucleic Acid
uggcgugauggcaugcacuaugcgcgacucuuccuc

SEQ ID NO: 14082 - RNA, 36 nt, Artificial Sequence
  Description of Artificial Sequence:  Enzymatic Nucleic Acid
guuggugauggcaugcacuaugcgcggcacucuucc

SEQ ID NO: 14083 - RNA, 36 nt, Artificial Sequence
  Description of Artificial Sequence:  Enzymatic Nucleic Acid
gggcuugauggcaugcacuaugcgcgguuggcgcac

SEQ ID NO: 14084 - RNA, 36 nt, Artificial Sequence
  Description of Artificial Sequence:  Enzymatic Nucleic Acid
uuuguugauggcaugcacuaugcgcgacugagacag

SEQ ID NO: 14085 - RNA, 36 nt, Artificial Sequence
  Description of Artificial Sequence:  Enzymatic Nucleic Acid
uucuuugauggcaugcacuaugcgcgacaaggguau

SEQ ID NO: 14086 - RNA, 36 nt, Artificial Sequence
  Description of Artificial Sequence:  Enzymatic Nucleic Acid
aacuuugauggcaugcacuaugcgcgaauuuuauuu

SEQ ID NO: 14087 - RNA, 36 nt, Artificial Sequence
  Description of Artificial Sequence:  Enzymatic Nucleic Acid
uagagugauggcaugcacuaugcgcgaaauugauuu

SEQ ID NO: 14088 - RNA, 36 nt, Artificial Sequence
  Description of Artificial Sequence:  Enzymatic Nucleic Acid
uccuuugauggcaugcacuaugcgcgaauuagagca

SEQ ID NO: 14089 - RNA, 36 nt, Artificial Sequence
  Description of Artificial Sequence:  Enzymatic Nucleic Acid
cgcuuugauggcaugcacuaugcgcgacauuuguac

SEQ ID NO: 14090 - RNA, 36 nt, Artificial Sequence
  Description of Artificial Sequence:  Enzymatic Nucleic Acid
gagauugauggcaugcacuaugcgcgacccucucuc

SEQ ID NO: 14091 - RNA, 36 nt, Artificial Sequence
  Description of Artificial Sequence:  Enzymatic Nucleic Acid
cugguugauggcaugcacuaugcgcgacguggaagg

SEQ ID NO: 14092 - RNA, 36 nt, Artificial Sequence
  Description of Artificial Sequence:  Enzymatic Nucleic Acid
aauuuugauggcaugcacuaugcgcgaggaccccug

SEQ ID NO: 14093 - RNA, 36 nt, Artificial Sequence
  Description of Artificial Sequence:  Enzymatic Nucleic Acid
gguugugauggcaugcacuaugcgcgaaaguaauuu

SEQ ID NO: 14094 - RNA, 36 nt, Artificial Sequence
  Description of Artificial Sequence:  Enzymatic Nucleic Acid
cauguugauggcaugcacuaugcgcgagguugcaaa

SEQ ID NO: 14095 - RNA, 36 nt, Artificial Sequence
  Description of Artificial Sequence:  Enzymatic Nucleic Acid
ggcugugauggcaugcacuaugcgcgaugucagguu

SEQ ID NO: 14096 - RNA, 36 nt, Artificial Sequence
  Description of Artificial Sequence:  Enzymatic Nucleic Acid
cugcuugauggcaugcacuaugcgcgagugggcugc

SEQ ID NO: 14097 - RNA, 36 nt, Artificial Sequence
  Description of Artificial Sequence:  Enzymatic Nucleic Acid
cagugugauggcaugcacuaugcgcgaccacaaaga

SEQ ID NO: 14098 - RNA, 36 nt, Artificial Sequence
  Description of Artificial Sequence:  Enzymatic Nucleic Acid
gucugugauggcaugcacuaugcgcgagugcaccac

SEQ ID NO: 14099 - RNA, 36 nt, Artificial Sequence
  Description of Artificial Sequence:  Enzymatic Nucleic Acid
guucuugauggcaugcacuaugcgcgaaacguagau

SEQ ID NO: 14100 - RNA, 36 nt, Artificial Sequence
  Description of Artificial Sequence:  Enzymatic Nucleic Acid
auuggugauggcaugcacuaugcgcgagaggcugug

SEQ ID NO: 14101 - RNA, 36 nt, Artificial Sequence
  Description of Artificial Sequence:  Enzymatic Nucleic Acid
gugggugauggcaugcacuaugcgcgaacucuccca

SEQ ID NO: 14102 - RNA, 36 nt, Artificial Sequence
  Description of Artificial Sequence:  Enzymatic Nucleic Acid
ucuugugauggcaugcacuaugcgcgaaacaggugu

SEQ ID NO: 14103 - RNA, 36 nt, Artificial Sequence
  Description of Artificial Sequence:  Enzymatic Nucleic Acid
gcauuugauggcaugcacuaugcgcgaauuuccaaa

SEQ ID NO: 14104 - RNA, 36 nt, Artificial Sequence
  Description of Artificial Sequence:  Enzymatic Nucleic Acid
gguggugauggcaugcacuaugcgcgauucaauuuc

SEQ ID NO: 14105 - RNA, 36 nt, Artificial Sequence
  Description of Artificial Sequence:  Enzymatic Nucleic Acid
aauguugauggcaugcacuaugcgcgauuugugcua

SEQ ID NO: 14106 - RNA, 36 nt, Artificial Sequence
  Description of Artificial Sequence:  Enzymatic Nucleic Acid
augauugauggcaugcacuaugcgcgaaaaugucau

SEQ ID NO: 14107 - RNA, 36 nt, Artificial Sequence
  Description of Artificial Sequence:  Enzymatic Nucleic Acid
ggaugugauggcaugcacuaugcgcgauucuuaagc

SEQ ID NO: 14108 - RNA, 36 nt, Artificial Sequence
  Description of Artificial Sequence:  Enzymatic Nucleic Acid
uccugugauggcaugcacuaugcgcgaaggaugcau

SEQ ID NO: 14109 - RNA, 36 nt, Artificial Sequence
  Description of Artificial Sequence:  Enzymatic Nucleic Acid
caaggugauggcaugcacuaugcgcgagacauaguc

SEQ ID NO: 14110 - RNA, 36 nt, Artificial Sequence
  Description of Artificial Sequence:  Enzymatic Nucleic Acid
uugagugauggcaugcacuaugcgcgaaggcagaca

SEQ ID NO: 14111 - RNA, 36 nt, Artificial Sequence
  Description of Artificial Sequence:  Enzymatic Nucleic Acid
ccacgugauggcaugcacuaugcgcgaaugucuuuu

SEQ ID NO: 14112 - RNA, 36 nt, Artificial Sequence
  Description of Artificial Sequence:  Enzymatic Nucleic Acid
gugauugauggcaugcacuaugcgcggugggugcca

SEQ ID NO: 14113 - RNA, 36 nt, Artificial Sequence
  Description of Artificial Sequence:  Enzymatic Nucleic Acid
cuuguugauggcaugcacuaugcgcggucugauucu

SEQ ID NO: 14114 - RNA, 36 nt, Artificial Sequence
  Description of Artificial Sequence:  Enzymatic Nucleic Acid
gacuuugauggcaugcacuaugcgcggaugcuuucc

SEQ ID NO: 14115 - RNA, 36 nt, Artificial Sequence
  Description of Artificial Sequence:  Enzymatic Nucleic Acid
ccgugugauggcaugcacuaugcgcgaugagacuuc

SEQ ID NO: 14116 - RNA, 36 nt, Artificial Sequence
  Description of Artificial Sequence:  Enzymatic Nucleic Acid
ggucuugauggcaugcacuaugcgcgauuaucuuua

SEQ ID NO: 14117 - RNA, 36 nt, Artificial Sequence
  Description of Artificial Sequence:  Enzymatic Nucleic Acid
uccuuugauggcaugcacuaugcgcgaauacaaugc

SEQ ID NO: 14118 - RNA, 36 nt, Artificial Sequence
  Description of Artificial Sequence:  Enzymatic Nucleic Acid
cucugugauggcaugcacuaugcgcgggauagugag

SEQ ID NO: 14119 - RNA, 36 nt, Artificial Sequence
  Description of Artificial Sequence:  Enzymatic Nucleic Acid
uuccuugauggcaugcacuaugcgcgacucugcgga

SEQ ID NO: 14120 - RNA, 36 nt, Artificial Sequence
  Description of Artificial Sequence:  Enzymatic Nucleic Acid
gccuuugauggcaugcacuaugcgcgguccuccuuc

SEQ ID NO: 14121 - RNA, 36 nt, Artificial Sequence
  Description of Artificial Sequence:  Enzymatic Nucleic Acid
ccuggugauggcaugcacuaugcgcgagguguagag

SEQ ID NO: 14122 - RNA, 36 nt, Artificial Sequence
  Description of Artificial Sequence:  Enzymatic Nucleic Acid
cacugugauggcaugcacuaugcgcgaugccuggca

SEQ ID NO: 14123 - RNA, 36 nt, Artificial Sequence
  Description of Artificial Sequence:  Enzymatic Nucleic Acid
uuuugugauggcaugcacuaugcgcgacagccaaga

SEQ ID NO: 14124 - RNA, 36 nt, Artificial Sequence
  Description of Artificial Sequence:  Enzymatic Nucleic Acid
cugggugauggcaugcacuaugcgcgaccuucuauu

SEQ ID NO: 14125 - RNA, 36 nt, Artificial Sequence
  Description of Artificial Sequence:  Enzymatic Nucleic Acid
aaguuugauggcaugcacuaugcgcggucuuuuccu

SEQ ID NO: 14126 - RNA, 36 nt, Artificial Sequence
  Description of Artificial Sequence:  Enzymatic Nucleic Acid
accguugauggcaugcacuaugcgcggugccuacua

SEQ ID NO: 14127 - RNA, 36 nt, Artificial Sequence
  Description of Artificial Sequence:  Enzymatic Nucleic Acid
gcaauugauggcaugcacuaugcgcgaccgucgugc

SEQ ID NO: 14128 - RNA, 36 nt, Artificial Sequence
  Description of Artificial Sequence:  Enzymatic Nucleic Acid
cauggugauggcaugcacuaugcgcgaaucaccguc

SEQ ID NO: 14129 - RNA, 36 nt, Artificial Sequence
  Description of Artificial Sequence:  Enzymatic Nucleic Acid
gucuuugauggcaugcacuaugcgcgaguuccccuc

SEQ ID NO: 14130 - RNA, 36 nt, Artificial Sequence
  Description of Artificial Sequence:  Enzymatic Nucleic Acid
gaguuugauggcaugcacuaugcgcgaucuggaucc

SEQ ID NO: 14131 - RNA, 36 nt, Artificial Sequence
  Description of Artificial Sequence:  Enzymatic Nucleic Acid
auguuugauggcaugcacuaugcgcgauccaauggg

SEQ ID NO: 14132 - RNA, 36 nt, Artificial Sequence
  Description of Artificial Sequence:  Enzymatic Nucleic Acid
ucguuugauggcaugcacuaugcgcgacaauguuca

SEQ ID NO: 14133 - RNA, 36 nt, Artificial Sequence
  Description of Artificial Sequence:  Enzymatic Nucleic Acid
gcaguugauggcaugcacuaugcgcgguucacaaug

SEQ ID NO: 14134 - RNA, 36 nt, Artificial Sequence
  Description of Artificial Sequence:  Enzymatic Nucleic Acid
uaaggugauggcaugcacuaugcgcgagucguucac

SEQ ID NO: 14135 - RNA, 36 nt, Artificial Sequence
  Description of Artificial Sequence:  Enzymatic Nucleic Acid
ggcauugauggcaugcacuaugcgcgauaaggcagu

SEQ ID NO: 14136 - RNA, 36 nt, Artificial Sequence
  Description of Artificial Sequence:  Enzymatic Nucleic Acid
gcuggugauggcaugcacuaugcgcgaucauaaggc

SEQ ID NO: 14137 - RNA, 36 nt, Artificial Sequence
  Description of Artificial Sequence:  Enzymatic Nucleic Acid
agguuugauggcaugcacuaugcgcgagccggucuc

SEQ ID NO: 14138 - RNA, 36 nt, Artificial Sequence
  Description of Artificial Sequence:  Enzymatic Nucleic Acid
aaaggugauggcaugcacuaugcgcgaccacggcca

SEQ ID NO: 14139 - RNA, 36 nt, Artificial Sequence
  Description of Artificial Sequence:  Enzymatic Nucleic Acid
ugcuuugauggcaugcacuaugcgcgaaucucuugg

SEQ ID NO: 14140 - RNA, 36 nt, Artificial Sequence
  Description of Artificial Sequence:  Enzymatic Nucleic Acid
aaaggugauggcaugcacuaugcgcgaucugcuuca

SEQ ID NO: 14141 - RNA, 36 nt, Artificial Sequence
  Description of Artificial Sequence:  Enzymatic Nucleic Acid
cuuguugauggcaugcacuaugcgcgaauuccaaag

SEQ ID NO: 14142 - RNA, 36 nt, Artificial Sequence
  Description of Artificial Sequence:  Enzymatic Nucleic Acid
uccugugauggcaugcacuaugcgcgaaguugcugu

SEQ ID NO: 14143 - RNA, 36 nt, Artificial Sequence
  Description of Artificial Sequence:  Enzymatic Nucleic Acid
ucuuuugauggcaugcacuaugcgcgaacauuuuga

SEQ ID NO: 14144 - RNA, 36 nt, Artificial Sequence
  Description of Artificial Sequence:  Enzymatic Nucleic Acid
augcuugauggcaugcacuaugcgcgacuguguguu

SEQ ID NO: 14145 - RNA, 36 nt, Artificial Sequence
  Description of Artificial Sequence:  Enzymatic Nucleic Acid
gagcuugauggcaugcacuaugcgcggaugcucacu

SEQ ID NO: 14146 - RNA, 36 nt, Artificial Sequence
  Description of Artificial Sequence:  Enzymatic Nucleic Acid
gaguuugauggcaugcacuaugcgcgagacaugaga

SEQ ID NO: 14147 - RNA, 36 nt, Artificial Sequence
  Description of Artificial Sequence:  Enzymatic Nucleic Acid
acaggugauggcaugcacuaugcgcgaccuagaagg

SEQ ID NO: 14148 - RNA, 36 nt, Artificial Sequence
  Description of Artificial Sequence:  Enzymatic Nucleic Acid
acaauugauggcaugcacuaugcgcgaccaugagug

SEQ ID NO: 14149 - RNA, 36 nt, Artificial Sequence
  Description of Artificial Sequence:  Enzymatic Nucleic Acid
auuugugauggcaugcacuaugcgcgagaauuccac

SEQ ID NO: 14150 - RNA, 36 nt, Artificial Sequence
  Description of Artificial Sequence:  Enzymatic Nucleic Acid
cuccuugauggcaugcacuaugcgcgagguaagugg

SEQ ID NO: 14151 - RNA, 36 nt, Artificial Sequence
  Description of Artificial Sequence:  Enzymatic Nucleic Acid
aaauuugauggcaugcacuaugcgcgauuucucuug

SEQ ID NO: 14152 - RNA, 36 nt, Artificial Sequence
  Description of Artificial Sequence:  Enzymatic Nucleic Acid
ggaauugauggcaugcacuaugcgcggugccccuuu

SEQ ID NO: 14153 - RNA, 36 nt, Artificial Sequence
  Description of Artificial Sequence:  Enzymatic Nucleic Acid
cguuuugauggcaugcacuaugcgcgagauccacag

SEQ ID NO: 14154 - RNA, 36 nt, Artificial Sequence
  Description of Artificial Sequence:  Enzymatic Nucleic Acid
ccaagugauggcaugcacuaugcgcggccguuucag

SEQ ID NO: 14155 - RNA, 36 nt, Artificial Sequence
  Description of Artificial Sequence:  Enzymatic Nucleic Acid
uacauugauggcaugcacuaugcgcgacugagggac

SEQ ID NO: 14156 - RNA, 36 nt, Artificial Sequence
  Description of Artificial Sequence:  Enzymatic Nucleic Acid
aucuuugauggcaugcacuaugcgcgaggagcuucc

SEQ ID NO: 14157 - RNA, 36 nt, Artificial Sequence
  Description of Artificial Sequence:  Enzymatic Nucleic Acid
aagguugauggcaugcacuaugcgcgaggaaguccu

SEQ ID NO: 14158 - RNA, 36 nt, Artificial Sequence
  Description of Artificial Sequence:  Enzymatic Nucleic Acid
uuucgugauggcaugcacuaugcgcggaugccaaga

SEQ ID NO: 14159 - RNA, 36 nt, Artificial Sequence
  Description of Artificial Sequence:  Enzymatic Nucleic Acid
acuuuugauggcaugcacuaugcgcggcgaugccaa

SEQ ID NO: 14160 - RNA, 36 nt, Artificial Sequence
  Description of Artificial Sequence:  Enzymatic Nucleic Acid
uauuuugauggcaugcacuaugcgcggugccgccag

SEQ ID NO: 14161 - RNA, 36 nt, Artificial Sequence
  Description of Artificial Sequence:  Enzymatic Nucleic Acid
aaaguugauggcaugcacuaugcgcgacagauuuua

SEQ ID NO: 14162 - RNA, 36 nt, Artificial Sequence
  Description of Artificial Sequence:  Enzymatic Nucleic Acid
gcgagugauggcaugcacuaugcgcgaucuccuuuu

SEQ ID NO: 14163 - RNA, 36 nt, Artificial Sequence
  Description of Artificial Sequence:  Enzymatic Nucleic Acid
ggaggugauggcaugcacuaugcgcggagcaucucc

SEQ ID NO: 14164 - RNA, 36 nt, Artificial Sequence
  Description of Artificial Sequence:  Enzymatic Nucleic Acid
cauuuugauggcaugcacuaugcgcgaaagggaggc

SEQ ID NO: 14165 - RNA, 36 nt, Artificial Sequence
  Description of Artificial Sequence:  Enzymatic Nucleic Acid
ucuguugauggcaugcacuaugcgcgaaaaauuguu

SEQ ID NO: 14166 - RNA, 36 nt, Artificial Sequence
  Description of Artificial Sequence:  Enzymatic Nucleic Acid
gacguugauggcaugcacuaugcgcgacucuggauu

SEQ ID NO: 14167 - RNA, 36 nt, Artificial Sequence
  Description of Artificial Sequence:  Enzymatic Nucleic Acid
cacagugauggcaugcacuaugcgcgaaaacaccaa

SEQ ID NO: 14168 - RNA, 36 nt, Artificial Sequence
  Description of Artificial Sequence:  Enzymatic Nucleic Acid
agaagugauggcaugcacuaugcgcgaccuaaggaa

SEQ ID NO: 14169 - RNA, 36 nt, Artificial Sequence
  Description of Artificial Sequence:  Enzymatic Nucleic Acid
uucauugauggcaugcacuaugcgcgaaucuuuacc

SEQ ID NO: 14170 - RNA, 36 nt, Artificial Sequence
  Description of Artificial Sequence:  Enzymatic Nucleic Acid
uucuuugauggcaugcacuaugcgcgaucaaucuuu

SEQ ID NO: 14171 - RNA, 36 nt, Artificial Sequence
  Description of Artificial Sequence:  Enzymatic Nucleic Acid
ucaauugauggcaugcacuaugcgcggccuacaaaa

SEQ ID NO: 14172 - RNA, 36 nt, Artificial Sequence
  Description of Artificial Sequence:  Enzymatic Nucleic Acid
ucuuuugauggcaugcacuaugcgcgaaucgccuac

SEQ ID NO: 14173 - RNA, 36 nt, Artificial Sequence
  Description of Artificial Sequence:  Enzymatic Nucleic Acid
gcccuugauggcaugcacuaugcgcgauucuaguuc

SEQ ID NO: 14174 - RNA, 36 nt, Artificial Sequence
  Description of Artificial Sequence:  Enzymatic Nucleic Acid
auaauugauggcaugcacuaugcgcgaggggcccuc

SEQ ID NO: 14175 - RNA, 36 nt, Artificial Sequence
  Description of Artificial Sequence:  Enzymatic Nucleic Acid
uccagugauggcaugcacuaugcgcgauggucuggu

SEQ ID NO: 14176 - RNA, 36 nt, Artificial Sequence
  Description of Artificial Sequence:  Enzymatic Nucleic Acid
gcuugugauggcaugcacuaugcgcgaagagauuuc

SEQ ID NO: 14177 - RNA, 36 nt, Artificial Sequence
  Description of Artificial Sequence:  Enzymatic Nucleic Acid
cugagugauggcaugcacuaugcgcgauuagcuugc

SEQ ID NO: 14178 - RNA, 36 nt, Artificial Sequence
  Description of Artificial Sequence:  Enzymatic Nucleic Acid
gauauugauggcaugcacuaugcgcgggaagaacaa

SEQ ID NO: 14179 - RNA, 36 nt, Artificial Sequence
  Description of Artificial Sequence:  Enzymatic Nucleic Acid
augcuugauggcaugcacuaugcgcgaaagucucug

SEQ ID NO: 14180 - RNA, 36 nt, Artificial Sequence
  Description of Artificial Sequence:  Enzymatic Nucleic Acid
guaggugauggcaugcacuaugcgcgagagagaguc

SEQ ID NO: 14181 - RNA, 36 nt, Artificial Sequence
  Description of Artificial Sequence:  Enzymatic Nucleic Acid
gggguugauggcaugcacuaugcgcgacauacuucc

SEQ ID NO: 14182 - RNA, 36 nt, Artificial Sequence
  Description of Artificial Sequence:  Enzymatic Nucleic Acid
guuguugauggcaugcacuaugcgcgauaauggaau

SEQ ID NO: 14183 - RNA, 36 nt, Artificial Sequence
  Description of Artificial Sequence:  Enzymatic Nucleic Acid
uucugugauggcaugcacuaugcgcgagauacugac

SEQ ID NO: 14184 - RNA, 36 nt, Artificial Sequence
  Description of Artificial Sequence:  Enzymatic Nucleic Acid
ucuuuugauggcaugcacuaugcgcggcuuacuguu

SEQ ID NO: 14185 - RNA, 36 nt, Artificial Sequence
  Description of Artificial Sequence:  Enzymatic Nucleic Acid
acacuugauggcaugcacuaugcgcgacaggccggc

SEQ ID NO: 14186 - RNA, 36 nt, Artificial Sequence
  Description of Artificial Sequence:  Enzymatic Nucleic Acid
aucuuugauggcaugcacuaugcgcgaaauguuuuu

SEQ ID NO: 14187 - RNA, 36 nt, Artificial Sequence
  Description of Artificial Sequence:  Enzymatic Nucleic Acid
guuguugauggcaugcacuaugcgcgaucugggauu

SEQ ID NO: 14188 - RNA, 36 nt, Artificial Sequence
  Description of Artificial Sequence:  Enzymatic Nucleic Acid
ugaggugauggcaugcacuaugcgcgaagaaccaua

SEQ ID NO: 14189 - RNA, 36 nt, Artificial Sequence
  Description of Artificial Sequence:  Enzymatic Nucleic Acid
guuuuugauggcaugcacuaugcgcgagcucuucug

SEQ ID NO: 14190 - RNA, 36 nt, Artificial Sequence
  Description of Artificial Sequence:  Enzymatic Nucleic Acid
cugggugauggcaugcacuaugcgcgaccauuccac

SEQ ID NO: 14191 - RNA, 36 nt, Artificial Sequence
  Description of Artificial Sequence:  Enzymatic Nucleic Acid
gccuuugauggcaugcacuaugcgcgagaugccaca

SEQ ID NO: 14192 - RNA, 36 nt, Artificial Sequence
  Description of Artificial Sequence:  Enzymatic Nucleic Acid
gucauugauggcaugcacuaugcgcgggagugauau

SEQ ID NO: 14193 - RNA, 36 nt, Artificial Sequence
  Description of Artificial Sequence:  Enzymatic Nucleic Acid
uguguugauggcaugcacuaugcgcgaucggaguga

SEQ ID NO: 14194 - RNA, 36 nt, Artificial Sequence
  Description of Artificial Sequence:  Enzymatic Nucleic Acid
uuccuugauggcaugcacuaugcgcgacuggaguac

SEQ ID NO: 14195 - RNA, 36 nt, Artificial Sequence
  Description of Artificial Sequence:  Enzymatic Nucleic Acid
ucuauugauggcaugcacuaugcgcgagcuuuaaaa

SEQ ID NO: 14196 - RNA, 36 nt, Artificial Sequence
  Description of Artificial Sequence:  Enzymatic Nucleic Acid
guuugugauggcaugcacuaugcgcgacuccaaucu

SEQ ID NO: 14197 - RNA, 36 nt, Artificial Sequence
  Description of Artificial Sequence:  Enzymatic Nucleic Acid
cguguugauggcaugcacuaugcgcgaggcuggaga

SEQ ID NO: 14198 - RNA, 36 nt, Artificial Sequence
  Description of Artificial Sequence:  Enzymatic Nucleic Acid
gagcuugauggcaugcacuaugcgcgaguguggucc

SEQ ID NO: 14199 - RNA, 36 nt, Artificial Sequence
  Description of Artificial Sequence:  Enzymatic Nucleic Acid
ccucuugauggcaugcacuaugcgcgaugugauguc

SEQ ID NO: 14200 - RNA, 36 nt, Artificial Sequence
  Description of Artificial Sequence:  Enzymatic Nucleic Acid
cugagugauggcaugcacuaugcgcgagaccucuca

SEQ ID NO: 14201 - RNA, 36 nt, Artificial Sequence
  Description of Artificial Sequence:  Enzymatic Nucleic Acid
cacuuugauggcaugcacuaugcgcgaaaaucugag

SEQ ID NO: 14202 - RNA, 36 nt, Artificial Sequence
  Description of Artificial Sequence:  Enzymatic Nucleic Acid
aaaugugauggcaugcacuaugcgcgggcuacuucc

SEQ ID NO: 14203 - RNA, 36 nt, Artificial Sequence
  Description of Artificial Sequence:  Enzymatic Nucleic Acid
aaaauugauggcaugcacuaugcgcgaaaugcggcu

SEQ ID NO: 14204 - RNA, 36 nt, Artificial Sequence
  Description of Artificial Sequence:  Enzymatic Nucleic Acid
guuguugauggcaugcacuaugcgcggaaaugaaaa

SEQ ID NO: 14205 - RNA, 36 nt, Artificial Sequence
  Description of Artificial Sequence:  Enzymatic Nucleic Acid
cccugugauggcaugcacuaugcgcgaguccgaggu

SEQ ID NO: 14206 - RNA, 12 nt, Artificial Sequence
  Description of Artificial Sequence:  Enzymatic Nucleic Acid
  misc_feature (1)..(12): 2'-O-Methyl
ggccgaaaggcc

SEQ ID NO: 14207 - RNA, 37 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-C-Allyl
  misc_feature (37)..(37): n stands for inverted T
gaaggaacugaugaggccgaaaggccgaaagauggcn

SEQ ID NO: 14208 - DNA, 21 bp, Artificial Sequence
  Description of Artificial Sequence:  Enzymatic Nucleic Acid
gcagcaccttgctctccatcc

SEQ ID NO: 14209 - DNA, 21 bp, Artificial Sequence
  Description of Artificial Sequence:  Enzymatic Nucleic Acid
ctgccaacttcccatgcctgc

SEQ ID NO: 14210 - RNA, 11 nt, Artificial Sequence
  Description of Artificial Sequence:  Nucleic Acid Substrate
  misc_feature (1)..(4): n stands for any a, c, g, or u
  misc_feature (7)..(11): n stands for any a, c, g, or u
nnnnuhnnnnn

SEQ ID NO: 14211 - RNA, 28 nt, Artificial Sequence
  Description of Artificial Sequence:  Enzymatic Nucleic Acid
  misc_feature (1)..(5): n stands for any a, c, g, or u
  misc_feature (13)..(18): n stands for any a, c, g, or u
  misc_feature (24)..(27): n stands for any a, c, g, or u
nnnnncugangagnnnnnncgaaannnn

SEQ ID NO: 14212 - RNA, 15 nt, Artificial Sequence
  Description of Artificial Sequence:  Nucleic Acid Substrate
  misc_feature (1)..(7): n stands for any a, c, g, or u
  misc_feature (9)..(9): n stands for any a, c, g, or u
  misc_feature (13)..(15): n stands for any a, c, g, or u
nnnnnnnynghynnn

SEQ ID NO: 14213 - RNA, 47 nt, Artificial Sequence
  Description of Artificial Sequence:  Enzymatic Nucleic Acid
  misc_feature (1)..(4): n stands for any a, c, g, or u
  misc_feature (9)..(19): n stands for any a, c, g, or u
  misc_feature (25)..(31): n stands for any a, c, g, or u
  misc_feature (39)..(47): n stands for any a, c, g, or u
nnnngaagnnnnnnnnnnnaaahannnnnnnacauuacnnnnnnnnn

SEQ ID NO: 14214 - RNA, 85 nt, Artificial Sequence
  Description of Artificial Sequence:  Enzymatic Nucleic Acid
uggccggcauggucccagccuccucgcuggcgccggcugggcaacauuccgaggggaccguccccucgguaauggcgaaugggac

SEQ ID NO: 14215 - RNA, 176 nt, Artificial Sequence
  Description of Artificial Sequence:  Enzymatic Nucleic Acid
gggaaagcuugcgaagggcgucgucgccccgagcgguaguaagcagggaacucaccuccaauuucaguacugaaauugucguagcaguugacuacuguuaugugauugguagaggcuaagugacgguauuggcguaagucaguauugcagcacagcacaagcccgcuugcgagaau

SEQ ID NO: 14216 - RNA, 15 nt, Artificial Sequence
  Description of Artificial Sequence:  Nucleic Acid Substrate
guaugguuaaaagau

SEQ ID NO: 14217 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
aucuuuucugaugaggcgaaagccgaaaccauac

SEQ ID NO: 14218 - RNA, 36 nt, Artificial Sequence
  Description of Artificial Sequence:  Enzymatic Nucleic Acid
  misc_feature (2)..(5): Phosphorothioate 3'-Internucleotide Linkage
  misc_feature (1)..(8): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-amino
  misc_feature (12)..(12): 2'-deoxy-2'-amino
aucuuuucugaugaggccgaaaggccgaaaccauac

SEQ ID NO: 14219 - RNA, 13 nt, Artificial Sequence
  Description of Artificial Sequence:  Nucleic Acid Substrate
cagacuacaacuc

SEQ ID NO: 14220 - RNA, 32 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
gaguugcugaugaggcgaaagccgaaagucug

SEQ ID NO: 14221 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (11)..(11): 2'-deoxy-2'-amino
gaguugcugaugaggccgaaaggccgaaagucug

SEQ ID NO: 14222 - RNA, 35 nt, Artificial Sequence; identical to SEQ ID NO: 11217
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (35)..(35): n stands for inverted deoxyabasic derivative

SEQ ID NO: 14223 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-C-Allyl
aucuuuucugaugagccgaaaggcgaaaccauac

SEQ ID NO: 14224 - RNA, 32 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-C-Allyl
gaguugcugaugagccgaaaggcgaaagucug

SEQ ID NO: 14225 - RNA, 10 nt, Artificial Sequence
  Description of Artificial Sequence:  Enzymatic Nucleic Acid Stem Loop
gccguuaggc

What is claimed is:

1. An enzymatic nucleic acid molecule which specifically cleaves flt-1 RNA, wherein the enzymatic nucleic acid molecule comprises SEQ ID NO: 14222.

2. A mammalian cell comprising the enzymatic nucleic acid molecule of claim 1, wherein said mammalian cell is not a living human.

3. The mammalian cell of claim 2, wherein said mammalian cell is a human cell.

4. The enzymatic nucleic acid molecule of claim 1, wherein the enzymatic nucleic acid molecule is chemically synthesized.

5. A composition comprising the enzymatic nucleic acid of claim 1 and a pharmaceutically acceptable carrier.

* * * * *